United States Patent 11,913,074 (METHODS FOR ASSESSING RISK OF DEVELOPING A VIRAL DISEASE USING A GENETIC TEST) - sequence listing, part 5

SEQ ID NO: 166 - DNA, 1628081 bp, Homo sapiens
  source 1..1628081: mol_type = genomic DNA
agtagaatttgtatataactcaacaccaataaaattatatttgacgagactagattccctatgttctacattccactgaactattcttgttgtctctattttactatttacgtaggtacatgccttacgtgtagtactaattcattattccaacaataactcagcagtaagtggtgagaagaacgtgattttattttgaaatttatttttatcgaggtaaaatatacatatgtaacgtaccttccttaccacctgtaagtgtgcagttcagtggtaataaatacatttatagtcttttatttacccttcatcccccccttccccttctggcctctggtaaccatcactatagtcactatcttcatgagaaccacttttttagctcccataaatgagtgaaaatatgcaatatttgtctttctgtgcctggtttatttcatttaacataatgacatccagttccatccatgttgctgcaaatgacaggatgtcattcttcttatggctggataatattccattgtgtacatataccatattttctttatccatttatccattgatgggcacttaggctaaatccatattttggctattgtgacttatgctgcagtacacatgagcatgcagatatatctctttgatgtacaggtttatttatttatttatttctctgtttctttccctagcagtggaatacttggatcatatagtagttctacttttaggattttgaggaactccataatcttctccatagtggctgtagtaatttacataatttgaggaactgtgagaatattttccaaagccaccataccattttgcatacccaccagcagtgtatgagcattctgatttctccacatcctctccatctcttgttattatctgattttttcctctagccatctttgtgggtgtgaagaggtatctcattgtagatgacaaattattcagaggttaacactcgtttatgtgttgaagcatttggtcaaggctgagtattcatgaggccagtgaaataaatccatccagtgagaaaagagtgtttgcaaacagacaagaaaacaagatgtgtccagacattcccaaccacatttcgaactcttcaccttggccaagtatctcataatgcatcgttgtctcacatagccttattggaagacagcatggatgatcctttgtaaacttattgacattgttatgattccaagttcatacgccaccatgtttggttagcaggagcaattccatccgggaaagagagaatattttgtttgttttgcttatgttttaaccatctgttgagagacagaattatccttcacctctttggcagtgtctagttgatgaaaaaatcctcatagttctgttttctaaattgaatttgtgttacaaaatgattcagactgagaatgagaattttgggagtatccaggcaattcagcattccaattaatttgggatataggtcatggccaccgccatgaaatatgtgcgtttgtcaaagatgttaagactctactactcaaggctttcacctgaccaatatctcacctcccctaatacagctcccatcaagaggcaagcttgaattccagatattaattatttttctcatcctttccctgtgatttgggctgttaatatagaaaatgttattgatgataggatgatgatgatgatgatgatgatgacagagtttgtcagagcattgagcacttctcagcaggcttcaatacttgagcatcagggattttacttcggagatagcagtgatgttgaataatttcattagtgcctgactcaccaggacaaccactgtctcttgcctacccactatccatatctccttctttttttcaataaacagacctcaagctcgctcagaaaagtaataagactgattaaacccatcaatgcccctggattcccttgctgccttgggtggctgagactacaaactctttgatataaaaagacaaagatttatttgcaaaaccttcactcctttgctctttctccttttttctggactagggatcttgaagcatggagttgttgcactatcttgtaaccataaagcctgaggacgaaagcctggagcctagggatgtggttgcttcatccttaggaaaggaggggatgagcctagctacctaaggttatcactgagccatcacaccagctcacggctcagcactgaagctggaataatgttgcttttctgttatctgaatccgagtggaattctgtctgatatgctctgtcagctgcagggatctgaggattgttttacaactcagtacattgaaatatcccacatttgtctctgtgatattcggaaatcaagaccactttgaagagatgtgaaatgaagatggaatggaaaatggaatggaattcaactattgaagtggtcttcatgatgactccagacttctaacataaggtgccaggtaggtagtagactccttatcaagctagagaaactgggaatggtgaaacataataataagatgaaattaaaggattcacatttggacataatgagttgtgagacacatacttgcagaaatcaaggaggaagtgggagctcagaaaatggatctgagaaggagaagtcaatgcatacctcatcagcaaggtgatgaggaacagttgagattatccatggagactctgtggagggagctgagagtacccaccacacaccctcagcaagtccagcacttagaaactgattagagcaggaccctgtagaaaggaggataaggagaacactgagaggtagaaggaaaaccagaagaatgtgaagttaccaactccaagagagaagcattctaggaagggatcccatttagctcccatcaaatcatgcttaaacggacttaaaagaagatgcagcatagtatctattggatttgccaagatgaaatttataacattatacaaatagctctgaggatgatgccaagtagaaaaggctgaatagaaaatggtttcaaacatagcatgattatttaaatagaaatatatatgtatatttgtgttactggactctgagactaatatacaccttctcttggacataattggcttccaaaggctgacagagttactgttaggtggagagatctggagtgattcttatcttctttttaatatatgctataattttttgttcattttatacattttcaatcatttcttgattaattatatgaagtgacaaaaatagccaaattatgtggagtccattcatgtcttcatttaaactaatcctgtttttattggcaggcaatacacacaatttgggaaatggtcaattaactaatgtgttcatatcagtcacagtatttcttcttctttttttttattatagacagggtctaactatattgctgatatggtttgtctgtgtctccagccaaatctcatcttgacttatagctcccataatccccacaggtcatgggagggacccagtgggaggtaattgaatcatgggggcaggtttttcccatgccgttcttgtggtagtgaataagtctcatgagagctgatggttttataaacgggagttcccctgcacatgctctcttgcctgctgtcatataagatgtgcctttgctcctcctttgccttccaccatgattgtgaggcctctccagccatgtgaaactgtgagtccattaaacctctttttcttgataaattacccagtctctggtatttctttatagcagtatgaaaacggactaatacaattgctcaggctggtctctaactcctgggctcaagtaatcctcccacctcgttcccccaaagtgctggtattgcagccatgagccacaatgctcagtcagtcacagaatttctgaaaggattgagcttctctttttgccttgtcctgacattcctagattattgtctagacaaaaattatttccttttgaaccgagtttactataataaataatgctatgtcaaaaaaccatgggtagctttaaactcctttagattaatagattgttataattcctctcttttccatctcaaaaacctgcctcataacaaatgctccttttgcagaaatattaacagagcatttatttaatttttcatcaaagaataacagcaaaacaagaaggacaaatatgcatgtatgcgttggtatcccagaagacaatatacacataatgtataggaaataatcacaacatcaaattgacaaaactatgcatctttagtgacttcattattttaagttcatggagacccatctgtggtcgatgaggcaaaactgacagctgcctgttcttgtaaataaagttttattgaaactctgccacatttattaatttacatattgtctgtggctgtttttttgctacaaaggcagagatgagtagttgtaaaagagaccatattgtcttcaaagcctaaaatacttcctgtctggtcctttacaggaaaaggttgcagaactctgatttagagcatctactatgtgcaactaacagaaaaagaaaccttttcacgtggttaaaactcagagcaataacaaaattatcaaaaatactggaagaggtttccagaagatagagagatgatttccagctgggtaactgcagaggttaacaggagaagaaggtaaatgaggcttctttctcaaggcaaggatgtgaagcaaacatagctggagaacttggtccttttccactgggctgatgtttcctgaagactgtcccactttcttgatgagagctcctgagggtatgctcatctttgactaaccaaatgtataccagtccactcaaggttctaagaaggtctgcataaataaatgcagaatttctcaaatgcgtaataagtcatgaaataccttctcgggaatgattttgtaactatgcagaatgaggtaatgttttgggagcaggagtgcaatattctgggagagctagacttgggagaaattctgtatagccaggaaatgaggtactagatggatggttgaatttggccaaaaatagtcagaaagctttgctgctcatttgcttgttgtagtttgataactaacaacccagaagttttgggagcctttgcacaagtatgatattgaccgaggtagcaataacctaaatacaaattaaaataattcttagtccacttagaacagctggactaatgatactggctacatgacccacttaaaactgataatatttacttcttaaaatgtgtccaacagtatttgaatacatgcattgaaggaacatataatagcagtttctatagctggcaagaagctgaatcagaaaaacttgaccatgcactgcacaaatttccctgcctctcttctctccagttgctaccctgccttaaattctaccgaaagaagttaaagctcgctttgtttttgaatagatcttaaacatgatgattattgacctcatacccaaagccaattatactgaacaaaatcgagataggctcattcaaccaagaacaaaacaaagatccccatatagatatgattattggaaattctgcacaataaactaagatttggagtagaaatgaaaggtccaaatattggaaatgacaaggaaaaattagatttatttgcagattctccgaatgtctgctgtaaaagcatgatgatctattattagatggttgagcaaattgatttgttctaaagtatttcaatatcttttgtatatgccagatataagtaataagaaaaaaatgtttaagcagtcttgaaataataaaatacagagtgtaaaatacattgagatatactctgtaggggacaagtttccatcagcccatatatatgtgtgtgtgtacatgtgtgtatatatatgtgtgtatatttatatgtgtgtgtgtatatatatacatatggacatatgggctaaacttctgccttaaaacaagcaatgtgcctttattttattttatttttaaattaaattaaattttaagttctgggatacatgtgcaggatgtgcaggtttgtttcataggtaaacgtgtgtcatggtggtttgctgcacctgtcaacccatcaaccaggtattaagccccacatgcattagctatttatcctgattttctccctccccccattcccctgacaggccccagtgtgtgttgttctcctccacatgtccatgtgttctcattgttcaactcccgcttctaattgaaaacatgcagtgtttggttttctgttcctgtcttagatggcagaggataatggcttccagctccatccatgtccctgcaaaggacatgatctcatttctttttatggctgcatagtattctatggtgtatatgtaccacattttctttatccagtctatcattgatgagcatttgggttgaatccgtgtctttgctattatgaatagtgctgcaatgaatatacacatgcatgcatctttgtaatagaatgatttatattcctttggttacatacccagtaatgagattgctgggtcaaatggtatttctggttgtaggtctttgaggaatcaccatgctgtcttccaaaacggttgaactaatttacattcccaccaacagtgtaaaagggttcctgtttctccacagcctcaccagcatctgtcattccttgaccttttaataattgccattctgactggcattagatggtatctcattgtagttttgatttgcatttctataacaatcagtgatgttgagcattttttcatgttttttggccgcataaatgtcttcttttgagaagtgtctgttcatgtcttttgcccacattttaatggggttgtttgatttttttctggtaaatttgtttaagttccttgtagattctggatattagacctttgtcagatgaatagattgcaaaatttttctcccattctgtaggttaccttgtttactctggtgataatttcctttgctgtgcagaagctttttagtttaattacatccaatttatccatttttgcttttgttgcaattgcttttgaggttttcatcataaaatctttgcctgtgcctacatcttgaatggtattgcctacattttcttctaaggtttttatagttttggtttttatatttaggtctttaatccatcatgagttaatttttctataaggtgtaaggaaggggtccagtttcaatcttctgtatatggctggccagttttctcagcaccatttgtttgtttttgtcaggtggttgaagatcacttggttgtagatgtgcagtcttatttctgagatctctattctgttccattggtctatgtgtctgtttttgtaccagtaccatgctgttttggttactgtagccttgtagtatagtttgaagttgggtagagtgatgcctccagctttgttctttttgcttagcattgtcttgtgtatatgggctcttttttggtttcatatgaatttttaagtagtgttttctaattctgtgaagaatgtcagtggtagtttaatgggaatagttttgaatatataaattactttggccgtatgaccatttacatgatattgattctttctatccacaagcatgaaatgattgtgtcctctctgatttccttgagcagtggcttgtagttctccttgaagaggtccttcccttgttagctgtatttataggtattttattctcttcatagcattgcaaatgggaattcattcatgatttggctctctgcctgtctattgttggtgtataggaatgctactgatctttgcacatggattttatatgctgagactttgctgaagttgcttatcagcttaagaagctttggggctgagacgacggagttttctagatataggatcatgtcatctgcaaacagaggcaatttgactccctctcttcctatttgaataccctttatttctttttcttgcctgattgccccagccagaactttcaatactgtgttgaataagagtgatgagagagggcatccttgtgtattacattaatggccacccttcatgtcatctgctccgctgagtctacaggccaggtaaaaaaatttttttttcaaatagccatggggaaccaataaatgttttatgcaggaaaatgacatgatccaatttttgttttagaaaattctataaactctgactacagagactagaacacattgtaggtgatacatcctagagccagaggggccaaagagaaggaagtgtttgctgtaaaggagaaaaaaaagttttaaaactgtatatcctaactctgaaaaatgaggacataggtttttacttaaatctctctgatgtcctaggagccttaaaaagtttaagaagcatctaggatagctatggactcctgagaaaagttctttctctatgatcctcatatatggaaatatatgtttccttctgcaggttcctggcggaggttctgtgtcagtctagggcatgtctgcatgactcccacttgcttctggcttctgggagtcatgcagacatgccctagactgtcataaagcctccctcattttgagttctgcaattcctgctcttgcaatctgtgctcagctcagaggccagggtatttctctaaaaacataaaccatagcatgctctctgctgctaagcctgttgatgtctgaccaggttgttgcccactcactgcctggataaagctgaacactgagacagagatgttgccgtaaagtaagagtttaattattgcaaggcaaccgagcaaagagaacaggagatatttctcaaagccacctcctcaaaacttcagaggctagggcttttaaagttgatttggcaggcagggggactagtggcaggtgctgctgattgatctgggatgaaatcataggcgtgttgaaactgtcttcatgtactgaatcagttcctggaaagagagggagtcacaacaccagacaagtcagttcattggttggggtgacaggccactagtctggttgctgtcagttggcccactcgcgagccaggtctgaaaaatatcccaaagaccagttttaggttttacaataccttttgtgactgccagttactatggaaagcaagctgggaagcagtggtaggttatcgtttactatgcctggagtatagcagaaaagttttcaggaggtgatatttccagtaatcaaagctgcctggcaccccccttggcaagctcaacttctggaagccattgagggggtctgcatgatctaaggatccctgttttttaaaagaaaaaacaagttcattaatcttgcgggcagcctgcctaggggctaggacaggaagataatcaattattagtgattaccacttactgaaatgactataaacaaacaatcatgcatggaggaggaaaacatcagagagaaaggaaaatatcttactgaaattcaggcccctaccataattttaattttgtggccttttaaaattctatgaaggcagtttcatacctctgcaacaatgtacagctgcatttgaaatgcactgggaacacttggccctggtttatgcaactccatcttatcctctgcaccatcattgtccactctaaaaggagacttcagaaagttcatggaaatattgtgttatgaacaaactatgcatggatttcaaatttttgttccaccaagataaactcatactagcttgttataacatgggtcgagtttgaggcacgaagaaggattagacatcagtttgaaaagagcccctatcagagcaatatgaatttcactacaatggaagcaagaacaaacatcaaatttatgatgagccttgggtggaagaagggtgaaatcatggatgctttatgaaagttttatcaggaaaatgctcccaaagaaatcagcaatttacaaatggataactcattttaagaagggataagataatgttgaagataaagcttgcatggaagaccatccacgtcaatttgaaaggaaaaactaatcttgtttgtgccctaattgaaaaggactgatgattaaaagcagaaacaatagccaacaccataaacatctcaactggctcagcttacacaattctgactgaaaaattaaagttgagcaaactttccagaagatgggtgccaaaattgttgcacctggatccactgaagacaagagcaaagctttctatggaaattttaaacaagtgacattaagattttgaagcatttctctgaagaaccattaaaggagagaaaacatagctttaccagtaccatcctcaaggaaaagcacaatcagagcaatgattaccaagaggtggaaggggttctgccaaagcaaaagtggatggatcaaaaacaaagatcatggcaacagttttttggaatgatcaaggcgttttacttgttgactttttggattgacaaagaacaacaacatctgcttattatgagagtgttttgaaaaaattagctaaagctttagtggaaaattgtccaagaaagcttcaccagagaatccttctccaccactacaatgcttctactcattcctctcattaaacaagggccattctgcaagaatttcaataggaaatcattaggcatccatcttaaagtcctgatttggctctttttgactgctttttgtttcctaatcttaaaaaaaaattaaagggcacttttatttttttaacccatttaaagggcacccatttttctttagttaataatgtagaaaagatggcattgagacggttaacttcccaggagtctgagttctttaggaatggactaaaatggctggtattatcacttacagaacttgaacttgatggagattaagttgagaaatatagtttatattttttacatttttatcttttaattccatttgtccacgaactttttgaagtcccctcatgtctaacggcagaggaattctttatatgcattcaatagaataagccacttcccactgccaggccctttccctggctgtacctttcatcaggagagagaaatctcttgcctaattccagccctgatctcgcatatgatcagacttggacatggaatatttatcaggtgctgtctcttctggttttcctctagccaagtctcaaatctccccactaccagggtccagaactatttttcttttctatgtctcattcaaaagagtgttctttgtttattttttccattgctaccttcaaaatggatacacctactgtgtgagtaacacctactgtgtgagtaaacagtagcaaagaagagatcctctttcacactgaaagtgcaactaagaaaagacatcctcataattacaaaataagcgactgaaggataagctagacaatttctcacacagcttctccatgtgggctcccaaaaagaaattgttgataaaatcctgctaacttcccacttctactttttaactcaatctccaaatgtagttcatgatatgattcaggaaaggggagggcttatgtatgcaagcattgctcacaatctctcatttttatattctcggtggctgttttgttttgttttgagacggattctcaccctgtcgcccaggctggagtgcagtggcgtgatctcagctcactgcaacatctgcctcccgggttcaagcgattctcctgccttagcctcccaagtagctgggactaaaggcgtgcgccacgccaattgtagtggtggagaaggattctctggtgaagctttcttgggcatttttctgctaaagctttagctaatttagactggataatttttgtattttttggtagagatggggttttaccatgttggccaagctggtctcaaattactggcctcgggtgatccacctgcctcagccttccaaagtgctgggattacaggtgtgagccaccgcacccagcctcggtggctgttttgaatacacagatccatatgagtcttttagcatgaactatgcaaaagcaatatgccatcgtctcttccatttacctataagtcaaaagataatacagttctatgttcttagtgtcactcacaaatgacatctctggcatcctgtgtgtctgttgggcttctatagatcatgacagacagcagagatagaaaatcaacattcaagtcccactttcccttccaataggagcaccatttcctctctatgtagcctgtattcacagaatatctgcttgtaaagcctgcctgttccatatcccccatgaggcagagcatacagtctagtcatttctgtcatttgtccttgtaatgggttgaatagtatctccatgcagacatgtccacccagaacctgtggatggaaccttgtttggaaaaggggtctttacagatgtaattgagttaaggactttgagatgaggtcattctggattagggtaagccctcagtgtcatgagtttataagagaagagaagacacacagaggggaagccacgtggtgatgaaggcagagactggagtgatgaggccacaagcccagggacacctggagtcaccaggagctggaatcggcaggaaagattctttccctagagcctccagaggaagcatggccttctccacaccttgatctctgactttttttctccagaagcaggagaataaatatctgttgtttaagccacacagcctttggtaaattgttctggcatccctaggaaatgaatactgtcctgtagtataattatgaattttactcaatagctcatctctttaatgaacacttacattttgactttgtgttccaattattgaataaaagacttggtaatcaaatagaggatgtaaattcagatactgtcctgcaggtgagggagattctgtttagaggagtgagccacttgaaattccactgcttaggtgaggtaacgagccgcccagacagctctcccagacccctgggttaataagcacacattaaagatgaactataggcatgcctcagctaacacaggccttccatgaatgagtagactgtataggtgcctccgatattggtgggtaggtaggtgttcctagtgtattttcaaacagataaagaagagtttaaaaattaattttaataaagggagaaataacttgtaatggtaaattctaagaagacattatgtctgtgacgggcacatcagaagatgcctacattgattttcttaacttgattctcttacaagctagaattaaagtatcctaaagtgccaagatgaggatagttaaactatgaagttttgagaaggtgagtatctgtaatggagctaatcattaggaatcagaccaaaataaagaatcatttgattacacattttttttagataaattatgagaaacaagtgttagagaagaggttctcaaagcagtgtccacattagcagaaacaggctcatctgggacctgcttataaatgcacattctcaggtcccaccccagtcagacttgctaaatcaaacgctccagagtgaggcccagaaatctgcatttcgacaagtcctcccagagatgcagatgcaaaacttctgctagaatatggctaacacgaaaccgtttactctactagctctatgagtagtttcatagagaatgtgacaattgtatagaaagaatatagtttttactactttggagaaccgaacatgtaaccttttaatggtttcttaacgagactggctattgggaaatctgcattttattattaaaccttagtgataacaggttttcagctaataaattacatctggacaaaacctggctgcggaaaatggctgcaggagagcccatttttgatcacgcccctggggaaaacctggaatcagtgctgagttttcccttcctgaagcagttggtaacagcctcgtccctaaattggctgctcaagctgctctccaggaaaagttaatatgttcccagaggatgaaatcaaccttcagttggagccccaccctgggagatgcaaagccatgcgtctctgtgggatacacaggtgacctggagaaggggtgcgggtgaactccagagaaaaactgaaaagtttactctcccgtctctcttgatttccagaaaagagtgagaccagtaggctccgtgtccccattttccaaagcttatttagatttcaaaaccgctttgcagacccagccgtatgtgttgcataaagcctgttgagtttattactgatgacagtcctagctctagtaaaaaagaatgcaacacgaaattaaatcatctcctcgataatgacaggattgcaatcagagaataaaatttgttttctcatctggttatacccaaaaggctacattcagatgagccatctttccattttgaagaagtgaaaatcgtatagaatatttgtgtgagtgtgttgagggagtgctttgacacaggagaatcatagagcagcaggaaagtggatgtgaaagttagtcttcccagtaaagtgagagtgaagggaagatacactagaaacaggatatttcaaggtaattgaaacgcaaaagtgaatccttttttttttacttaattatgatagaagacaaaataaagagaatcttagaaatcttgaatattcacatcagtttaagtaagtaataaaaactgtatttactgtattacagaaaactgtaaataacatagaaatagcatttgctctctctgtctctgtctctctctctctatgcctgcctctctgtttctttctgtgtctctgtctctctctctttctttcacacacacctctccatttaagatagatagatagacagatatagatatagatagatagatagatagatagatagatagatagatatagatatagataaggtaacaggtagtattgctctgagtgggatatttacaatgtggtacacgtgattttgactgtgtttgacattcttattgtgaaaaaggatataacttggaaataaattacgtttatgcatccatacacactcttcaaacaggcaattggattgaaagtatgccagtgagactaaaaatcatacaactccgtgtaatgtggaaggtgaaggagcattttagaatgcatgttaaaacacaataaacataaggatagattctgtgatagaacagaatgcctgaattcctatcccaggatgtgatttcaaggcacaacgagataaaatgcctggagagagagaataacgacgactttagacactgaggcaattcccagggtaagttcacagtgacacactgctcctggaccttgagcaaatgagcaatggtcggttgggctcaggggacttctggggtggactagccctggctcggggtcagaagaagcttgacacagcctttgtccaagccgtacatctatcgatctaggaacagcaaaagtgcactcagtgggatttaggactttccccaaatcgttagagacacagagctccatcggtcatctgtggattctctcagttcccatgtcttgtcttgaggtttttgttggtttgggatttcattcctgctttgtccaataattcccccagattctgctgggatcacccagtactctctcagcatccacctttgtccctattgattgatacctgtaacctcttgctgtctgattttcccaccaatcccccagtgcacatccacaccacccctttgaatctactttttttctccaaggttaccagtgacctcagaaaaagcagtcagatcccgttaactcctgttagtccattattgacattacagtatttgactctgttcacgtgcatctcagtttcaaggcatggctctgtggctttgagtctgtttgccttcttcattgacttctgtttcaacaacacttcttataagtcagaatttcccaaagctatgcctgagttcagcctgtgcctccaaactctgctttctatgggctcctaaccatccctatagcttccaccatgagttctctgctgctaagtccctaatctgtgattctctgctctcatttctaaatgccaaacacctacacccggaactcagcacttctaaaattaaattcgtgattgcctactctcttcttgcagtcttgattgtttatttgtgttctctaatttaataataaaaccatggaatactacgcagccataaaaaataatgaaatcatgtcctttgatgcaatatggatgcagctggaggccattgtcctaagtgaactaatgcagaaacagaaaaccaaatacaagttttcacttacaaacaagagctaaacatgaggtactcatggacataaagatgagaacaatagatactggggactcctagaacggggagagagggaggtgcaagggttgaaaaactacctactggggactctacttactacctggctgacgggtttaaccatacacaaaacctcaggatgatgcaatatactcatgtaacaaacctggatttaaaataaaagttgaaaaatgtaaaaaaaaaaaaaaaaaaaaaaaaaaaagggccgggcatgatggctcacacctgtaatcccagcactttgggaggccaaggtgggcagatcacctgaggtcaggagctcaagaccagcctggccaacatggcaaaaccccatctctactaaaaatacaaaaagtagccaggcgtggtggcgcatgcctgtaatcccagctaatcaggaggttgaggcaggagaatcgcttgaacccggaaggcagaggttgcagtgagccaagatcgtgccattgcactccagcctgggcaacaagagtgaaactctgtctcaagaaaacaaacagacaaacaaacaaaaaccaccttccttgcctgcagactcaacatttcgctttgttttatcatggtctccttcccatccacccactcagcaatacaattggttgtcaaaatctattatttacagctttcaaacgtctcttctgaattcttctctcgatttttccttgcattcatcaagcacttgcccaccccgttgtatttgcacctccctgatttttctctagtttctcacttcttccatctcattgttttctttaaaccacaatcagcccagccctattaaatatctttgaaagaaactacatttttcttagtattagtcgcatttctcagtcaacatttgaattgttatcttttttggggaccaggttatacatctgcctcacttacctgacacctatttgaagtctaagatgatttcttgttcatccagaagcttctgcacattcagcaccctgtcacctgccaagagttgcaatgcacccaaaatcaggttgcctctctgtttggtaaggggatttttcaatgtgcttcaagctgaacatcatatatattatctcattcagctcacaacaattctgtaaagtattgattatgcctccagtatatatgaggaaaaggaagatcacagtgattaagcaattttgcttaactggttagtaaaagaattaaatatttattgtgtggcttggaaaccatcatttttctcccaagacaccacactacctctcagtaagaatatgtcaataattaatgctggatagatctctccggttctatcacaaatgggaccaaaatatatgacccctattcttcacttttcttcttatgtgaccaaagaagtctgtccacacaatatctaggacacaccatggaaaaaaaaaaggattaaatcaaaattctttttgtgtaatggtgggaggttgaatccacagtccccaaagttgttcacatcctaatcccagaagctatgaaaatgtcactgtacctggaaaaaaggaaatgagtaaggatcttaaaatggggagatcatcttgggctagccaggtaggtctttataagagagaggtaggagggtcagagttagagacagagacgtgaggatagaaagagatgtcagagtgatgcggggccatgagccaaggaatgcaggcgggctgtgggagatgggataggtaaggcagcagactttctttcagagccttcagaacaaatgcagccctggtgacctattttggacttctgacctatagaactgtaagacaactgtgatggtaaatattgagtgttaatttgattggattgattgaagaatgcaaagtattcttcctggtgtgtctctgagggtgttgccaaaggcgagtaacatttgagtcagtggactggaaaaggcagactcactctcaactggttgggcaccatctaatcagctatcagcatggccagaataaatgcaggcagaagaacatggaaagacagactaatttagtcttctggcctccatctttctcccgtgctggatgctccctgccggtgaacatcagactccaagttcttcagctttgggacttgaactggtttccttgctcctcagcttgcagacgccccattgtgggacctcactatgtgatcatgtgagtcaatactccttaataaacttccctttatatatacatctatcctatcagttctgtccctctagagaatcctgactaatacaacaacatacgtctatattgttttaagccactggatttgtggtaacttgttgtgacaaccataggacactaagacagccattgagattaaataaatttatgaaggatgaaaaattaatgagcacagataaaagactcttccatgcaggagcagggaacatggaaaaatactccccttcgtattttttctctttattttttaaacaaattctctccttgcatgcaagaaagaatcatagaggcatggtctgaacaaaagggaatggatgcattggcttccccgacttaattggggttgagggataaattttaggattcccagtgaagtttgaatttttgttgaacaacaagtgattttttaaagtgtgtgtattctgcagagacttacctcattggtatatgtgacacaggagttaagaagaaatcacttaggcagatagtaagggtatgggagtcctcagtaaggctttcctttttaatgaaaagcagccccaaatcgttttctaggaaagagcagcctgtaaagtcgagctgcagacatagacaagcaagctgggagcttccacgagtgaatgctggcaggaacttaagactagacatgttcaagatggcagctccatcttcccttttctgtcagccacatgtactataaggagcagacaagatggcactgatcaactggaaagcccatttgcataataagattagggtggggcaaccagtctccccccgaacccacacactatgtaaatgtcatacctgatcgaaccgatctgttaagccctatgtaaatcagacactgcctcctcaaacctgtctataaaatctggcgcattctctgccagccggtcctttctgcttggagacccctttctctacagagagagctgtttctctttctcttctcttctgtctgttaaacctccatcctaaactcctcatgtgtgtccgtgttctaaattttcctggcatgcgatgacgcatctcagggtatataccccaggaaacatagccacttcatatggacaccattattttaaaaaatagattgcagagtccctaatggaaatagatgaagacacagctgaaaagagtagatgtttagtgcatgtattcctcacggcaagtggttttgaagcgcggctcagagagccatggttcttgggctgaaattgaacccgactattgatttatatatgagaattattcccaaaacagagttagattgcatttatacactcatcccctcttccttcaaccaaattattgattttcatagattaagtgggcttcttattcttgtgactcttcacctcttgaattctgtatgcatttttaagcaaaatgcagacattttatctactcttctatgcaaatatttactggctaaaatttttaaaaagcagcagcctccagaagacagcacaatgagttatcatcagtcacaattacccactcaaaagtggtgggatatggaagtcaggctccaggacatgccttgataccaagaagagtggttcattgtagaaaaaaaagtctgtcagtgaaacaccttacatgtaattcacagataaagatcataggttttaaaatggcaagtccagagagttgtgccacctatcttttttgataagtgattctgataaggtttccctaagaagtgaacacctctaggtatttagagctcattttggcaaatgatttgtttttctaaaaaatacagaataagtgtaagtttagctaatgcaagtttagcatttatgcaagtttagaatttttaattgggttcaatatctgcttttgctgccaaacttctgaacagtaataacaggtagtaacaagatgttcaagatgttatccaaataaatgagaactggcagtaggggaaaaaagaagagtttagtgtacacacgcacatatatatacatatatgcacatatacatatatacacatgtacatacacactatcatacaacatactgtcaacctaaaatcatcaaaaggctcagaatccagtataaaagagtttattcagttgcaaagctaagaacagccattcaggtaacacagattctgaagaaatgggatcattgcttctaaacgggaacgctaaggtcttgcttatatggggagaaaacaaaaaaaaattgaacaggattacaatagtttttctacaaggctagtttatgagtttcagcaatttgattaattacagctgttttattttccttttccaattaaaaaatatatttaatatttcatcttagacaatgtggtaattgtgaggtctttctgtatgagaagtaagagagaagttaatccataatgaaaatcaacagtgcagtgggaaagggatcttccctggtgccctttagcctttcacaacattttacaaaacaatgtaggtaaagcaaaggctatttcataatcagcggaacaaatgttgcagctgcgtaggttacagctgtctgtcaggttactcagttctcataattacattcctttacgtctaaaacaaaattaaagttccaacagctttaattttgagttccttatttttataatacttatactaaagagttttttgttgtttatctaaaatttgaatatagctggtcgtcctgtatcatttactagttctgacaactctaaatggaaagttcagagtttgggcatactttggagaaacttcatctagcaactcctttatgaaccaagcacttgttttttctcctcacactggcctgcctgttgtctcattcatcttaaagttgactccattgatggcctaaggtcacttccaatttcactgcttcttgattcacgtccagaaaagaggcatgagttcacttaccccaacattcccggccaatcagagagctcagggggagataatgttatgatacaatttatctacattgcctatactcaacctggaaatccagggccatggtgatcttcttcagaaccatgtagcaaccaaaatatttaggaaagcaggagaagccatgagcagatgccccctacactatgcacaaaaccttgagagtgagaggtaagaagaccttgagcatggatgaagtctcactatagggctgtttgctaagcttggaaccttcagctttggggagtgtacttttgagcgtggatgctatctccagtttcctatatgcttggacttcaataattcttatgactagaacacatctgtttattattttatcgtttgatgctgggaattttgtgtttattctgtgtattaaggagagagtcaaagggttaagagtcaaagggttaaaagtcaaagggttaagttaaggtttcctctagtgcaggagttggcagatgtttggaggaaagagccagataatgtgttcagctttctggaccccacagtctctgctgcagctactcaaccttgctgtcatatggagaaggcagctacaggcaatatgaaaatgaatgaatatggtagttttcccatttatgcacactgaaatttggatatcgtataatttttattgtcatgaaacataagcctccttttgattcttttcccagtcatttaaaaaacatgaaaatgtattcttagccaatgggccctaaatgaacagatggccagacagatttggcccactagccattgtttaattgctcttcctccatggtggtagatcccttatcttggccgcacatcagaatcaccatcccaggtaaatctaattatacttcttgtgattgagatccctgaatcactagttctagagggaccatcgttgtaggcaacttaattcactcaagtggtaacagggtagagttcagggcagaagatctactcgagcatcactgaccttctgctgcatcacttacgctgcaaatctggagaaacagccctgggttaaaaaaggtgaagagcttcaagacttataaaaggctttttagaataaggagagtgtgaagggcaaatgcacacaaatgaggagtccagtaatagaaagcacgtcaccattcctgatacactctgaacaccggtgtgattgatagtctcccaacaaacattttcatagaatctgcattgctatctgatggcctgaaatgatcttttaaaagtcagggtttcaaacttgatagttctaagttatttaaggtaccacataacagcagagtacttatcaccagtagaaatgatttctccaaaggaaaaaaaaaatcacatattgaagactccgttaaaatagaattgtttctaatccaagaataaaaatggtagtttataggaatattgagttataacaaattttggcttctacatatactgatggctctcaaataggaatatttcaaatacctagatgtgtgtatatgtgtgtatgtgtgcatgtgttttgtctcacgatttcaagtgaattggtctgaatgttttgtaaaattacaataaaatatcatgacaagtctatcgtttcatctgacaaatttgcaatatttaatggaattggcataaaatcctctgtcaattgaaaatatgtttgaagagtacaaggaaaaggagagttacacttttgagaccaacatttctcatctcataaatgggaaataattagggtttttgaattttgttaggcaaatttacattaatcatatttttattttaaaaaatatgttgagttagcacattgcatttgttttcaaggaacttctataaaactcttttaattttttaatttttttttttgagatggagtttctctctgtcacccaggctggagtgcaatggcgggatctcagctcactgcaacctccacctcctgggttcaaggaattctcctgcctccgcctcctaagtagctgggattacaagcacctaccaccatgcccagctaatttttcgtatgtttagtagagatgcagtctcaccatgttggccaggctggtctgaaactcctgacttcaagtgatctgcccgcctcggcctcccaaaatgctgggattacaggcatgagtcaccgcacctggtgaaaacctttttaatttcatttattccatttttcagatatatgtatgtgtgtgcccgtgtgaagtctgtatgacagtatatatgtctgcatctatgtacatattatatagatattcatgggtataggatgggggatgagggaagagatttctttttaagtggttagccatatggcttgtacagccacactatgatctttgcttatccttctaattaataataccttcaaatgtgcatgagaacaacagcaagatctctgcaaatcatagtcagaatttgtcattttgcaaatttagggaacaagtttcaaatagaataatttgaggattttaaatggtttaaagatttcataccccagtgatttctcttttattgtcacaaataatgtaaattttctccctataaaaatgtaaaagtattaaaagggtatataaagtctacaacagttacttgtgtgcaataatttgacaaggacatagagtgcccagatatttgattaaacattattctgggtgtgtctccgagggtgtttctggctgaaattagcattgaactggtacattgggtaaagcatattatcttccctgctgtgggtacacatcatctgacccatggaagacctgaatacaataaaagactgagtaagatagaattatttctctctgcctgacggtcttagagctaaggcactggtcctctcctgtcttcagacttgatcttggactaaaaataacattgttgactctactgatccttagacctttggattcacactggaccttgcaccctcagctctccagggtctctagccaaaagactgggattcacaccattggctctcttgagtctcatgccttcaggctggaactcataccatcggttttcctgagcctcaggcctttagacttagactgaaactcacaccctcagctctcctgggtctcaggccttcagactcagctggaactcacaccattggctcttttgggtatcaggccttcagattggcactcacaccctcagcttttctgggtctcaagccttcagactcaaactggaactcacatcctcagctcttctgggtctcagaccttcagacttagactggaactcacacccttagctctcctgggtctcgggccttcaaactcagactgaaactcacatccttggctctcctgggtcttcggcctttagaatcagactggaactcacactctcagctcttctgggtctcaggcctgcagactcagaccagaactcacacccttagctctcctgggtctcgggccttcaaactcagactgaaactcacatccttggctctcctaggtcttcggcctttagaatcagactggaactcacactctcagctcttctgggtctcaggcctgcagactcagaccagaactcacaccaacacctctcctgggtctcaggccttcagacttagactggaactcatacccttggctctcctgggtttcaggccttcagaccagaactcacatcatgggctcccctggctttccagctttcccactgcagatcttgggacttcacggcctccacaatcatatgaaccaattctttacagtaaatctctctcattgcccattaaagcgagaatggtaaatatatgatgtaccatttctaagaaattatgtgatttctaagaaaaatgttttgttgttgcttgtcagtaatacctctaattcaaatgaaagtaaatctgacctttaagactgacaaggctgttaatccaattcatgttcaaagcattgttgtatgacttgtacaaaaatatagatgtgaagaagacagaattcagaccctagaacatttaggaccattcaggagggagatgtgtgcacaatgggccatacagtcaagactaaagagcacctaaaccattccactccccagttgctgactccaaaccaagcttttgtatgatatgtgcccatgttctgagcctgaatcccaaacaaggcccattggttggaaatgtctttattatgtttgtctctgtttaattctattcctttctcattcctctggaagagaagaaagataagtggtacaagatacttagtggtacttagtagttctcaacttgggggtgatcttgtaccacttctccaggagatgcttagcaatgtctggagacaatatttttgattgtcacagttgaggagaaaaggaactactgggtaaaagccagggatggtgctaaacatcctacaatgctcatagcagacctccaaaaccaaaaattgtctggcctcaagtgtcaatagtgttgatctcgagaaactctgctgcacttcagttttgataattctgacacacagtgggggaaacagcacaacaaaattaatgaaaaccttaactaatataatgcttgtaataaatctaatatgaattggaggttcatcacatcttgcaaatattaattcagtttttaaattttggttttttaaatttgttttgtttgaataaacttttaaagagcttcaattctatgatagggcctggggataaaaagcaaagtaaaatgctcatgcaacacttgaagttcagcagagaaagtagatgtgcaaccacatgtattagtcagggtactccagagaaacagagccaataaaaagatagatagatagatagatagatgatagggagataattagacattgagatagatagatataaacagatgtagagataggtatagatagatagtgtattagtctgttttcacacgctataaagatactacctgatactgggtaatttatagagaaaagaggtataattggctcacagttctgcatggctggggaggcctcaggaaacttacaaccgtggcggaaggcaaaggggaagcaaggcatgtcttacacggtgacaggacacagagagcaagcaaaggggaagtgctacactttaaaaccatcagctctcatgagaactcactcacaatcacaaggacagcatgggagaaactgccctcataatctaatcacctcccaccaggaccctccctcaacacatggggattacaattcaagatgggatttgggtggggacacagagtcaaaccatatcagatagatataaagacatagatatagagatagataaatttaaatagatatagaggcatagatagacatagagatatatagagatatagatatagatacagatagctatagatagatagatggatagacagatatagatatgtagatggataaatgacagatttatgataaattggctcatgcaattatgaaggctgagaattcccatgacctgccatctgcaagctggagactcaggaaacctggtcttgtaattcattctgagtttgaaggtctgggaaccaggacagtcaagagccaaggagtgtcaaccagcccaagagcaagagaaggtgagatgggatgtcctacctcaagcagtaagtcagaaaaaaagggatgattcctaattcctcctccttttgtactattcaggctctcggtgaattggactaatacactgtctatctgtacctatctctgtatctatttctatatctattaatatgtatctttctatctatcactacatctacctatctctacatctatctatctatctatctatctatctatctatctatctatctatttatctatctcttattggctctgtttctctggagtaccctgactaatacaccctcacagacacacacagaaataatgttcaacctgggcaacccatagcccagttaactcaacacaagtcaaaacaaacaatcccatcatacacactacaatactgtacaatttaataatggggcaaccctagcctctaggagccaggacaaggatttacttctcctaggggagcctgggtaccttcatagaggtggtacattgggtgtgggccttgagggatcagagaatatcagacggaaaaggaaaagagagggatccaggatggcaaacaaaagcccagcacgtcagaaaaggtgagtgtgttctgagacattaaaaagccagtatggctaaagccaagttagaaatcaatttcaataggatgttgagctaaagacagggaacatgatcatggttgtggatgtgattggcaatttgagaaattcacacactgactaaagacaacactttcaagaagtttctctgtgacaataagacaagcatcatcaaaaccacagtgagatatcacctcaccccagttaaaatgtctattatcaaaaagacaagaaataacagatcctagaaaggatgtggaaaaagggagctcttatgttctgttggtgggaatgtaaaatagtacagctgctatggagaaccatatggaggttcctcaaaaagctataattaggactaccatatgatctagcaatcccaatgttaggtatttaccctaaggaaaggagatcagtatattagaggaatatctgtactgtcatgttttttgcagcagggttcacaatagaaaatgtgtaaaatcaacctaaatgtccatcaatgaatgaatggataaagaaaatgtgatatatatgtatatatacataatgaaatattattttaccatataaaaatgaaatcctgtcatttgcagcaacatggatggaactggaggtcattatgttaagggaaataagccaggcacagaaagacaaatatcgcatggtcacaatcacatgtgagagccgaggaagtggatctcatggaggtagagaatagaatgacagataccagaggctgggaagggtagtggggaggagggaataaacagaagttggttaatgggtacaaaaatacagttagatggaaggaataagttctagtatttgataccagataaggaaagtataattgacacaaatttattgcatatttttaaattgctagaagaaaaggattgaaatgttcctgacacacaaaataagacaagcatttaaagtgatagaaacgctaatcaccctgatttgatcattacacattgtatacaggtatcaaaatctcacatttacccccaaaatacatacaactactgtataccaacaaaaatatattttaaaaaacacgtgtccacataaatgtttttcctccattttgtaataatagagggaaaaatagagttggctttttgagctggcttctctcaatttttggatagcttgcaaatattttcatcagcctttacaaggagtgagacaggcatgtttatgcttttctgaagctgcatgtcgaaatttagacacctgctggtgtctaacaggtcggaggtggctttatgttgggaaggagttgaatcaataagcagagatttcagcaaaggggcagctgagatagttgctcttggctctacaatgtctgttcttgtgtgcaggatcaggctctcccataagacttcagtcttggttttgcatctgaatgaaagatatctggcattcctaggagattgttttagttcctttcatgggtttcacagattgagcctcttttctacattcttactacttctgcctttgaacagttttcctttgcctcattcagagacatttgcaacagagatgtccttccatcagtctcttcctctcaaacatctctgtgttactttttaaaagttcctgaatatggtaacaaacaggggtctagtttcattcttctgtatatcactagccagttttctcagcaccagttattgaataaggtgtcctttccccatttacttttgttgtcattgcaaaagatcagatgattgtaggtgtgtggttttatatcttgggtctctattccatttatctatatgtctatttttctaccagtaccattctgcttcggttactatagccttgcagtataatttgaagttgggtaatacggttcctccagctttgtactttctgcttacaattactttggttattcagcctctttttcggtcccatatgaattttagaattgttttttctaattatgtgaagaatgatgttggtaatttgataggaattgtgttgaatatgtagattgctttgggcagtatggtcattttgacaatattgattcttcctatccatgaacatgggattttttttttttacaccatggaatactacgctgccatttaaagaatgaaatcatgtgtttcacagcaacatagatggacttagccattatctgaagtaaaataactcagaaaatcaaacatcacatgttctctcatataggtgagagctaaacagtaggtgcatatggtcataaagatggaaacgataggcactggggactccaaaccaagggagagtgggagggagcgaggatttaaaaactacttattgggtactatgtttattactttgttgggtgatgggttcactagaagcccatatcccaccattacacaatacctccatgcaacaaaccttcacatgcactttcaaacctaaaatttaaaaaacagtccctaaaaaaaaataataatgcggaaaaaaaacacacaaagaatgaaaaacaattaaaacttattatcccagtaccctcctcctccacctggtgcccctagccttcccctattgcgggatctggccagcagcccgcaatgcaacggggctctccctctgctcctaggtggatcggcaggttgagaaataatagagacacacaatatagtgaaagctgggtccaggggggtcaccgccttatgcttccacggtgccaaccatgcactggatataccagcatttattattaagtttagtgagggcgggggtaggttagtgagggatttagggtcatttgattatgaggtgagatggtcacatggggatgaagtaattcttcaacataacatttgtatgtagaagtacagtacatttgtatgtagaagtacagcatacagagataagaatttacaatatagtgtgtgcgtcagtaatttctaacagagccttagaacagaaacacagtccttccataacctatgattagcaagatattaatcagcagtaacaattgcaacaaaagctggttacaaacaatccatggaaacaggacgtgaagctaaacaactggttagaccagaaattctcagaagggagtatgctttaaccctaaaggggcctagaagagctgtggcaagatgagggcgtttatagccctatcttatccatatggacaggcgccccccatgcttccatttataggctctccacaagggtcgcattccattcccagagctatgaacatctgcttttctgggataggaatcttggtgatgtgaaacctccctgactgcacgtccattcataggctctctgcagggggaagcacatcacgcactgttggctcgttctggcagtccaacctggcattgtctttacacaatcctgcatgcaattttgtatttacaatactcaggagcatttcatcttttattccatagcaatagtttcagggggtctccctacattctcccatgtggtcctgatgcctcacctgctggcatctccccatctccaacagccaggtgtgttctactatgctccctcatcaaagatgtctcaggatctgtttgcacagcctccaagtgcagccaaacctagaagagctgatggtccctcatctaaacatagggaaatgagtggtctgatttatgttcctgacaagtgacctaaatataaaatgcatgccactgtcacagagtctaatccacccccaccacctcctcacttgcattctccgtctttccatttgtcatttacttagcagagtcagcaagtgctgccaagctctaagaaccattatcgcagaagcaaccatcgtcaagaagcctgcacacatgtttattgcagttgatatagatgctagtaaaatgcaggacagttttaattctttaatttctcatctgcccatcttgtggtggagctacacggatatttaatgtgatgtcgtaaagctctgtgttaggaggagaaagcaggcaggaagcggatgtttgcaaacgataggcttataaaggtgagggtagtgaagttaccagactgacaacctggtgctgtagtacgatagtagtattttgtatttctatagtaccattcttcacagaactcaaatgagtcagatgcgactttttatggcttgaaaaattcctaccagtgagcatcagattttatttttagactgaggaaatcgttgttaccaagaatgttgttttaaaattgttaggtatgtgtctgttatatatttcattcccaaatattgcgtcttacaatgaatataattatatagagattagagaaagagaaagagagagagagatacatagatatacggatataacatatcctctgtgatgagggagataaagtaaaaatataatatcaatgaaaatataaaaagctatagataacatcaagaagtgctgctttcattagcattccttcaaaaggtactcttaacatttttaacatagacttcagcgcatctaatgcacaacaataattgacagtcataagaccaagtacaagacactgaaagtttctaatctatctcctgagttgtcaaagaaatattaaattatgaattcactcaggacaaaagtgagattgattttagtttatacttcagtaactattctgtgtttatttggaaaaatatcccagaggttgtcagcttttgtttgcctctcaaaagagaatgatattgggtttaaaaaatttaaaaagctattaaaaaaaacaatcagagcagtaaggtgacaaataccttttatctattttttctgctttcgttgggttttaattttaacttgcttttaaatttaaattaaaagtcaggcacatacatgggaggaaaatctcaagggaaaaaagcagtgtgcaatggagaataatactgtcaaaatccagatgaacaactctttctataccctttgtgtattgttctggtgaacagacatctgtgtttagttgtgtatatgaatgtgtatgtatatatgtatctacgtgtctgtgtgtatttatatatatatttatgcatgttatcttttcacaattggagacacatatacaatcttctgtaccgtattttttatttcaatagcttatcttgaaaaccttttcatatcttcacacatacattatagcatcaaagtaatcctttgtacgagagtactctattttactagtccccgattatgtccacttgggttgtttccagccttttataaataacgtcaaaatgaacctttgtgtctgtagggctttgtgcatatttgaatatatgggtagttacatattgagattttcaattgccatatcaaattttttccaaagaggttgaaccagtttacatcgtgaccaacagccatatgagtgagcctgttatctttgccattaatgtaaatattttcaaacttttgaaacaacaggctaagaagaatttttgctgttttaatttgccaattaatattatgaatattattgagcaacttttcgtatgtttataagtaaacggtttatttttctgtgaaatatctgttcctatcttttgtccattctttctgccaggattttggtctctcagtaaactgtaaaaactctttcactgctaagcaaatttaggcatatatatatatatgggacacacacgcacacatacacacatatatatatacactatatataatatcttgcattgatttattttgacttttcctgttttgggcagcaattattgtttttcaaatttatatcatcaaatttatcaatttttctgctaaagcagaaattcagataacataaagaaaaatggtatctgaaataccattctgagtatcagaaatgcctgtgatactcttaaatttcatcttatctcttctagtctgaatggactttttccttctttaacgcttaaatctttggactatgtataattatctttactggaacaagtgaacttaccctttttttcttttttcccaaattgttacttatttgactcaatacatagatggacaaatccatgttttccaagttggtttgaattgctatctttactaaaaataaaattttgaagcatactgaaggcagtttcaggattctccattcctctatagatctaattacacatctatatgaaatttttattaatattgcttaataccatgcttccatattacatacaccagtcctatctcaatgctttcagaaatgttttggtaattcttttttttcatatgaacttaatatgtatgaacttctataaagttcatatacttctttaaattcataaacatatatatttgggtgtattatgtattatatataaatacataatttatattatacataatttatgttatataattatatattatatttataatataatacaaattgtatatatgtatatatttacttgtttccaatggttttggaataacagtctagatatttttcagttatagactcatatctacaaattattccgtctcttctctcctaatattccttccatatttctctcttttctcccactaaattgactagtaatttcagaacaacattaaattattacaaggacaatgggcatccttatcttgcactgactttaataggatttttttctaatgttttcatatgaattaaggtgctggttcatggcttaaaatgtgtatttttataacaaaattatcagtccatttttattactcatttttatcagaatacacatggagttttatcagattccttttggcacacaaagatcacatggtttatatcttctctgatttattattgtggagaatgacattaataaatattgatccattcttatattttacagaatgaaacagttttaagtctcctaataatttttaaatttgataatattaaaaaagacatttcttcttcagcactgggcatcaacctttggcagagaggttctgattttagggtcagcagtttcagaactgaaattcctcgaatgagccccacagtgtggggtactttatgtttattcatttgttcatctaagaggcaggcaccaggcaccaggaatagaacaagacaaaccctgtttctgacctcacagagcctagagattggcttttgttctcactttgctcattaagaaaggcatttgtactttttcttgttcggacttctcttgggttctttttatatttttcatgaaggcttttgaactaatgaaattaattacatttaatctgatagaaaaaggtgtgtaaacctcaaagacattttgaagaaatgtatttgaagacactgaaaattttacttatgtttatttgggcacaacagcctactttttgattattctaaacacaacatgattggatcattggaaccttgaaatcagggatttatttgcacattcctggggtgccccaatgtttcatcatgggtccctttaatgcttcaggtggagtagactctttaatactgaatttaaactgctgaactcattcttcagaactcaaaagaatactagttagtcccagtgatcacccagtctgaatataacacagaaaaaaaaattgttctaactccaaggaatgaataaagtataattagttggagaatcataacagttaggattgcttttaagccatcaatattagaattaccataatgggatactttttagaaaagaacatattaaattcagaatttttgctttcaatttttttaacttggaggatgaaagaaaacctgtatgtctcggtgcagtggctcttgcctctaattccagcaccttgggaagccaaagtgggagggctgcttgagccctggagttcaagaccagcctgggcaacatagtgacattctatctctaccaaaaaagaaaattcttttaaaaaattagtcagatgtggtggtgctcacctgtagtcccagctacttgggaggctgaggtaggaagataacttaagcccaggagattgagtctgtagtgagctcaggtgtgattctatgatcacaccattgcactctagcctgggtgacagagaaagaccccatctctaaaagaaagaaagaaacaaacaaacaaaaaacccttctaatatgaaacaaatgtaggtggcaatttatcatgaataagtttttgttggtttcataaggcagtcaatattcagtgttgggcattgtcgtgaaaggtagcagatacagtgttctggaacactttatctactgtagggttttttaaagataactgagtggtcctggggtgtactagttttcttaccttgcctgggtttgctgggaaaaaaaaaccctcctgtgaaaaacataatgtaaggactgacctggaaatggactgcttagatttcactaatccattttaatgcctgaaaaataaagagtaaaaatggcctcacatctataaaagtagaaatggcttttggctcactagacggacatagagcatgctgaataataaaggatgctgattccaaaatttaagaaaattagagggtgggatatgatcgctcattctttacaattttgcatctttgattgtttttctataaaacttgtgtgtcatttctcgatccagtgtctaaactcaatgtggatatttaggtcattgttgtagctacctcttcatcccaaatacatcagaaatttgggatttatttatctatcattttatgctttattttccaccagttgatgttatctaggaaattagataataagctttcaatgactccactagataattttaatatgtcttttaaatcaatacctagtgatatccattaataaagcatgaatgggtaaaaacgggatgtgtctatttgataagtgtcgttttaaactgcagtgccacctgccacctctgatcccttctttctcacctctaaaatattcttctgaatcactgttgcccctattaaaattggttattgatttgcatagttatctgtgtcgtggctgatctccgccactccaatgcgttgtacgttctatgcaagtttaaggcatgttcctgttgtatctgcaaggcttaatagagtatgaagaaacatgggagaattacaattaatttatttttatgtttttcaccagaagaatggcacagcaaaaccattaacttgctaattggagaagagatatatttccattaaaagctctgaggatatcatagttggtgtgacccaatttaagtggtgaaaatcacagatcatgtttatagaccattgccgtatttaattttaccacctccctaaggagtcatccctgttttacagtgtattaggctgttctcatgctgctaataaagacatatccaagactgggtaattcacaaaagatagaagtttaatggacttacagttccacatggagggggaggcctcacatacatggtggaagacgaaggaagagcaaagggacgtcttacatggtgcaggcaagaaaacttgcacatcgggttttctttggtccaatatttatgtgtgaggttaaaaataatttgacaacacatgcaactacatggaaagtccaaccccagttggcatatggtatcctttcatgcaaaaagtaagcctagatgactgctctcatcaacatcaaggaattcctaagtgacttaaatgacctcagtctgaaagcaaaacaaaatagaagggtgatattcctgaagtggcaggttaatcttccttttcttttcattccaagttcagcaataataattcagtcctagaccattatggtgtttatcaagtttagtatgaatcatagagctattcatgtaaagtatccagagcacttgtactagtaatgttaactctgttctatattgaataggtgtgattgcaaagttctactttagcccttgaaatactacagaatttcttaaattaaaaattaaagtgctctttacattcatgtgaaatgaatattggactcaaaattgggatacatctctaaaggatactgtttatgcattactaatgttttatcaggccatccttgcctttatacaactttggcctcagcttttcagggtaagttttaaaaggagttatagtatgtttttgcctacaaaaaaggttacttttgtaagagtaaactggtttctgacataaacgtttcatttgaaagtggctgaaagacggttgaggggaaagtggaaaagaatggcttcattctttgcaacacttctagacaggtttttactcttattatttgaaagctttttttgagactagtcatatttttgattcattcctccaactttatctgtttccttataattctaacttaccgtcaaatatagagaaagagcttaaaggaaactaatatgcagggcacagacacaagaggggtgggtttggggatggctctcttccaatcaagcttctgaactgttcctgccatttctggctttgactctgcaccgtgccccctgctggtccctccagggagtagacaagaaatgccaaatcgaaaaatctagagcaacctctcaaatgctgcttaggttattcaggttttcctaaaatagggaactttattaaaccggcttgcctttaaaactcaggtgggtaatactaaaatctttcctcccgaaatgtattcaacttcattttaatcagatgaagaaacaaatcaaatgaagaaaaataacactctactaattagcaatagtattgctgggatcagccttaagctcctaggggatcggaccaaccagatgcctctaattattgttttccgcccatacaggaatatttcagtctatttctgagatgctctttgcacaaagcaaagaagagatacagctttctaggagttattcattcttcctgcagtttcttcatgtccagcgaggcaagtcccatcacagtgtttaaaggccttgtgactggtagtatttatgtaatatatggaatttttatcctcaaaatttgtgaaagctatgaaataaaagtagattctttaaaaatgccttgatggtgatttcaagttcatcctttactctcttaacacactatttaaagaaatcccatacaagttcaggatatagtaactggccgcaagatgtgatagaacaccaacttttgcaacactggcttttgtgagattctattctaacatcgactttggtgagtttctattccaaataagtaactatacacattataagaaattttataaatactacttcatttaatcctccagcaacgctttgcatcattttattgataaggaaaatgaggtgtggagagtttgaataacttgcccaaggtaacagctgataataaatgatggagccaagacaagcccttcatttccaaacctttactctttccccatgccttattgcttacctaagactttttcccaattcaaaagccactggatttacatagatttgtgtgatgtgttgacaaggagaaaactccaaaaggaaaaagagttctttgctaaacattcagtcctacttttaaaactgttacatttccaaatacttggggtaaaaaggatgaatggagtaaggccaggagaaaaaacaagcttatatttgatacctcgagatttttacacatgaaaaatccaaaatagacagatcctgcaaaaaaagaatattcaaatggctgataaacattttttaagggtgttcaacttgattagtttcagagagaagaaatgaaaactacagtctaccataatggctagaatttgaaaatatggcaatatcaaatgttggagaaaatgtagagcaactggaaatcacactcacgtatgctggaaatgaaaactgggcagctactttggaaaaactggtagcttacacaaaaattaaacatacaaccacttgtgacacagcaattccatacccagacaaattagctttatacattcacccaaacagacatattaactcccaaaaaaccccaaagctagtcaaatgtccaccgatatcaatatggacaaacagtttatgctatattcatacaaggaaataccctgcagtaataggaaaatataaactacaactacacaaaaaatatgaataaatccctaaacaatgttacctaaaagccaccagaaacaaaaggttacatgctgtcccgttttctttaaataagttcacaacataggcaaaactaatcaaggttgctaaaatcaggtgtgggcctgtgctcggaatgggtggtaactctaagaggttaagggcaagttactgggtgctggaaatgtccagtttcttgatctgaatgttggtgacatgaattttctcaggcaaattcgtcaagctgcacatgttggcctttgtatttttctcaatgtacatggtataccaatcaaaagtttcagaagcccaaaagagagaggataaaagtattttggagagaggaagacaatttataaagtggatatacagatggagattgcccttgctgaacatattttacatggaagagtgaagagaaaaaaaggaacaacacagagttcatgtagaacttctttttttaaggtagtttatttatatttctattttatctagaatgcttttgtcattgacaaataaaaattgtatgcgcttaccatgtacttcaaactacatgagaaaaaggtaaatgttggagtgttttatcttcatgtgcaaaggtgatatttcagataaaatacaaactttattaagactttaatttgaagctatctagaaaacaatttgggtctgtctccacgatcttttcccagcacctcactgtatccttctcatagcatgtgataatgcattgaatatatgtgccggttactagaaaaaaacataacaacctatctggtttggttttatgcttatttctatctccatggttgctttgatctctctttctcttatcacacttgccttctggatctttctctaattttcttcttgtcctgagagcttccaaatcctccagacaggtgaaagtgttcctccagtttgcatccaccaccacatgttttatgcctcctctccttgtctccctagagaagccacaaactcttgcaggacatccacaccaaaggtattacccattgcctggtacatagacaatacccaaaattgtgctgagttaatagaagatttaaaattcaaacaataggttggcaaattgtacatagtgaagaagcatgtccctttttaaatggagagactgcataccagctttgtgaaccaaatagaatttattgcatctattttaatcctcatgcaggggaccgaggttagcatattcagaaactcaccaggcttgcacctgctcttcatcaagtgggtcctacttcacgagggtgagacccatgtcctatagggcctcagctcaaagggctcatgcttggtttaatgctctgctaatgtggtcttgaagtccttaatttataaacactgggccactcgttttcacttttcctgaaccccacaaattgtgtagctggtcctgttcatcacaaatagaaaaatatgttgccaagcaacatgagaaaatctagatgcccattcatcttcctaaagacaagatctaaagcagaaggacaggttcactttatttacttatgtaattatttatttatttttttattttttatttgagatggagtcccactctgttgcccaagctggagtgcagtggcaggatctctgctcactgcaacctccacctcctgggttcaagcaattctcctgcctcagcctcccgagtagctggaatttgtaatccgaccaccatgtccagctaatttttgtatttttttagtagagacagggtttcaccatgttggccaggctggtctcgaactcctgacctcaggtgattcgcccacctcggcctcccaaagtgctgggattacaggtgtgagctactgcaccctgccctaattcacttttgaatggacttttttttcaacctgcagcatagtaatgtagaattcaggactattgttatttgactatttatttatttatttatttactgaaagaaggtcttgctctgtaacccagactagagtgcagtgccacaatcataggtcactgaaccctcgacctcctgggctcaagtgatcttcctgccccagcctgccaaagcactgggattataggcatgcacaaccgcacctagtctctgacattccacaatttaatatttcacacttgtcatacaaagaccctaagcatattttgaaacaaaaaaagtctcaaaaatgtattgtctgccaccaagcacgaaaaaggacatcattcagcccactgcctctttaaaggaccaacaaagagggtatctaggcaaatattacatttgctatctcacaacaggaaatacatagctcagagccagaaccttgtctagacataatcatctagttctaaacccagtcactgcctaaaatttaaactaatttgctctgtcttcaaacttgatgggtaagacaatcctactccaaataatctgagtcacaagatagtaagtcaaactcatacagaaaaaaagaaatcatatgcatctcatgtatatttagactctttaaacaatagtacatagtatattttatattacatatacacagactgtactttatttatttattggagatggagtctcgctctgccacccaggctggagtgtggtggcgcaatctcggctcactgcaacctttgcctcccgttagctgggattacaggggcccaccaccatgcccagataattttcgtatttttagtagatacagggtttcaacatgttggccaggctggtcttcaactcctgaccttaagtgatccacctgcctcggcctcccaaagtgctggaattacaggtatgagccaccatgcccggcctgtactttatattttagttgaagagtaaatgtttccatttatcttgaaaatggcagtgtatgaattttaaataaaatttttaaaacctataagcacattaaatctaattttatttgtgccaacccctcaggtttttgtagctttcagtgtcattttataatgagttgctcagaaaacattgttacactcttcatctttcaaggttctcccatcacctaaagagccagtatgaaggtctgaaaattgcttatgatttaaccatctttatatctttcttgtatgtttctttttctttctatatttcagtggataccactcactcagggaagacttgctctagtataacctttaagaccaatggcaaacttaagaattggatactgaaatatccaatttaaaaataaattttaaaatttaaaatttattgtgattttctcactttctttacttttggttagctataacagagacagttcgctgggtgtattagtctgttctcacactgctataaagaattgcctgagactgggtaatttataaagaaaagaggtttaattggctcacagttccacaggccttacaagaagcatggctggggaggcctcaggaaacttataattgtggcagaaagcgaaggggaagcaagcacattttacatgtccagagcaggaggaagagagagtgatggggaaggtgccacacacttataaacctcccgatctcgtgagaaatccatcatgaaacagcactagggggatggagctaaaccattagaaaccacccccatgatccaatcacctcccaccaggccccacctccaacactggggattacaattcaacgtgaaatttgggtagggacatagagccaaacaaaatcagttggagacagatgcaacctctgtgtttctcaacaacagtagcacctatgctttaagtatttggccgtttctaactgtataaacagaaatctgtattcttcccataaatttaacacaaggcagtatccataatgcccctgaagctttggacatggagatatggtctcctctcttttttcttcctcttattaaaagaaagcctttgcttactggttaagtggttcagatttatttaaagcaatatgttgggtgtttatttctcagtggcaggaaccttggccagatgtccatttgaagtgtatttcagttcggcaaggtccataactcactctttcagattattatggtttagctatatggatgtccaaggctgataaatccactaattgtaagcgagatttctataaattgatttttcacactatacttcatgttctatggtatcaatgacaaattgcaaaatctcctgtctttcttccctgcgggtctatttcagaaatagtgcaacagacactagatgatgagacatgaaacttttgctgaaaccatactgtgtgaagttttctgttattcaggaagaatacaagtaagccctgtcacatcagtaaaacttaggagtgtcatagcacgcattcaattgagtatcgtgtagaagctaatgattgtgcttttcatttctctgaataatataaagaaactccaggaattcttgcattcagactttgtgtctcaatttagaagagattgagctatgccctgcattgggaaggattgaattgctctcgttcatttgctgttagttttttttttcttgaaataataggataaatgcacatggcaggaataagtggaaaattatttcacaagtgtgacatctatggcttattcacaatccctagttgcttcttaaaacatagattaatagaccttgtccctaaggcttctgactcagtaggtccgacgcggtgcctgagaagttgaatctctgagaagtatcaggtaacgtggctgatggcagacgactctgacagaaccacctttctatcacgtttcctagtgtagccagacttccgcctagtacagcgtgcctccttgctcattgtgaatctgtttcatctcatatgtttcttgaatacttgatatttctcgggagccagatcatctcaataattcagaatcttgatcaggaccagtggctggaatatctcagtctggccacacgaaacatcttcgtgacccaggcagagaagacagaatcccattgcaagatctagcaattcccaaaggggtgggagcagggcgctaaggggattgttgccatctactggacctgccctttgcattgtaatgcacagaggcagtggtttctttccattgtgtgtgaccagaggatgcaggaactacccactttctggccccaacactaaaagtctcctcctgccattttagatgtttctctttctcctcatgaacttttccccttaaatttttgaaattgtttctcctctgctcagagctctgtggtgcgtgggagaaattgcacactccttatgctagtgcaagtaatattatttggccctgggcaaagtcctcttgctctgcagttttcaggtctttcataaattttatggagctttcttcttctttgtttgcttctgtggctcctggtccaaagtttctccttagacctacattgaaattaggagtctatctgtctgtctatcaatctacctacctacctacctacctacctacctctccacccatcatatctgcctatctatctatctatctatctatctatctatctctctatctctctatttctatcatctattctgtctacctataactataatctattctatttatctaagtatcatctctatcatctctatctgttatctatttatccacctatctatctactatccatttatccattctatctatcatctatctatctatctatctatctatctatctatcatctatctatctatctatctatctatctatctatctatcatctatctatctatctatcattcattcatcttttttccattactctcatccatttttccactgcctttgtcttggcattccttctcacatttgtttttatttcaataattcagctttctttagtatccactctgctgtttattgtctccttggctgctttcactgagtttctctgttttgtctccatccatgagtgtctgacttcaaatcacctctctatgacttccttttcttgtgtatagatgtgctttcatcttgaattgtgcatgtgtatgttcatgcatgtgttaatggaccagaaatcttcaaataacttctcctgattctttccataagttctagtatatagataccatatttggtatgagacaagttacttgatttccatttttgtttggttatgaaaggagaatttgagtgagtcaatggggcttaaatgtccaaacttacattgatatgccaacataaaatactataatgaggattagaccatgtatactcttttatatcctagttttttcatgtaatatatagtatgtgttttccttctgtggccccactacttatcatcatatgaatacgctgtttagtcaatttacatattatcacatatttagccaatttacatattatcacatatgttacttagtcaatttacatattatcacatatttagattgcttcttattataggtattataaaaatatgactatgactatccaggtagtaagataaatctcttactacatgtctgacagtttctgtatgaaatatttctaaaaatggggttacttggtcaaaagcagagactcaatttcaataccctaattgctttaaaggaacatttcagaatgttctcagtcccaccaggagtgtatgatatgctagtttcttagataaaaatctgttcatacttttcttactgtaatgcatgtggttgtttctcatggttaagagccatctactttttttttctaatctgtatcccttgggtattattttgttctagtgttagatatttttcacctattagttaataagtgctcttataagatgataaactccattaccatgtctacttttatatcgactacaactttttttattttgtggagtagtatttctaataaatttgtttaaaatattctatcatctgaaactggtcaaataaattataattgaactatcatgacctgtgaggacctcatgttggtctctgacttataattcttgctgttccttttataaataactctttgtataaagatatgattgtgtttatgaccatcacagctatattttggcagtgaaaaacctcccatatttctatcttgtatcttttatttaacgtatttttagagtcaaaagggaaaaaaaagtgtaaagattgacttactcaagaaatgacttcattacattttacatgtatctgtgtgacataccttgcaatgatgtgagttcttgtagatggctaaccatggctttttttgcatgtattaacttatttgtttgtttgtttacttaagaaggcctgcctgctttggcattattttctcacagccttctacttatttgatttgcactaagtggtttttgatgtgctatatattttctgttctatttaggattgattagaagagtttaggtaacacacaaagttcaaatcagctagagtataaaagaatacttcctaatgtaggtttccaggactaaaattctttttttttttttttttttattatactttaagttttagggtacatgtgcacattgtgcaggttagttacatatgtatacatgtgccatgctggtgcgctgcacccactaacgtgtcatctagcattaggtatatctcccaatgctatccctcccccatcccccgaccccaccacagtccccagagtgtgatattccccttcctgtgtccatgtgatctcattgttcaattcccacctatgagtgagaatatgcggtgtttggttttttgttcttgcgatagtttactgagaatgatagtttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgacttttgaatgatcgccattctaactggtgtgagatgatatctcatagtggttttgatttgcatttctctgatggccagtgacggtgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggaattcactcatgatttggctctctgtttgtctgttgttggtgtataagaatgcttgtgatttttgtacattgattttgtttcctgagactttgctgaagttgcttatcagcttaaggagattttgggctgagacgatggggttttctagataaacaatcatgtcatctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagtccacttgatcatggtggataagctttttgatgtgctgctggattcagtttgccagtattttattgaggatttttgcatcaatgttcgtcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtcaaggaatgtatccatttcttctagattttctagtttatttgcgtagaggtgtttgtagtattctctgatggtagtttgtatttctgtgggatgggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtatccagtagtcattcaggagcaggttgttcagtttccatgtagttgagcggctttgagtgagattcttaatcctgagttctagtttgattgcactgtggtctgagagatagtttgttataatttctgttctcttacatttgctgaggagagctttacttccaactatgtggtcaattttggaataggtgtggtgtggtgctgaaaaaaatgtatattctgttgatttggggtggagagttctgtagatgtctattaggtccgcttggtgcagagctgagttcaattcctgggtatccttgtcgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatggatcttgactttttatccaacttgccagtctgtgtcttttaattgcagaatttagtccatttatatttaaagttaatattgttatgtgtgaatttgatcctgtcattatgatgttagctggtgattttgctcgttagttgatgcagtttcttcctagtctcaatggtctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgagattctgggttgaaaattcttttctttaagaatgttgaatattggcccccactctcttctggcttgtagggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccccatcactttcaggtacaccaatcagacgtagatttggtcttttcacatagtcccatatttcttggaggctttgctcatttgtttttattcttttttctctaaacttcccttctcgcttcatttcattcatttcatcttccattgctgataccctttcttccagttgattgcatcggctcctgaggcttctgcattcttcacgtagttctcgagccttggttttcagctccgtcagctcctttaagcaagaataatttaatcaataatcttacaagttcctgatgaaagacaatgagtttcatgagaagggtatctttttccttctgcaagaatggcatttctttgcacctgaaaatcaacttgtaatcggactccacccgtgatagttaatactttcatctttcagaaggaaaagtttaatgagaaaaataaggcagaagtctttaactcacccaggtgctatttattacttatcttatgttttttaaccttgaggcaattttcttagcaatttcatttccagcatgtcgttagaaagatgatcttatcacagcttcaattccattatgcataggattcttgcaacaggcaccagcaggtgtgcctagagagtggtgcagaggaacctaaactattcagcaaaaacctacaggaagagctgagtgttaacagaaaactcattatgccctaatactgagagcttgccattttagaaatgcaacaaagaagctcttttaaataagattgtgctttggaggatggttggatgcaaaggtcaactagagcagggttctccaaatttagtaggcatttgcaatcacctgaatggccccacttcccaaggtcctgattcctttaggtcaagggcaggaccctagaatctgtatttctaacaagtttccagctgagcctgatgctgctgaccacattttgagaacccccaaagcaggcgaattcttacggctcctcaaagaggtaggatctactcctgatgtgctaaatttctttcctctctgaagttttcaagtcctgattacagtggggcagaaatctcccacagacctacaaaattatgtatcttaatgtgtctgtagttcttttgcgcatgaatgtttggttattgcccccgtttcgataacctagttggcttaatcgttgctttcacaatgttgacattttatcttacaggaagaatattctatggtgtttttatagagtctctgtgtttgaggaacctcttggcattcagacttacaaggttacttttgctgttgcacgacacagaaaattcacaagagtggctggaaccctcttatccatggatactttccttcctggtgtcttctgcacacttataacaaactgtcacgctgtctccatcccatttaaaaacgtgatccacaaaccattttcattttcagcttcatgagttccataatgatgggctcaccttcctgcctattagccattctctcttctcaaaatagtgatattctgtagattttttcctacaaaaattctaatgggaggtttacgtttcttcttggctttctttgtattgcttctctataatgtatgtacaactttaaagccagaaaattgcatgaacagcaatgaatcatttttcaagactttacaagaaatacatcaatcttttattttatggattgctttgctgagattttaaaactaccctttagaaaccacaaacagaagaggacttatctttccaagtctttttttatttcttcccaggttcttcaaatggctccttattgactggtttctaggaaaattccttctcgaagcgtcttcttttttacatattcaccatccttcttaattggctctgtcttcacgttctccctctgaaacacttaagagcccgaattactcagcttattcattttccctccaaaaggccactaaaacacaaggtttcctactgacaattctctgcaaacgttaatataatactatcaatgctttcatgaacacagttcttcatatttttaaagcactattaaatgtttttatcttgggacaatgccaagaaatctagacttgattcacaatcgacttttcttttaaacatgaaactctttaaagctaattcttcttatctcctttatcaccacaatatttttatttttccaagtggattaggtccaataatatagagtcaaaactaatagctattccaccagaagatgcctttataaagaggtacctttggaaatcttcattcgtaacccaacataaagccctattttattttcttaacttggaattgttgatgcttttgcagtatgtcccaatttttaaatttttgctatcagcttttctcatttttattcagacttcaggtgcaataatgccgttttatttttcatattggaaagccctgcacatttgataattgagtacatgaatctttccaattaattagaatatggattccaataaaaataaattagtttttattttattttaaatcaattaacttatttttgttgacatataatagttgtacatatttggggggtacatgtgatattttggtacctgtatacaatgcttaatgatcaagttagggtgattggggtatccatcacctcaaacatttatcttttctttgtgctgggaacattctaattctagttattttgaaatatataataaattattattaactataatccttctaccatactatcgaacagtagaacttattctttctttctaactagtacagtttttagaagtttccttctctatatgatggagagaaaactaggatggagaggacttcactccacaaagattcagaagttctgggttctgatcatggccttggtactgaccacctatggggatttggagcgaatcctaaaaagttcgcctgatgctggtttttttccactacaaaatggtgataagaagttttttctttaactgtataataatttcttaggaaatgagactatcactggataagactgtagatcctaagatgtcatatgatgacaaactgggttttgtagtttgcctagggcacattcttacctatcccagcaaaagtcctgattccggccatgtttgaagaatgatagaaccattagagtatccattcatatatctctttgatgtataaaatttcccacgctccctgttcagtcttgatagtgtaggaaaacgtgtctgctttttcttctgaattccacgcttttgaatcactgtctggctttacattctcttatgaactccagtaagtgggtaaaacaaacattcatgggaatgttcaaatggatttattgatttatcatctcagcgatgctcaaggccaacgctctatcctaaagcaacaactatttgggacaagacaagtcaacattttagcacaatccaaaaacagcttcattatttttttaggttcaatgcgcagacattgaattcacagcataagatgggattcagttgagatcaaggaagtttagatggcagtgaatatcagatgtggtccagtgctaaggttgtattagaaagagatagtaggattgcagaagtccaaatgtgcttatgaatgatagagtttccatagcacccaggtgtacagagtcatgtattttgaaactctaaaattaattagagatgtataaggaaaaaatgagaaaccttaaatctatccatgccacttacttgacgtatgaatgtattcatctacttggttctattaagagtttttgtcaaggatcttaaattttcctcttcccagagagcggtttcacaatcttgtattctcagagagtcaaacacctcattcttcttaacgggctcattaagcccctttagcattccttgataaaatatgttactgccttgcagtttctatcataattagccattagggatatcttgggtagctgtaaatattcaaaggcaacactgcacctatgaactgtattttgaagaataccagaaggtatatgggtaataaaaagaatatataaagctctctaatgtaaatcaccctcttagtggcatacaaaaaccaatttttaattagattaaagtctgagattcaaagccatgattccttgaacaatggacctgcttttctttgcctcagcacattctaatgggaaatccctatatttcgatttattttgtcaatttggttgcactgttgattattattatttttaaactcaagagtagagtgggtaatgattaactgaatgcagggaataaaagcataattgtggatggatatgagtagtgtaggatggacctattgttgggaataatttttactctaatactctattattggggataatttttactctaatactgaaatcactcaaagaactcatggatttcatttaaattctgtagaataatagaatgagaaaaatttggctgctgacatggcattaatattgtgaatatacccttaaaggaaaatggctcatttaagcaaaagtgggtatatttggaaatcagaatgtaggaatgcaattttgaaaaccatcatggacactccattactaacagacagctttccatccactcatacctcacattaaagagaattaagtgtaggaaaagaagttcacagtaaaacccaacaattcaagtacataatctatgtattatgggaagtttaacctggcaaaagtatcctttaattgggtgcacatcaaaatattcaagagcaaatcaataatgacccacttatgattacatcacaaagctatcagtttttcttcagatggtctattgatagaatagatttacacaatggagtagtgataaataataaattacagcgaaatattccaacctaaagcaatttacaagcataacgttaaatttttttaagaaagtcaaagaaaaattggtccagtccgatcatatttatcataatatcaaaacatgaaaagtagaatgacataaaatattactaatatattcgatgtatctatatgcaaatatgcaaatatatttaaaacaatatggaatatagataaatatgtatgtgaccaaaatataaataaacctaaaaaaggccaggggtggtggctcatgcctataatcccagtgcttttggaggctgaagagggaggatacttgaggccaggagatcgagaccaagctaggcaacgtagtcagactccacgtctacaaaaataaaaataaaaacaattatctgggtgcagcggtacacacctgcagtctcagctacctggtggctcaggtgggagggtcgcttgagctcagaggttggaggctgcagtgggccgtgactataccactgccctctagccagggtgactgagaaagaccctgtcacctcctccaccaaaacaaaaaaacatgaaaagcaaattacttaatcagaagcagttctctgaccagaacgtgctacttccaggggacttgaatagaagtggtggtatctacctaaatgaattcaaggcagaagaagggaaggtaacaaaaactgtccctaaggcaagaaatgggagaacataaaaagacagatttcttgtagagcaaattgaatgcagtgagatgagtggaagtcatagcaaacaagtatcaagaaggaagacagaaaaaatgttcttcagtgaggataacaactttgtaggttgctatggagctcatactgacataagcaaaacataggcctgggttattttgtttagagtttttttttaaaaaaaaagattgttggtagaaatgtgtgtgctcatcaatataaaaggtggattaaaacacctcggatatgtgatcatgttataattgtcaatagtatgtaaggatgatgtattagtccattttcaggctgctaataaagacattcccaagactggataatttataaaggaaagaggtttaattgcctcacagttcagcatgtctggggaggccttgggaaacttacaatcatgatggaaagtgaaggagaaatggtcatcttcttctcaaagtggcaggaaggagaatgaatgcaggaagaactacaaaacagttataaaaccatcagatgttgtgagaactcactcagtatcacgtgaacagcatgggggaaactgccctatgatccaaccacttccacttggtctctcccttgacacatgggagtaatggggattatggaaattataattcaagatgagattcgagtggggacacaaagcctaaccatatcagatggtaactgtaaaaaaaagaaaatccagcatgctctaaaaaagccatacctgataattgttctaagagactaacattataaaatataatcctgatgtgcatcctttacacctctggaagattatattttatgattttagatttttagaactaaattataacattacaaaacagttgagaagtatagtcacagaaaaagtcattaatccagcaaaatttctgtcaaaaaaaatggaattggggcatggaaacattgaggcccaaaaagttaaacatagaattaccatatgttacccagaaactccagccctacgtgtatacccaagagacataaaagcagaaactgaaacagggattagcagcattattcacaatgatcaaaaagtgaaaacaacccaaatctctatcaacagatgaatggataaacaagttgtggtctattcatacaatagaatattattcagccttaaaaaggaatgcagtactgatgcacgcagcaacgtgaatgagccctgaaaacaccaagctcagtgaaagaagccagacacaaaaggccacatattaggtgattccacttctattaatcacatggagagacccatagagacagaaagtagattagtagttgtcaggagctgggtgtgaggatggggtgggaggagtgactgctgcatggatacggggttcctttttctttttgagacagagtcttgctctgtcacccaggctggagtgcagtggcacactcttgctcactgcaacctccacctcccgggttcaagtgattctcatgcctcagcctcctgagtagctgggatgacaggtgtgtgccaccatgcctggctactttctgtaattttagtcgagacggggtttcaccatgttggccaggctgatctggaattcctagactcaggtgatccacctgccttggcctcccagagtgctgggattacagatgtgagccaccaaacctgttctggggtttctttttaaggtgatgaaaatatttaggaaccagatacaggtgatggttgcctgacattgtgaacacattaaaagtcacagaattttacactataaaatggttaatcttatgttatgtgaattttatctccatcaaaaaaaaaaaaagaatgaagctcttctctgcaataaaaatagtctgaaacagaacccggtaaactgggtagcatataaggaatgtaggtaaatgtctgtagaacttttttaaaaaatctctaagacaaacaaaggaaaaagaatgtatgccccacttttaaaatgccagagagttgcaggatgtttttttcttaataatttaagccttatttattatttagcactttgtttgaagataactatagactttccaaaaagtttccaaaatagtacagagagttctgctcacccttcagaatgtttttctaatgttaatgttttttgtcatcatagtacaattataaaaccaggtacttatcattgatagaatgctgttaactgaactacagatctaagtaaaattctgacagttttacccctagtgttctgtattagtccgttttcacactgctgtgaagagactacctgagactgggtaatctataaagaaaggaggtttaattgacttataattctgcatggctgggaaggcctcaagaaacttacaattatggaagaaggggaagcaaggcatgtcttacatggcagcaggagacagggcagagaaaactgccatttttaaagccatcagattttgtgagaactcccccactatcatgagaatagcatagtccaatcacccccatgatccaatcaccacccgccaagtccctccctcaacacgtggggattataattcgagatgagatttggatggggacacagagccaaaatatatcatgtactctttatggaccaggagccaatccaggattgcacattgtatttaattgtcatagctccatattctcctccaatcagtgacattttctcacttttttccttgcattttatgaccttgatgcttttgaagagccatcgtcagttattttgtatcttgtctgtgggacagttttaaaagatctaaagatctcaaaggaagaaattaagtatttagagataaacatactcatctgagaaatgttcggcacgggaataagcagaaataaatggcaaaaaaaaatcggattctcaaaaattatgaacaccaattctttaaatgatacggagtcaagctgcagacatgaacaaggtctctacaaaatggcagaagtgcaagaagttcatatagtgaatggaaattaacagggaggatggggaaaagaaagatttggcaaatgtgatgctatgctgaccatttgcagcgggtgagggatgaggctgtctagagtagtttagatgtagctcttagcctatcagcatctcaccatggtggcatgacaaggccacccttatcatggccctgctttgcttgttactatatcaagtgttacttaaactcaagcttctcaaagattgggaacacccactccccctatgccctcgctccctgtcccctaactcttgactttaatttctgtatttgtattatctccttgaggatcatctcccctcaataaattgttggccctcaattgtctctgagctcaattctccctcatggtatactctttaccgatgttattttatcactgaatattttcagcttcttctatgaatatcctttaaatctgccgtatctgtctaacacaaatccaacttattttggagtagaagacaattgctacaaatcatgagacaattttcccttatttcattataccaagctcctttattgacatgttcttatagtgcatttattttaacttgaatgtgctctgattcacaccccatttctattacctataactcttgcttgtattactgatgtgcttaggcatgaccagtcatttctcaaagaagatatttgcaggttgattatttttgtctcaatgtatacttgccaataacatatgctgtgcttctagctccatcagggtacttctgtattagatgacattcttcaagggattaatggccatttttcattctttatcagttgtaccttcagagttcaaattgatcaccttaggctttgacgtaaatcattcaacatcctatgagaaagcttaggaatcctcaagacagtggtagtttcaaagacatcccacatgttacttctcctttcaaatcaattatttaaaatttcctggtaaaataaatgtacagagaaagtagagcgaaatgtgaaaatctcccatagtcttcaattgtatacaacggatgtcccattggtcaagaaccctggctcacaccaaaatttggtctggacaaattttaccaagagaaactatttccaaacagttcccaggatgagactgtatggtatagttcagttttctatttctttacatggtcttcccttgtgctaggttcttgcaggcaaggatggttgctaaagatactcggaagagtcattatcatcaaggacagtagaaagtgctcttgaaaaagcacttttaggttgggcatggtggctaacatctgtaatcccagcactttgggaggctgaggcaggaagatcccttgagccaaaaagtttaagaccagcctaaacaacacagcaagaccccatctctaccaaaaaaagatgtacttttatagtacatactgctccaaaaatgtagaggaaagctcattttatgttcataacattgtgtggtatgaagaagcatttaccttctagcagagtttttgattagtgtttttacttgatccataaagaaattaccgggcagaggtgtaaccttcttcttttcttttcccactcacatctgagatgacatagacaagaagaaagagaaattttaacatataaaataaaatctccttccctctccccctactctgcaaagaaatcctttgtattttcaggaaaaccctcatgtttaaatgactataatggtttagttccccaatgctgagggattttaaaatttgaactaagatagccttttagcatagaaggtttgaaaattcatacctgacaatatctcatcaatttacagaaaagactgcctctgggagaatatcataatcttccaagatttatatggagctgaaagcaccttgtctatgaaatttcctataatataccgaaacatgattaaaaatgtggatctaaaaatggaattgcagagcatgcagcattggggaaagggatggtgataaatataaaaatattggggtggaaaatagttttaccatgtctacaatcagcaccaaaatatcacttgtactaaagtaatagaatgagatgggttacaaaaagcatgtttttattgcaatataggtgcaaaacatttgaaaaggagaggcttttttaaaatccagcttcatttggagtatatctttgatacacagccattgagtcaatctctctagaccattcaaaatgagaatatccaatgcacaaacgtaaatgtgcccaatttcctaatctcctgtaaatactatcacttccctgagagctactggactttggaagggtggattgattcctctgtctcatcacaacgttgggggaaaatgttgtgactccagtgtggatatcctatttatctcccgttgggaaagaagtatttacatgtattatgatgctttgaaatgagatttagaatggttagaggaaaatatagtgcctgggttccagccactgggcagacagattaccatagtgctgtgtgagtaacactttataaatgcatttgtcacacaggagcagtgtcacatgaaatctgattcattgcatgtaatggattaggtgaaattcacttagatttttagcaatgtgtgtaaaataactaacttaacctatctgcaaaccgtattttatctttcaaatcttgtaagtgctctctgggactacacaatgaataggcagttatatttcaacaggtatcgtaaggaacatcagtctcctaccagaaatcatcatgaaaccagcccattcaggctgtttgctttacatagaaaaatgtgtatgaccatacatattatagaattattcactcatatgcatgtggtcttgtgtcaaaaaagttgtcccttattgaggcagatgttctggctaggaaaatatctaaaccaaaaggtctgaatatttgattaactgatggtccttaaggcttaatgccatattttgcttcttaagatttactgagaatgtcatcattgcatctttcttcatctgtccgggctgctgttgtagaataccctacctagcctgggtgaattttaaaaaccaatgtatttcttacagttctggaggctgagacatctgagatcagggtgctgccatgctcaggttctggcaaggggcttctgtccagtttgtagacagccaccttctttctcactgtatcctcacatggccaagggggagagagaaagagaaagagggaaagagaaggggaaagagggaaagagaaagagaaagggaaaaagagaaagagagaaggagaaagagaaagacagagagagagagagagacagagaaagctcccgtttctcttcttaaaagtacactaattccgtcaagggctacaccctcatgatctgatcacctccaaaggtccccaatctcctaatctcatcacactggggattggggtttcgacatatgcatgctagaggaacacaaacactcagtctataggagcatctgcatttccttttgggagaattgtctccttttcattgtgtgaaattgagtgctaaggtagaccaagtcaactgtctccattttagaaagcccaatgggacaaatgtggtctctgtccaagaagcaggcatttgacttaagtctccctagtcagggcattgcctcttgtgcaagggacgagcatgggatggatggcccttgcctaattgctgcagactggtgtgataacgaatggcttccaggagcctctagaatcaagatcagagatcaagtgcatatctttgtatgcacttgatcccaagtgtttatctccacactcaagtggattttgtatctctttccaatgtatttctcccaattccaaaatgagcttcgattgccttggactaaaacccacagtgatatagatgtttccccagtggaaggtgtgtgacaggaggtaggaataaacatttgaaattaagtttcatattatttatctcatgagtatcaatttcatccacaaaaaatgactacaaaggcaacctttataaggaattaagtaactcattctcattttgtactttaagactgtgactatatccagaaaaaccactggactaaatgctaaattgtgtcagtttttttaaaagtaaagtttaaccttgatttaacataatttttttctgaatttatcatttttttagagacagggtcccaccctgcttcccaggctggagtgcagtggcacaatcagagttctctgcagcttcaacctccccagctcaagggatccccaggccttagcctcccaagtagttgggattacaggtgaacacctccatggccagctaattttttttttcttttttgatagagacagagttgcaccaaagtaaattttgacatgaagactgctgtttagttgtgtgatattattatatatatgcattagtctttttttctcactactgataaagacatacctgagactgggaagaaaaagaggtttaatggacttacagttccacatggctggggaggcctcacaatcatggtggaaggcaaggaggagcaagtcacgtcttacatggatggtggcaggcaaagagagagcttgtgcggggaaactcccctttttaaaaccatcagatcttgtgaggcttatttgctatcacgagaacagcacaggaaagacctgcccccacgattcaattacctcttaccagattcctcccacaacatgtgggaattcaagatgagatttgggtggggacatagccaaagcatatctatctgtatctatatctacatgtgtcgatctaatctgtcatctatctatctatctatctatctatctatctatctatctatcaatcaattggggtggttcaggaaatagcagatgtaagaccctgtagaaacaacagctctaggtaaagagtcttggagaacactggtgttctttgacacatacctattctcacctgggaaagagaaacattctactcctcatctaccattttctatcaagtgtttagtcctttgttccctttaaaacaaaaagctgaaattcattgaatgataaaagcagcacccctttttaaatcatatatatatatataataaatacgatatattgtgtataagatatagttttttatccacagttccggggtcataactcccataacccttgctataatgttggggtgcttttggcctcagaagcacacttcagaaaacagaatctctttctcactgaccttctcctgccttccttccacctgccgaaagtaggactataacctttccctgacttttttttttttttttttgagatggagttttgctctgtcacccaggatgaagtgcagtggtgcgatcttcgctcactgcaacctccacctcctgggttcaagcaattatcctgcctcagctagtagctgggattacaggcacctggaaccacacccagctaatttttgtatttttaataaagacagcattttaccaagttggccaggctggtctcaaactcctgacctcaagtgatcctcccaccttggcctcccaaattgctggggttacagacataagccactgcacctggacctttccctgactttactatccatagtaagatgtattatcttttgcaccactgacccactgatatgatttggctgtgtccccacccaaatctcatcttgaattgtagttcccataatcctcacatgtcatgggagggacccggtgggaggtaattgaatcatggaggcagttaccctcatgctgttctcatgatagtgagtgagttctcacaagatctgatggtttcataagggtcttttccctcttttgctcagcacttctctcctgccaccctgtgaagagggatgtgtttgcttccccttctgtcatgattgtaagtttcctgaagcctccctagccatgtggaactacgagtcaattaaacctctttcctttataaattacacagtcttggatatttattcacagaagcatgagaacagtctaagacaccctccctcccctagtagtctgactgtgggacataagacccttattttagaagacagcctgccccataccctggaagaacgactgctgcacagagaggccaagaaggatttgaacagttaggccttgctgtgtcctcttactcacccttctagtgtcacatcatagcctttttgtccaatcacatttctacatagttgtcaatcatgcctatccaatgaaatctggacaaaaaggccaagaagactgtgtttggagaccttctagagagctgaacacgtggaggctggcaggcaggtggacaagaactcacccatgtgcctggagtgtggtgcactccaacactacggggagacactgttgtggtctggatctgcccagacctcaccctatgtatctcttcatgtgactgtttttgtcctttaaaatatcctttataataaaccaggaagtgtaaataagtgtttttctgagttctgtgagccacttcagcaaattaatccaacccaaagagcaggtcgtgggaattaccccaagttgaagctgattggtcagaatttccggaggcccagacttgtgactggggagatggagtaggcagtcttgtgtgaactgaggtggtgtcccctgcagaactgcttgcttgcttggcgtgcggggagaagcccccacacatttggttgtagacagcttctatgtggattgtcattgcagtgtgagagcagaggaaaagcactttgagtttgtgtgtgagtttgttttattctcttgagacaatttgtattaaaatgtgaaactgtggagtcgactctggttgggttggtaaacaggggtgctattattgtcatccagtgaatttcagctttgtgttaaaaccataatagaaattacaagtaaggaatggaactagagtctcatggttctctttccaaggtgagaataggtatgtggcaaaaaacaccaagactctttagactgtagctaccatttctataatactagtgtcctacacctgctgtttccaagatcatcccaattcaggtcatcgttatctcttactctaattattgtgagagactcctaactgatatccgtgcttctagtttctcccttattctgctccgtttttcaaactatagctaaagctacctttaaaaatagaaatctgatcatgacactcttggaaaccatgcacaacttggacggctttccatatctcttagggtaaggtctattcccttaccttgtcctttcctattgatggcccagcctccactcccctggcctcttcacatttcatcccagacacattgcatttatttctatttcctacatgaggcttagcctgttagatctctgggctttctctcatgaagttcatgttgccccaaagactctctaccttctcctcctgttttgaaacaccacatctaccaccaacatgtatattttgcaaaatgtctactcactcttcctgcagtaagcatttcctgtcttctcccatgtttcttcctcatcctttccctgtcaacaaacttcctattgttttactttgctgagttcccttctgaatggtataccccacttgactgcattcttatggggggaagtaaggagggtctgtcattcacctttgtatttctaggacctagtgtaattcctggctcctagcaggtgttaaaaaagtcagcatatatttgactgaataccaaattcaatccactgatgagatacaatgggaccaccagtatctatttcttctgtgaccttcatccctcaatggtcctttgaaaatgctaacccagacattgagaaagaagtctatttatgtattgggggatagttactcaggcaacacagcctatctgtaaaatataaaataaaataaaatataataagatattagaattagactacaccaaaatgacattgattgggttcacattcccactacacaatgcacaaatcctggcacagatttttgaaaatggtaaaatactgcacaaatgtaagacactatcatataggatcatgagaatgcacacacaaataactataatatgacagcatgaccaaggctgtgggtactcattgtgagctttttcaataaccaggagatgaacaaatatcctaaaataatgctattaaccgacgtgttatgaagtcatattctgtgaagtactattctatctgcacaattttgcaaccagaaaaaaaccctataacatttaaaatgtctgcttaaaaatgggaccagactgacatgtttaacgtaaaatcattaggagaatttaagaagtagcaattctggtaattaccaaatagcatgattctctcccagtaaagcatatgtcaaattacagaaaaacatcactatgttgctttcccttttaaagattttacatatgaagcatatgagtttaaatattcccctgctttttgcatattttatttaagcttttttaatgggatttaacgctcctttgttttcactttttttgtgtgagattccaagcactgaaagtttcttttgatctcttcccagtaatttttcaggtaaaaatgaaatatacatatatatatagcttttttgtttgttttgcgaagacatagagtgggagaagaaattggggggtggtgaggcagagttgttttactctcctaagagaagaaaggaaacatttctgcatatctcattcttatagataacacttcccatcacgtctcgtggaactaaggctatttgtttcgttaactaatcgtcatttatgcactccgttattcccggtgaaactcttcagacagcttacaagtattgtcatgcttattattattattactattattattattattatattgctggcactatgttatattctttcagtataaaaataccaatactgagttgatgtcacaaaccacgtgatttcatttttgttgtgttctattcttccaagttatggggatgattactggtttgggccaatatggaagctactgattggaattcagcctatagccacagattaaagaaaaagaaaaaaggaactctctcaggcaatggtagtactcagggtttggcttttctcataaacactccaagtgtttactttgtgagctaattaggaatgagtttcccaagatgatccaacaattgagaaaaaggaaaagaaaaaaacagtctcccaccagaatacaaatatccatgggtttccaattcacagaagcaaaatatgtggactggtttatgaaacacacaccattatcttcttccctcggggaaaagcagcttgctgaacaaacacttcatgtcagagactgttccagccacgtgaaaagcccactgcacaccagtaaaagtcatggctcaaaattatgacacgaatgttcagatgaggaaggatttatatttacaaaagcacttgtttcataaagctacacttttcaggagcggcagcatcagtattgccatggactgaattatgcttcctccaaaactcatacgttggagccctgacccccgcaatgcgatagtaataggaggtgaatccttgggaagacagttgagtttagatgatgtcgagctggtggggtcctcatgatgggattagtgtccttataagcagaggaagagtcaccagagccccctctctctccctctgctatatgaggactaagagaccaggtggccgtctacaagacaggaagagagagttctcaccaggaaccaatcttttgggaccttgataatggacttccagcctccagagctgagaacatacatttctgttcttaaattacccatcctatggtttgctgttgttattgttgttactgtaattatggcagcccaatgatgcaaatctaaacacatgatgcaatatacgatgcaaatataaacccagaatgaattgaacacatccaccctttagtgccctcacctttatagtaaaacttccaccctgaaatccatgcaaatcagtgtcccccaggagagagtatgtacctgagttcctcagtgctcaggttaattcccttaatcgatctgcaaacatacagatgggaagggatgggcacgatcagtttcctaactccctgattatgcagaaaaggaagctggagcccagactgtttgggtgacttgtttgatgtctcacaacaagtttgttgcagagattcaaatacagattgagcatctcacatccgaaattccaaaatccaaaatactcccaaatccaaaacttgttgagcaccaatatcatgcccaaaggatatgttaattacagcgttttaaattttggggttttttggatttggggtgtcaaaccagtaagtataatgcaattatgccaaaatccaaaaaaaaaatctgaaatccaaaacacttcttgtcccaagtgttttagataaaaagatattcaacctgtagaacccacacttttcacttgcaaccagtacaatttcaactataacatgacagattagtactagacttttaacccagatttccttttgttgatgaaaatgcagaaaaggttttgataatcccattcaccgtacaaataatcacatgtatgtatgaatgtgtatgcatgcatgaatgtgtatgcatgtatgaatgtgtatgcacgcataagtgtatgtatgtaaacacatccagacatgtatgtaagtaaattttaaatgcattaatatgtcagcttgataataaattgctacatggtaatattaaagcaatcaataataaaataagaggaaggtcatatcttaaatccttcctgcatttgactttgtctctggtctaaattgatagtcagagacaccatcaataacatcaacagaaagtatgacagatttaactcctggcttcatcagggtcccttttgcaatgagttttgggagctcagacttagctgggtagaaaggaaggaaggacccgacattacgaggggtacatatcataacctttaaaactatgatcctatttaattctcaccacaattgtacaaagtaaatgtcactcacattccacaaaacacttagcagattcgtagctctgccataggaggcactgtgcaacccggtggtttgaactcagcttctttctatcttcacaagatgcaagcttttaaagccaggaggggtgagttatttatccttgtgtctcccccagataactgatatgctaagtactgtatgcattgggttcataaattatgggtctcctttcctgtcacatattgtttaaaagaaaactttccaaatcatttttcaatatatgaagggcactatggtgtgatggtgaagactttgagctgtgaagttgagttgaatcaatttacatcagtatccattgttatttctctccctgcctgactccgcttacactgtttcttgtctttgcttccagctcctggggaaaaactgtctagggatccatttctctgcccctgattttctttgtggggaaatactttctcccaacgtgcataaatttgttgagaagttagctccatatgcctcctccctcttggtgagtgcaaagagacagattttcccaagaaaagaggcagatgtttggcctaagctatatccattcagacactctctccaagaccaatttttttaacttgggctcaaattccccgttcttccctgaaacaattattcctacctatgtaacacttataagccacatacggggacatctccctggaggtaacatcttatgtgtgatctcaggatggaaggaaaccttttttctgctgaattttcaaacgcattgtcatttctttttgaaagtatgaagacatcaaaaggtcgcggagctcaggtaatccgcaggcattgcaactcaacagagtgctctgatgagctggtgatgttaagggcacatgacagctgactgccaaaacaacctctgtatggggaacagaagaaagagacactcatgtggatttgactgaagccaacttcaaggcttcccagtctgaggcatgctgtgtattgatagctggggaataatcatggtgagcaggacagaaaggttgaggaggctccacggaaacaagagtgtcaaatccattgagcaaaaaggccaagggaaaaggctgatttctagtgatagcaaccaaaacgaatggccaaatgatacccaggaaaacatggcaggaggggaatcaataatcacccatttttgtttctaaaatccaatagatgaagaaaggcagtgaattcaatgaatattcgaacacttatttaatatcaagaagggttctagaagccaatgcagtcactgaaagcagtcagactttgaagcagatgctgttggcatttggatcataacctttcagtttgctggaggagtcagccacagctccggtgggcagactgcaaagagttttcaattgggggtatacgagagaactccccaagatgccacagagcaaaatcaagggagattccatttaaaggcaaaggtatggtgaatcaagaaagagagggagagagagagatagggacagacagattgacagagaaggcacacataaggaatccaaaagatattccaaggaccagacacaaagtccttgggcattatttgcacataaaccctgttctgccttagaattgaaccatcaaggtatgcacaaaaaagtctgacttcttcaggaaaatgcaaagtacaagtttgtggccagcgtttaaagctcctctggctatgtcatcaaaccagctctgtctaactgattaggccaattttgcaaaccatcagtggagaaattaatcatgatggtctccagggggcacttcagactttaagcagcacatcctaaatcccacagcccttaatttgacaaagagtcagaaatcacacttgcaggtagcctcagggataatgataaagctgctgcaattcagtggtaaatcggccccatctgtatagtgagttcttgacaaggtctgccctgtatggctctgcttgggaacttctcaggcagtataacatagaggggcatggtaggcccatgggtctagaaacttacgggtgtaagtggacaccccaggaactaccttcactcactaagggatgggattttctagataaatgctccagcttcctttcccctgggctggacaattctgagattgctgccaccatagtccctcgcggaatctccagtgggatgaagatctcattgtccacagaagtagccctttgtcaacacttcttgtattgttatagatggtagaaatctaagatgcaacccaagattccagcctcctgggctcccaacatgtataatccctttcttttgagagtggacaaggactttgaatatgatgaatgtcactcacttgaaccggttaccaattggttgactttgagtccatcagttatcctgggtgggtctgacctaatcagaggagactttaagagggggaagagtcggcaaacagccatgatgataactgcttatgggacaacgtggcaatgaaatgcaggcagaactcgagaagtagagagtggtccctctaacatagctcttacagaaaactgggaactctagttctacaactgaaaggaactgaattttgccacagctacctgagcttgaaggagaaccctgatgtatgcctgtagtcccagctactcaggaggctgaggtggggggattgattgagcctgggagttagaggctgcagtaagccatgatcatgccactgtagtccagcctgggtgacagagtgacaccctgtcacaaaaaaaaaaaaaaaaaaaaaaaaaaaatcaatcaacaaagagaacacggagatttaaatgagtataccttccctgcagtcttgtgagacctgtgcagaggatgctgctaacctttacctggatacctgatccttgtgagagaggaggcaggactcaactccagaggtggggctgggatgcaggaccaaattgaagactagctaaaacaggtcccggacagaagaatcttttcatcggacatgcccaccagtgtgccaggtcagtttgccattgccatggcaacccccgggggttaccaaccatttccacagcaatgacccaatgatccaaaagttgctaccctttctctagaaatttcagcagaaaccgcccctcaatctttatgcaaataaaaatgggtataaaagtgactgtgaaatcaccctgagctgccactctctgcccagggggtagccctgttctgcaggagcagccacggagctgtaacactgctgcttctgtaaattttcttctacctccagcttgcccttgaattccttcctgggcaaagccaagaacccttgcaggctaagccctgctttgaggctcacctctctggcatcatttggaagctctgaggtaatattaataaaagtgtgttgttgtaagtcacttcatttgtgctaatttgttagacagcaatagcacactgatacagttggctttcctcacctcccagtctttttctggccatacctacaaggatcacctctcaaataaactacttttaccaaaattcttctctcagaatctacatttggggaacccaaacttaggtatggttctcaaaaagtgtaaaatcttgatgggtgaatagcaaggaattgaggaaaaatatatgataatattcaccttacctttcttgaagggtaaatgaaatgaaacatggtcttcttttgaactaaaatgttcccaacatttaattgttcccggcatttaatcccaacataattggggctttcttctcattctaactaggaattgttttttcacaaaggaaacaaagagagtataaatttaaattatcatatgaaaaaattcaggaagatgttagaaataatttttggcctgcaaattgatttgcaagatgttgatggaaaatgtttaaggtttattttatagagatgttaaggaagatagtaggaattataatattgaagtggttggaatagcaattctataataaagggaacagatcttcttgagggaaaatactagctacaattttcccatttggggtaaatatcagtatgtttacattactgttcttctcacattttattctaagttattgacgatgaagaaacacaatacaagctaaatttatcctcatgaatgatgttataggaaggtttcttttcatgcagtatattagttttctaggacttccataagaaagttccacagaccaggtgacttaaacaacaaagatttattttctcacggttctggaggctggaaatctgagatcaaggggtgagcacggctggttcctcctgaagcctctctcgtagccttgtagatgccatcttctccctgtgtcctcatgtggtcgtccctctgtgtgtgtctgtgtcctcatctcttcttcttatgagatgtcttagtcaatttcaggcttctgtaacataataccatagacttaatggcttacaagcaacagacacttattctccacagtcctggaggttggaattccaagatcaaggtgtgggcagggctggttcctctcgaggcctctctcctgagcttgtagacactgtcttctccctgtgtcctcaaatggttgtccctctgtgtgtatctgtctcctcttcttatgagatggcttagtccatttcaggctgctataacagcacaccatagactgggtggtttacaaacagcagacatttattctcccacagtcctggaggctggaagtctaagctcaaggtatgggaagggttggctcctcctaaagcttctctcctgagcttgtagatgctgtcttctccctttgtcctcacagggtcgtccctgtatttatgtctgtgtcctaatattctcttcttataaagaccccagtcctattggattggtgcccatcttagtgacctcattttaccttaatcacctctttaaagaccttatctccaaatacagtgacattctgaggtcccaatgtttaggatttaacatataaattttgaggaaacacaattcagcctgtaacatgcagtaaagaattttatatggaaaatcctttcagttccttcagcctctgagctcccgattccatatgcacttagataatttcctaacatgcacatatggtattagagttattttttttaccctgattgtacaattaacatttacacagagagttgctgctgtgagttgtagataagttctcagactcatctatatcaccactttatttcgatcttgcgacggacagattgattctgaatgtcccagaggagagaccataatcaacacccccatattcccgccaagcttgctcactcatcctaggggaggctgacattgcaaagggttcctgattgagaaccacaatgtcttgaccagctgcactttgcactgggcttcagctgacttccagagggcagacctgtggaccaacagaaagtagatgaaaatagagaggaactaagatggatctctctgcgtcctccaaaatttcccttctgccccatctcacttcccccttggctcggccatgtttataaaaagagctgtgataacctcaggtcctaacaacgctgatggcacttttgtaaaaaggacactgcatggcagaatctagattttgtaaaagtatttggatacctcgaggtgcaagtcataaagtcattaaacttgttttcgttgcagcatggttcgatgcataaaaaggttgtgtgaaaggcaagcttatttttgggtttgtgttgtgaatcatctgctctcaccctggggtcctgcacgatatcatcttatttctttttcatgaaaaggaaacaaattagacccagttcaatcatcctgattctcctgttcgagcttacctttctgtctctctgctgatggcagcagaatccatgacatctcaaaagaccctgtttccagataaggtcatattttgaggttctgggtgatgtaaatgtcagggagaccccattcaacccattgcagaatgtctctttctttttcgttgccatctttctatggctctcacctcgtactgacccctccaaggagctgagaagtcgtcttctgcaggaaaaaggagaaagtctgctattctcggcacagcctgttatttttagagtgacactgttcacagagcccaggcccagacagccttgggataaacaatctgtaggatcccatgtcagccgcagaaatgagaacaaaagtgaaaaactctagcaacaggattaggaacctgagccacagccccaaggctcatccttctctgattaacggggctaactgcaaaatatccaggtgttttgttgctttaatcaggtattgtttttcgtcttaaacgtaataagctcagcagcactgttgatctgagttttctctcatttttagcttgtgtccccaggttggaagactacttagcaatgccccttccctgctgtgattctttctagaagctgggtcaccggcatcctcagtgcctgtccatcagagggatgcaggcacaaaaggtttgttcaagggctgcctgccaagtccggggaggccgtcccagcattgagctcacattcaagcagattatcaacgctctcagggacactgatacatgccaaagaaatgtttacagaatgtcttgagatctcattgctggcggtgataagatggtggtggtggtggtggtggtggtggtggcggcggcagctacactccagtcactgcagaaaagcaaagagagatccaatgagtgttttggctgaggaagagggattgagcttgacctgtgtgcaaagcagaggggaggtgacttaatagctcctttcatctctaatgggtattcattcaagtcaaccaggataacacaagtgtatgcacaaatgtatcaccgggatggatgaagatgtgaaaaaaaccagtgacatttgcctgcctttctggaagtcgataccaaagaaaacgtagtaatcatagtgattatggtaaatctgtgtgcatagttagtgatttttctttctaggattgaaaatggaaactccgccttctctcctcccctggggttagaaagtatgcatactttgatttctcatcatcctggcttccttcttcagaatgctgttgctcaaaagctttgtctgtcatcaggttgaacatgttttgaccttgaagcattactttgatcttaaggttaagtctctgatcttcttgtttgaatccaggaacataatgtgtttagatccagatgattagatcccacaatcaccaccttcaattcactcattctttcctgcatccattcattcaatatttgtctagcatgtgctactcataaagcaaccatgtgtatcaggggtttactaagtgtaggagatgttctagaggctagaaaggcattgttaagcaaggcagatggttatgagtgatgacttcctctgaggtagagagcacaaggctatggggaaataaaacaatgtggccttggtctgtctgggaggcagagagcaggactagagagtgtgacttttagcataagcctaagcaatatccaggagcaagagacaggaggagaaggcactggcattgttggtggagttggcagcaaatccaagaccatgagtgaaatggtttggatttgcatccccatctaaatctcatgttgaattttaatccccagtgtaggaggtggggcctggtgggaggtgactgaatcatgggggtggtttctaatagtttagcaccatcctcctagtgctgtctcatcatagagttttcatgagatctggttatttaaaagtgtgcagcacctcccccttcacactctcttcctcctgcttccaccacgtaagatgtgcttgctaccccttcaccttctgccatcatagaaagtttcccgaagcctccacagccatgcttcctgtacagcctgtggaactgtgagtcaattaaacctcttttcttcataaattacctagtctcaggtagttctctatagcaatgcaagaataaacatatacaatgagatatgttaggataagctaggttttgctgctgaaataaaatccatgagacataaatagccacagcttcaaatgttattaatttctcacatcactgtctgatgggggctgggccatctccctaggccttatagctttgccgtctggaactcatgacctcacaggggacacctcacaaggaaagagacagaagaaaaaggagtattgactactcactgcctgcatgtagaaatgccacatgtgccttctgctcacatctcaccaggcagaactagtacttggtgctatgtaattgtgggacagtctgagaaatataggaaaccacatgatatctggtaatctgtcagagctacactatttctagcacaaaccaggaagaagctagctacattggaagactgaaagccaacctgaatgactagggcaacgaacagaggagagacagcatcataaaatgagtttggaaccagaatggaagaccacgccacgcagtgtcttaaggccacattgctgagtactttaagggtaatgggaggagagcagagatggacagggattggtttcttaggtctgaaaatatcttaagtgtacaagagtagatctagaggttacaatcattgactactgatgacaatacataggctaaaatgctctacaaacaagacaatcagtaaaacttcatcattccgaaacacatcaacaaaactttgtaattcagaagtaaatcagcatcctattcaatgtcagtaggttatgcattaatcagtatgtcaacagtctgagaaacttatgttaagattctttgctcagagatggagtctccgtgcatcacaagaccttcttaaggcaggttagtttggaagcctgctgatatagtttggatgtgttttgccacccaaattttatatggaaatgtaatctccaacattggaggtggggcctagtgggaggtgacttgatcatgggggtggatttcttataaatggtttagccccattcaccaagtgttgtcattgtgatagtgagcgagttctcatgatatctgggtgtttgaaagtgtgtcgcatctcccccactctctttcttcctcctgctccagccatgtaacatgcctgctcccccttcaccttctgccacgattgaaagtatcctgaggcctcaccagaagctgtcatgcttcttatacaacctacagaaccataagccacttaaaccttttttaaaaaaattactcactctcaggtatttctttatagaaatgcaagaacagactcacacagaaaattggtgttggaggtggggcctggtgggaggtgattgaatcatggaggtgggtttcttatgaatgatttagcaccatccactttggtgctgccttcataatagtgagttcacatcagatctggttgtttaaaagtgtgtaacacctcccctctggctctcttgctgctgttctggccatgtgatatgcctgctcccccttcacattctgccatgattgtaagtttcccaaggcctccccagtgactgagcagattccagcgttgtgcttcctgtacaacctgtagaactatgagccagttaaacctctcttctttatatattacccagtctcaggtatgtctttatagcagtgtgagaatgggctaatacccctgccaaatgtgacctgcagtttatcaaagtcaacaaattaaaaagctgcaggggtgatacaagtgagaggaggtaagattgtggatgcagtccatggctgtgggcatcaacatagagagaaaagaacttgttggagggatattaaagataagcatgacctgagactaataactgggtttggggcatgcggcaggcagaataaaaatgcacatgtcctaatccttggagcttgtgaatacgcaacctttcttgtcaaaagggagtttgcagatgtgattaagttaaggttcctgagatgggaagttgatcctggattagccaggtggccctgtgtcatcacaagggtccttataagaaagaggcaagagggtcagagtcagagagagatttgaaggtgctattgatattgcagaagaatgatcaatagcatcttcaaatctgatcttgaagaaggaaagcatgagccagggaatgctggcagcctatagacattggaagtgacaaggaaacagatttttccctacagtttgtagaaagaaacactgctattttagtctgttttcacactgatgataaagacatatcccaaactgggtaatttataaacaaaaagacatttaatggactcacagttcaacatggctggggaggcctcacaatcatggcagaaggcaaaaggaacatcttacatggtggcaggcaagtgagagtttgtgcagggaaactcccctttataaaaccatcagatctcatgagacttattcactatcatgagaacagcatgggaaagacctgcttgcatgattcagttacctcccactgggtcgtcccacaacacatgagaattgtgggagctacacttcaagatgaaatttcggtggggacacagccaaatcatatcgactgccctgcctacaccttgatgttaacccaagcaggacttttcatctccaaaacagtaaaatagtacttgggtgttttttaaagcccctaagtttatggtagttggttaccgcagccacaggaagaaaatacaggacagatgaggagagagacagcaggttgattcccaggttgtggaggacaactacatggatggtggatctctcacctggtccttccacagaggagtagttctgggaataaatacatattttcttttgcacaccttgcatttgtaaccatgacagagcaatctgtttcaacttttatgtaacaaagttatgagttgtttttcagttatcatgcatccccagtttaaggtcacctaacctgggcattcccagatgaaccaaggtggaacctaagtccttggaacaaggaatgggaactgaattaagaagcagacactgcatggcaggatccacgatccaatcagattgagccctggtgtcaccacatggcggaatccagtcagatgacgcctcccaccctcacctcattgcaagatccaatcacatcatgcctcattattccatgtttataaaacccaacctatctcccaatcagggagacagatttgagcatttcctcctgtctcctttccttgccagttgagttgcaataaagcttttcttttctcaaaagccagtgtcatggaattggcttctttttgcgtcagacaagagcccattgattgctcagtaacacatttgagatggaaatggatggtagacaattggctagaaatccagagttctgaggccaagttctctgcgctgaggacagagaagagctggtgttcaagctgtttgaccatgggtctgaatgaatctgtgactgccttccggccttagaaaaacaaaatagccatatccgtgcaggctattaatcaactgggtgtgcaagtccttcacacaacagccaacacgcacaccatccttatagatggtgcagatgaacacatagccattgagaacatcttgcagaacatcaatgtttagtgtaccaactatgaacaacacactatttttttacttcagatctcatagcattttcctctggttccttcaaatattttaatctattggtctttctccttctcaacatgtttcctagttttctataaccattgccaagtcctctgcatcttaaaataaactccctctcattttgatagtatggcttccatcagtcacattagtgagagtcattgcagaggtgacagggaaggacagaattcaaacagcatttggtgtaggagaaaataagccagagctatcataaggagagtgtagaggaggaaaaatgaattcctgggcaccagtctatggagatgcagcaaaatcaccaaggggggtgttttctttgattttattttcctctgagttgtggattttaggtttgttgaacaatggctgggtgtggtggctcacgcctgtaatcccagcactttgggaagctgaggtgggtggatcacgaggtcaggagatcaagaccatcctggctaacacggtgaaaccccatctctactaaaaatacaaaaaatcagccaggcgtggtggcaggcgcctgtagtcccagctactcgggaggctgaggcaggagaatggcgtgaacctgggaggcagagcttgcagtgagccgagatcgcaccactgcactccagcctgggcgacatagtgagactctgtctcaaaaaaaaagaaaaggtttgttgaacaatgaaaccaagtctggtgatgcatgtattcatttccaagcaaaatctagtgcagggattttgggggtgggggggtggggcaggtaggggaaagtgggcaggtttatttattcctaacaccatttatgcacatgacactgctttgaatagattcagcctcctttatacctgggaaaccactccctatccagttagcaccagttgccagaaagctctattgtataatatcaaactcaatctgatcgttaatgttacttacctcagccttgtgcctccaagagtttatagatcttgaaataaaagacatcttgtaggttgtaaggttgtctacatttcctcatcctaagaaaaagagaaaagtggcaaagaaggaagaggaggaggaagaagaaaaggaggaggaggaggtggaggcttggtcataacacttagcctctgtggctaagaaagttcagttccagcctgaaacctattcggcatgttgaataatgttctacttctttgagttcatgttatcactggactatcttattgttttaggatgcgtatggctgatactaaattcttattccattccttgagtactaaggtttcgtgaagtaatttgaacacaaaagtccactaacagattgcttctattattgctgtaacctgagcagtattgagttttccttctttctaaggcagacattggcaaatgatggtactggtccaacccagcctgcttctgtttttgtaaatgaaattttatggacatgaagtcatgaccatttgtttacacattgcctgttgctgttttcatgctgtagaagtagatttgagaaattgtggagaccccatggccccaagagcctaaaatacacatcctctggcccttcaccaaaaacatttgttagttcctgctgtagaagatcaatagtcttgtggagcaaagtgtgtagcaaaacagattcctcgtctgtgatatgcttgctgtttaatatttttatgactaccatgatatcgactaagtaaggaaataattgagagaaaatcacaagccattcatgagtactaaagaaaagatttaaaagagagaaaggaaggaaggaaggaggagaaagaaaggaagaggaaggaagaaaggaaggaggggaagaggaagggagggagggaaggaaaaaaggaggaagggaaagaaggaggaagggaggatgggaggaagtgaagaaaagaaggaaggagggaaggaaggaaagaagaagggagggaaggaaggaaggaatggagggaaggaaggaaggaaagaagggagggaaggaagaaaggaaggaagaaggaaggaaggatgggagggaggaaaggtgggagggaaggaaggagggagggagggaagaaaggaaggagggagggaaggaagtaaggaaggaagggagggagggaaggaaggaaggagggaaggaaggagggatggaggaaaggaaggaaggaaggaaggaagggagggagggaaggaaggaaggagggaaggaaggagggagggagggaaggaaggaaggagggagggaaggaaggaaggagaaagggaaggaggagggagaaagggaaggaaggagggagggagggaaggatggaaagagggaaggaaggaagaaggaatggagggacagaaggaaggagggagaaaaggaagaaaggaaggaaagaaggaaggaaggaagcaaggaagggagagagaaaggaagatgccataccaagagcagtgagaccatgtagaattctaccctaaagatgaacaataaaatatgcaagaaaaagtgtttactttcataacataattctctttcctacatataaaatgtctgtctggaccactagatttaaaaaaaaaaaaaaaaaaaaaacttctcctacttatgttcacatacagagtttctttcagtattctgacttcaatttcattctccaacattttttctctgtgatatgggactatttaagtctaacatctgcagttcttggaaaaggcgattgtttcaaacatatctaataacatcttatgggtcttcacaattgaagaggaactatattttactttgaatatgctgacatatattaacatggttaggatttgtgtccccaaccaaatctcatcttgaatcgtaatccccataatccccacgtgtcaaaggagagaccaggtggaggtaattgtatcgtggggtcagattcccccatgctgttctcatgaacatgctgttctcaagtgagttctcatgagatctgatggttttataagaggctcttcccctttgctcagaacttctccttcctgtcaccttgtaaagaaggtgccttgcttcccttttgccttccgccacgattgtaagtttctggaagcctccagaagcctcatgttaaactgtgagtcaattaaacctcttccctttaaatattacccaggctcaggcagttcttcatagctgtatgaaaatggactaatatattcagatagaatttggatgttagttatctgtatttacagtgaaatagtttggctctgtgtccccacccaaatctcatgttgagttttaatccccagtgttgggggagaggcctgttgggaggtgattaaatcatgggggtggatttctcccttgctattctcatgatagagttctcacaagatctggttgttttaaagtgtgtagcacttcctccttcaccgtatctctttcttccaggccatgtgaagatggacctacctcccctttgccttctccaataattgtaagtttcctgaagcctccccagaagcagaagtctgtacaacctgcagaaccacgaacacaattaaacctcttttccttataaattacccagtctcaggtatttttttcacagcagtgtgaaaacaggctaatacatacagcatgaattttgacatgatttgacttccttttgaaatttgataacatatgttaacacagcccactccagcccttctctgagaatgacctgctggccttcatacctatatttctgggacatacacagcatgaaaccacttgggtatttatgctaggtctgacctataaattttagtgatttcatattgcctctaataagttaagatgcagtgactacctttccacagtggtttccagttgctatccaagtttcattgtaggctatgtcaatgctgagaggtgaatatcagttcagaggactttgctagatatctttcttttttctttttcattctttcaccttctgctctgcgcatgataatacccttcaataatgcaaaatggtgcaatagttgttcttcagcaatgattctgccagaccttaacaaccataatctttagcaacaagttcaggaagaattacactttcaacatttcacaaggtcatggagttaatacttatatccatttttcttcatttgtcatgaacatcctaactgttgtatattaccagaccatcaaaatttgtcctattaaaatgcatattagaaaatttaatattcaaaggataatggagtaatttttttccatttctggaaagtgtacaataggaatcagttattcaatgctgatataagaaaaaaaaactcacttactctatgaaaataagcaagtgatcatagacaaacatacatggggcctgaggctggagtgtgggttgaaaagaaggtaacaatgtgcagtgtaatacaaggttagagtgagcagactatggttaacttagaccagggactacatgtcctttttcatcaaggctgccttaggcacagagaactgtccacaaggtccctgatgtctacaaacttcccagttctccgttgtttttgttacaaaattaatttttttaatgaagaaaaatacaaacattactgaaagacgtagaagacacaaatataaatgaagtcatatggcatgattttggatgagacttttcgatattgttaacatgttagatatttcagagttagcatatcaggtttgacacaacactaatgaaaaccacaatggaattttgctctgttctttagattaagaagtgatttttctgatcatctgaaagaacaaacatacaagcacagtcatggcaatttgagtaaaaagatcaatacaggaagagagaggaagatttgaattatcttggtataaatttcaaattattaaaatcatgttatagtataatagctgtgtggtgactgattatgcaaaaaatgaagtagccaaataaaaaacaaatgaaaaagcaaaaaagcaaaagcgtattggattgccttgtaatgcaaggctataagcatttggattaattctttaggaaaaaaaattcatttcttacctaattgaaccccaggattaaatatagttgttaggagtccctcttccagttcaagaaagaatatcactctcatcttaataaacaaaacaatagatatttgttaaaaagatgttttaagttaaaaaaatcatagtttcttaaacatttgtggttttttaggtttgttttcggttttgtttcgttttgagatggtcttgctctattgtccatgctagagtgcagtggtaccatcgtagctcactgcagacttaaactcccatgcttatgggatcctcccacctcaacctccagagtagttgggactacaggcacatgccaccatgcccagctaattttaaaaaataattttatagagacagggtctcgctgtgttgcccaggcttgtcttgaagtactggcctcaagcaatcctcctgccttggcctcccaaagtgctgggattataggcatgaaccattgcacctagctaaaaattttaattaaacctcaggaaacaatgaaacacctataaactcaattccaaaaagtaacagctctatataagaaagaaaatacccctgactactttcatctttgttggagttggagaggcagaggaagctgctaatgtgggaaaggagacactagctaaactttttataaaatgtagtgaccacaggcaggtaggcatatcaggttagacaacttaggagtcctagtctctgaacatatcttcatccacctgccacctgcttcccaaacctctctacagagggtagagtgatagtacatcaaatgtggtggagacaggaagaaagagctgggagacatagctctgcagacacaaggaatctaccccaagttcaaggcagcctctctcagaaggtagggatcagggaaggaagcctgaatgaaaccctgcatggtcatctctgacctttacagagtatgggacaatagccctccaaagactgaaggcagtgtcacaaggtggagaaagttctcttgaggtacagaaagctgggcatgagagacagagcaaataggcatgccagcaatacctgaaaaatagcatcgaaacattccatgaaaaattccagacataaacaattcccaagttttaaattgcatgttgttctaagtagtatgtattattctgttctcacagtactattactacccaagactgggtaatttataaagaaaagaagtttaattgactcacagttccacatggctggggaggccccaagaaacttacaatcatggcagaaagcaaagcaggcacatcttacatggtggcaggagagagagcatgcaaggaggagaaatgccagatgcttataaaaccatcatatctcatgagaactcactcactatcacaagaagagcatggggaaaccatccccataatccaatcacttcccatcaggtctctccctaaatacttgtggattgcaattcaagatgagatttgcatggggacacaaagcctaaccatatcatagcatcatgaaatctgccagcatccctctctgtcctgcctggaacatgaatcaactttcttttcagcatatctatgcggtagacatttaggagccatctcagttatcagatccactgtcctggtatggcagtgcctgtggtcaaataacccttattttcctcaataagcacaagagtggacatgccagcatgttgttataattgttctactttgttatcagttctgttaatctctcattgtgcctaatttataaactaaactttgtcataggtatgtagatataggaaaaatatagtattaatatctatagggttaagtattctctgcagtttcaggcattcactaggggtcttggaacatatcccctttggtaaaggggaaaaaatggagtataatttttctaaagttgactgtgatatgttaaagataaatattgaattatctacagtcatgctttttaacagaactttctgagatgatgaaagttgcattagcctgttggaaatgatataataaaataccagagactgtgtagcttataaacaacactaacatatttctcatagtctgggaggctggaagtccaaaattgagacaccagcagattcagtgcctgatgaggacctgcttcctgcttcatagatgacaccttctcactgtgttctcacatagtagaaggggtaagggaacacgaatcccattcacaaggccccactctcatgaccttatcacctcccaaagtacccactttctactaccatcattttgggggttaggtttcaatacaggaatttggtgagaggacataaatatttagtctatagcagaagtattctacatcattcaatatggtaaccatcagccaccttggctagtgagcacttgaagtgtggctggtgtgattgaggggcaaatttttaaaattgtatttaattctactttctttcaatatccatatatgactagcaagtaccatattggaaagtaaagctccagggtagaggtgggcaacctttttctattaaacaccaggcagtatatagtcataggaggggtccccaacccctgggccatggaccagtactgtagccacactgcaggaggtgagcagtgggtgagcgagtgaagcttcatctgtatttacagtcactccccattgctcacattaccacctgagctctgtctcttgtcagatcagcagcagcattagattctcacaggagcgcaaaccctattgtggactgcacttgtaagggatctagattgtgcactccttatgagaatctaatgcctgatgatctgtcactgtctcccatcaaccccagatgggactgtctagttgcaggaaaacaagctcagggctcccactgattcgacattacagtgagttgtataattatttcattatatattacaatggaataattatagaaataaactgcacaataaatgtcatgtacttgaatcttccctaagtcaatcaccccagcttggtccatcgaaaaattgtcttccacaaaactggtccctggtgccaaaaaggttggggactgctgttctatagttttggatttatagactgacaggcaatgtcaaggatatcatgttggtacatatataactatttaaaatgtaacctatttaaaaatgtagaaacccttcttagctagtagaccatacaaaaccaggtggtgggctacagctttgctatagaataatcactaatatgtgtatgtgtgtgtgtgcatgtatatgtgcatatacatgtataggtatatatgcatgtgtatgtatatatacatgcatgtacatacatatatatgtatatgtacatacatacatatatgtgtattttttagtagagtagataaaaccacatactaagtgtattagtctgttctcatgctgctaataaagacataactgaaatgggtaatttataaaggaaacaggtttaatggattcacagttccacatggctggggaggcctcacaatcatggcagaaggcaaatgaggagcaaagctgcatcttacctggctgcagacgagaaagtttgtacagaactcccatttataaaaccatcagatctcatgagacttattcaccaccacaagaaaagtatgggggaaactgcccccatgattcaattatccccactggccccgtccttgacacgtggggattattacaattcaacgtgagagttcggttgggacacagtcatatcactaagaaagagtcaatccaaaggaaggtatgaaatgagtaatggaattataagaaacaggtagaaaataactgtggtagaattatacctacctgaaattcacacatacattttggttggatagtaaatggcaagactactttgtaaaatcatctgaagtattttttataaagtcagacatacgatgatgccacaacccagcactccttctcctagatatttattcaagaggaacgaaaatacaagtcctcacagagactcttcaagaatgtctacagcaagattatttgtaataaagaaaaacaggaaacaacccacatgtctatgaagaggggaatgaataaacaaattgcaatagagtcacacaatgaatactatagtagtccgatttcacgctgctgacaaagacatacccaagactgggtaatttataaagacaaagaggtttaatggactcacagctccacgtggctggggaggcctcacaatcatggtgaaggcgaatggcatgtcttacatggtggcagacaagagagaaaatgagagccaagtgaaaggggtttccccttataaaaccatgagatctcgtgagacttattcactaccatgagaacagtatgagggaaacggcccctatgattcaattatctcccatcaggtccctcccataagacatgggaatttggggagctacaattcaaaatgagatttgggtggggacatagccaaaccatgtcaaatactattcatcaacaaaagccaatggaggaataggtgcacatcttggtaaatgtttagaaattggacacacctatataatcactatgcacatcaagagctggatcaaaatgagcaaccttgaaatcccccttgtgtccttcccaaggaggtcaattttgcttccttttaaagatttctgtattttccaaactttctacaaaaaaggtaaacatttttaaataaatatttttcagtaagttccttgtctttatggagtttctgtgccgattttcctagaattgagatgctctgctagcttgcatataaaacatgacatatttaaaataaaatattatcttttcaatgattatcctggaactgtcctctgaagcaattcagaatacaattaaagatttaatttaatgtccgtgaaccttaatttctaatttggatataggctggagcaaatagattgtaaaaaatttttaacaaaaattgatattgtttctcatatcatttcctaaggatttgataatttatgctatccttaatgactttgtacctcttcaaagcacattgatggaaattgattttcctgattatttcagcagtctttgggaggtaacatattttagtgacaccctggaaaatctctctagtgtactctctaagttacccaggacaacagctgctacagaaagaaatctcttcataccacccacctttgttcagccagaaacaaaaatagtgctttgattgctctctctgacctacttttgtgaaggagtactaacgacctaaattcccaaagtcgtgggccttggagaaactgtacaggattttccaacccgtcctcataaccttaggccgaattccacttccactgtgctagattcacacaagcctgtacttttcctagagatttgcaaggattttgcaccattcgctttggattgtctatcagatctttatggaagtgtatggctttctattttgtattccaaaaaataatatgtaaccggttcatttaatggcattatgaagtttcagagttaggcaatgcaaaggaggactgagcacaggacatttggacttataaatttgtctgtcacacaccctagccctattagtagttcacagaacccatttttaggaatcattattacatcagaatctatccagaaaaatcagcatccttacctggtcactggccaatgccagcctgagggatacccagcctcccaggtctttcttgagtctttacctcggacatgataggttcacatcattgtttccagtgcttggctttaaatagttgtgtcctgtctcctgaccctttcattcatttcagccaccttcttttctctaactaacacacatagttataatctatagactggcaggtttcaaacattggccctcaattctgactcatttcagagtcaaaagaaccctcatgaaagaccacctggcatgcaggtgcatcaagttccagaagggacccttgactgaccttgccgactttcctctaccttttcatcccttatcatgcaccatcagtaagttctcttcaatctaatatctacgtatgtgtacatgtgtgattacgtttgtgtacctgtactttgttttgttctttttccaaatttgtgcattttcttaatttttactgcaaccacccaacttcacaccactgtcttcttctgcctggactgttatagtagactcccagcaaggtatctcagactccctcatgtgcacctccaatccattctcttcaaggcagcctgagtgacctttctaaaacaaaatttagattgggcaattgggccacttctctgcttaaaatcttgcaattattttatttgtttttttgatttaacatttgggtagtcaaaatgtttaaaatggcctacataggctctacttcgttaatcttgcccctgcttctgtcctccagaacattacattataatgataaaatgttcctgaagagacaccaaagcttataaatggagtcacttaaaatattttcgtaggatttaaagcaatttctactgtttttctgatagctgaattattttcttgagacagagtctcactgtgttgcccaggctggagtgcagtagtgcaatcatagcttactgcagcctccaacttctgggctcaagtaatcctcccacctcagcgttctgggtagctgggattacaggcacaggtcaccatgcacagccaatttttttaaaaaaaatttgcagagacaaggtctcagtatgttgcccagggctcaagcaattctttcacctgggttgagttcctgggctaaagtgatccttccacctcagcttcccaaaatgttgggattacaggtgtgagtcatcgtacctaggctgatagctgaaattttaacctcatggtactgttcgctcaaaaaaaaaagtgtgggataacctgctcccagtttcctgacccagggcaatcacattatgagttcacattgtaagacttttgcagaagacaatttgaatgccttagcatcaattctgtacagaccctgaaggctcatcatagaattaggaagacttcctctctcctaccttcttgtccatctaattgttctgtttcataagccctattctcacaatcaaggacataatcacttttcaatctttatactgtccaaataaggaatggaatctcattaaaataaaatttaaaaatttattggctgttgtctttatttgctagagctgtcataaccagataccaccgactgggtggcttaacccacagaaatgtattctctcacattctggaggctggaagcccaagatcaaggtgtccccagggttcattcctcctgaggcttctcttcttggcttataaatgccaccttctccctgtgtcttcacagggtcgtccctctgtgtgtgtctgtgtcctcatctcctcttcttatggggtgtcttagtccatttcaggcttataacagaataccatagactggggagcttataaacagcagacattgattctcccacagtcctggaggctggaggtccgagatcaaggtgtgagcatggctggttccttctgaggcctctctccttggcttgtagatgatgtcctttccctgtgtcctcatgtggtcattcctctgtgtgggtctctgtcctcatcttctcttcttataaggacatcagtcctattggatcagagccctccgtactgacctcattgtatcttaatcacatctttaaagactccatttgcaaatacagtcacatcctgaaattctgggggttaggtcttccacacatgaatttttggggatgaaattcagcctgtcataagcactttaaatatgagtgcagttcccgatgccctcttccacagcctatccctctgcattattacctgcagaaataactgattggcctgaactcctatgaatatgcagaaacaaccaatcttcgcatcagagtattctaaaagtattaagtgggattggatgcacgtgtctgtgagtgttgcctagaatgtcaaccaatgtcagtgagccttgatcaacatttcctctctaagttcacttttctaaagcactgactgaggaaagatcttaaaactttagacatggaaagattcatttttcaaaccccagtctctagaaaacacattacattaaaacttgaaaaaaaaattagccatgtttcagaagcaaacttcattttgaaggaaggtcaggaaaagatatataatatatatattcatcatttgatagttggacccttgccactggtaggttacttgaaagactattaacagagtcacaaaatcagaatttaaatcgagcccagtttatttcctaccacgtgattttggggaaggctaatcacagaggttagaaaattaattaaacatagaatgaactcacctctatcctttggaaaagtctagaggggatacctttacaaatttacaacagcttgacagagaaatgccagtttcaggaaagaaaaaggctcgctaccacaacctgtaaattgttagaagcaacatcttaacaaatcaaaatggcagttctgttgcacatcctgtaggctagtgagtatgattcagaaataagcatatagttggtgaaaaccatgattcactggacaatatttccagcaagacttcttttactttaaagtaaacactgagtttttttaaaaaatcttttttggggaaagtttacccgctcccctccccccatcctaccttctgttctcacttgattcctgtcataatcctcaatttgttgaatcacaattggttgctgtggtgatgattgcgatatcacaaacaagattatgacttcaagtggggaataaacagcaggcactcgaactcttaacaaatgaaattctatcattatgcaaatagccttcaaataatcaagtgtgacccaaaatgcataattttcttttgtgggatatttttcttcctttggcatagaaaatgcatcatcatccactagattcatttctaacgaaaatgtcatggaacttcaaagatatattttaggttgaaacactctcgtatataacaattaaacatcatcaacatgctgcaaagatcattttataaaatgtaatgatttgtccaaatttaaccaggcaaactttcccaaatcagaagagtaacagcaatcatactgaataattgccaaattatgggtttaaaattaaggaacttgtaatagacatggaatatgcttaacttggcttctgagattacagcagttgctgatcactctcatgtagtgcctaaatcctgaccaaagatacacagacggacagctagataatagatgaattgataggcgataggtatacatatagataatacggataggttgatagattatagatgattgataggtgatagggagatggatgatagatcgatagatagaaaaaatgatatctagtattccatgaaagtctcctctgaccagaaatacatctgaataaatgtggagcgcacacacacacacacacacacacaccgtcttgttattctcatttttatgtgatttgaaggcttaaagagaataaggattgagttgtgtctatggctaataagtttcagagtctgtatttaaagctcaacactcagcactaccccttagggctcaaatcccttgaaaaaacacaattatatatagtcgtaattaccagtaattattatcttggctctatgtaggtttaactgtccagctgtccggtcattgcctgaggagagactcgagctcctaaaataagagaaggtgggagcaataaacgttggcctctgtcagggatgcacaaccaaattgatcatgtgtctggtaaacaaaatatctacaggacatgtggcttagggaaaattttctgtaaaggttccccaactgtaatattctatcatgagaaatgtttttacgcctctttgaatcttggagtttaactcaaagggactggggtgggtagattttacacagaggataggtctcttaaagattttctgataacgaacaccttgatgaggagttcttgggcccttcctctattagagggtaaactcgtgaaaaataagctatacgataggtattatgtgttcgttcttttaaaacacagaatgaagtgacttctgtcataagcccatggtgatttccattgttgttaatacttcaagatacagggacatgtgagttgaaataagtggggaaatctattagagagagaagagacaagcataaaaagctattcatatttctttgcaagacccattcaggaaagttgagggaggtgggggagtgtctgagggttcatatatctacaaaaacaaaatttacttttatttatttatttagagacagagtgttgctctgttgcccaggctggagtgcagtggtgcagtcatagctcactgcagccctcacctcctgggcttaggctatcctcctgcctcagcctcctgagtaaccacaccctgataacattaccattcttaagctattgatgactgctcctggaggtcatgaaaattacagtgaagggtcacccaaatctacgatgatggcatatccctctctattagtccattctcacatggctataaagaaatacctgagactggttattcataaagaaaagagccttagttagctcacagttctgcaggctgaacaggaaacataatgctggtgtctgctcggcttctggggagacctcaggaaacttacaatcatggtggaaggagaagaggaagcagggacattacatggccagagcaggagtaagagagaagaggaggaggtgccacacagtttttaaaccaccagatctcactggaagccactcactatcttgaggacagcaccaaaggaatggtgctaaactatcaggagaaatccacccccatgatcaaatctccccccaccaggccccacctccaatactgggaattacagttccacatgaaatttgggcagggacacagatccaagctctatcaccatcttaggaattgtatcctatgtgtcagtactggattagcccagccgccagccagtaataaggataccatccaaagcaagaattaacaggatgtgtctgtactgccggctgggggccctcactgtgttccctcccacatctgttctgtttagggagcagaagccttggcccatatggtcaggatggcaggatgtctactccaccagcctacgacatctctggtcaacattggcctctcatgactgatcgcccgtgcctgtgtggaaaagagcccttctaggaaagccgttacttggcattccagagatctgttcttcctgtgttgccattagagtcacaagcaggagcaagtacctccaccccatggttcctggaaacaaagaaaatcagtcagctggtggtgggtttctttggcttgtggaaagttagagacgcacttcgatttcatgaggaggttgtaatgagcctggatcataacactgcactttaacctgggtgacaaagtcagaccctgtctcaaatagtagtaataataatgatgatgatgatgatgatgatattgagcatcctttcgggtgcctattggctattcatgtatattttttggataaatgtctgttcagtttctttgcattttcaatttggttatttattctttcattattgacttataagagttctttatatattctggataatgtcccttataggatatgtggctttacaatatttcatcttagtctgtgtgttgtcttttcactttcttgattgtgtcttttcaggggaaaacacttctaatattgataaagtccaatttttcaatttttttcttttgtcatttgtgcctctagtgtcaaatctaagaaatcattgcctaacccaaggtcaggaagaaatattcataggttttcttctaagagttgtataatgtagctcttacatttaggcctatgattcattttgtggcaagtttgcgtatggcatgaggtgtttttttttttaatacatggacgtataatttggaaatgagcttgttttgcctcagataaatgaaacaggctctttgtcgtctcttctcttttatctcttttcttgttttaggtgtctcctcattcctggtcctacataaactcattttgacattcgccttaggcatttcagaatctggccctcacccttatggttttcacatatcatgaacaattttcttcttttaccctcttatttggggtgcctaagcctctcctcaatgaaatggcaaccggttacaaacgactaagccaaggtgacaattacccataattatggcttaataaatatagatgccattgtggtttggttttgtaacaactttattgaggcataacctccatatcttattcacatgcattaaatgtacatttcagtgacatttaggatattcacagagctgtgcacccatcaccatattgtaatttacaacatttccagccaagcacagtggctcacctacaatcccagcacttttagtggccaatgcaggaggatgacttgaggccaggagttcaaggccagcctggggcaacacagcaagacccccccccgcatctctacaaataatgaaaaaattacccagatgtgtgccatggatctttagtcccagctactcaggaggctgaagtgggaggatggcttgagctcaggaggtcaagactttagtgagctgtgatggcaccaccgtacttcagccttgacaacagagtgaaatgctatctctaaaaaatagtattaaatttaaaaaagaacatgtccatcactgtaaaaagaaaactcatgctcattgtcagtcactacctgtttccttcatcccacccttcccctagctctaacaaactctcaaactactttgggtctttatagatttgcctttcctggatagtacatataaatgaaatcatattttatacattctatctatctatctttatttaaatattaattgtgatgaaatatacatggcataaaattaccaccttagagtgtacaatccagtgacattaagtacattgttgtgcaaccatcacaatcatccatacacagaactgttttcatcttgcaaaactaaagctcttcttaaacaagaactccgggcctggcatggtggctcacacctgtaatcccagcactttgggaggccaaagggggtggatcacttgaggtcaggagtttgagaccagcctggacaacatagtgaaacctcatctctactaaaaaaataaaaacaaaaaagaactcctattgcccctacagtatgtgatttttttttttttttagtgactggctttcttctcaaaatttacccatgtcctagcatgtattagtacttctttccttcctccattgtgtgtatatattacattcatctatgcattcatcaggtggtggacatgtgggttgttttcaccttttggctattgtcaataatgactgctgtgaacattcatgtgcaagtttttgtatggacaagtgttctcacttctcttgggtaaatacctaagagtaaaattgctgtgtcacatgcacacgtatgtttactgcggcactatacacaatagcaaagacttggaaccaacccaaatgtccaacgatgatagactgggttaagaaaatgtggcacatatacaccatggaatactatgcagccataaaaaaggatgagttcatgtcctttgtagggacatggatgaagctggaaaccattattctgagcaaactatcacaaggacagaaaaccaaacaccgcatgttctcactcatagttgggaattgaacaatgagaacacatggacacagggtggggaacatcacacgccggggcctgtcatggggtggtgggaggggggagggatagtattaggagaaatacctaatgttaaatgacgagttaatgggtgcagcacaccaacatggcacacgtatacatatgtaacaaatctgcacgttgtgcacatgtaccctagaatttaaagtataataaaaacaagaaaaaaaaattgctgtgtcaaattctatgttaatattttgagaaactgccagactattttatcaaagcggctgcacaacattacactcccaaataatatatgagggctccagcttctccacatccttatgatcatgttattgtctgctgtttttattttaacaatcctagtgattgtgatgtgtgaatgtggttttgatttacatccccctaatggctaatactattaagcattgtggctcatgactataaccccagcactttgggaggccaaggcaagaggactgcttgagcgtaggagttcgagtccagtgagggcaatatagtgagatctcatccctacaaaaataattgtttttaaattagccaagcatggtggtgtgtgcctgtagtcccatctactcaggaggctaaggtgggaggactgcttgagcccagaagtcagaggttgcagtgagccaagattgtaacactgcccttcaatctgggtaacagagactctcaaataataatagtgatgatgatgatgatgatgatgatgatgatgatattgagcatcttttgtgtgtctattggctattcatttatctttcttggagaaatgtcttttcagttcctttgcattttcaatttggtgatatattattttattattgagttttaagggttttttatatattctggataacatcccccataggatatgtggctttccaatattttatctttgtatgttgccttttcactttcttggttgtgtcttttgaagagcaaacacttttaatgttgataaagtctaatttttgaatttttttcttttgtcatttgtgcttctagtgttaaatctaagaaataattgcctaacccaaggtcaggaagaaatattcatagattttcttctagcaactgtataatgtagctcctatatttaggcctatgattcattttgaggtaagtttttgtatggtatgatgcaggggtccagctttattttgtttatatatggacactcaaggcaggaaccacatatatcttatatgtgatatttacccccagcacctagcctgttgccatgaaaatagtaagcacaaaattcagattttctaatagatagatgtttagcttttttgtgtacttttaagttcagggttacatgagcaactttgttacataggtgcatcatgggggtttgttgaacagattatttcatcatccaggtattaagcctagtacccattagttattttcctgatcctctccctcttcctactctccagccccaagcacgcattgctatctgttgttttcttctttgtgtccatgtgttctcatcatttagctcccacttatacctgagagcatgcaatatttttttttccgttcctgtgttagtttgctaaggataatggtctccagctccatccatgtccctgtaaaggacatgatctcattcttttatatggctgcatagtatttcatgatgtatatgaaccacactttcttcatccagtctatcattgatgggcatttgggttgattccatgtatttgctattgtgaatagtgctgcagtgaacatatgagtgcatgtatttttataatagaattatttctattcccttaggtgtacactcagtaatggattgctaggtcagacggatgttttataactgtagagtctatggttccaattctcaaatccagatttcatgcttcagttgttacaaaaagtcagaagacagcagaataagacaggaataagaaataatatattatatatatatatatatctgtatatctcttctactaagcatgatacatgaatggcatttcatttttctcattaaaccttttccatcaactgagaaggcacatattaaaataaactatcaaggatgcaaaaatacctactcatgcactttgaatggaacagtctgaatagaatcaagacaagaggcggactcttcagacaatattgagcatctgctgggttaataataatgttcagttacaccagtccttcattgaattctactgtacccaggcatgaaaatccagcagtttagatggcaccaagaaggtgccacagttaagctgcacaagccagttacaaaatcgcaaactatgcaaaattgatttctagttcagaaaggaaattattatagaattgggtagacataaaaggctggcatgtgaatctcatgcaatgacaccccacctctatgccatgtgtcactctgctatccacatgctttctgtggtaactcgctaacacacggtctgaccttgtatatccaagtggaattatcatttagttactttactgcaaacagcctataaatagttttgcaattataatcttgatttgaaaaatatgaatagaaaaggaataacttccttggggaagctgttaagtgcattattattccatctttcaaatgagaatgcacttttaatcccagccttcctctctgatcagaatttcttttatgcactggattcaacagcactctggaagttcattctccactgcaagcccacagatgcataatcacacaagggaaggtgcttcacccaccacatctgagtctcaattttgcccaataagaatccacttttctcaatgccatgaatcccacaaaatgtacatgtattagtccattttcatactgctatgaagaaatacccaagactgggtaatttataagcaaaaagaggtttaatggactcacagttccacatggctggggaggcctcacaatcatggtggaaggcaaaggaggagtaaaggcatgtcttacatggtggcaggcaagaaggcatgtgcaggggaactgccttttataaaatcatcagatctcctgagacttattcactatcatgagaacagcatgggaaaatctgccctcatgattcatttacctcacactatgtccctcccatgaaacatggggattatgggagctacaactaatgataaggtttgggtggggacaaagccaaatcatgtcattacacaaagctagttgggctgcttttttgaaccactgaaataactcttctaagagatgtgaaaggaaaataagtcttggggaccccaaaatcactaagctaaagggaaaagtcaagctgggaacggcttagggcaaacctgcctcccattctattcaaagtcacccttctgctcactgagataaatgcatatctgattgtctcccttggaaaggctaatcagaaacttaaaacttaaaagaatgcaaccatttgtctctcacatacctgtcatctggaagccccctccctgcttgagttgtcctgcctttccggacggaaccaatgtacatcttacatatattgagtgatgtcttatgtctccctaaaatgtataaaaccaaactgtgctctcaccaacttgggcacatgtcaccaggacctcctgaggctgtgtcatgggtgcatgtcctcaaccttgacaaaataaaccttctaaatgaactaagacctgtctcagatatttggggttcacagaggtaactaattcatggaagaaggttctaatgttattcaatggcttaaaaaaagctaattagctgagactgaactggttgacttgacagacaaggatatagtctgaaagtaaccacaattgatatattagaattagcattttgaatgaactctgttctccagctacttttctctctctttacaaattattttctgaagaaatctggttttgtaagtttttctatgtatcttgattcaaaaaactttgatttcatacttagttagaattgacaagattgccctcaaccacactgcatcgtggagagtaatgacctcctggtgaaaatgaaggatatttataaaattcagctctgcctgccttcataaatccacattttcaaaggagaatgaaacccacacccattgaaccacaaagaatattccccccacttgtcatttttctgtggacttttaaagtaacatacctttcagagtccagaatgctcatttcaaagagatttcttttgttctgttattatcagtgatggaagggcctttattgggagtattctgtaactcattgtaacttgctttaaagtgaatatttcagcttcatacctggtcatgtggtttctcctttagctcttcttgtttgcacagttaagcaggaaggaaaccaaccatttgtacaaataaaagtggagaattaaggtatgctgtcatttttaaaatttctccccaaggggttttactgactgtctaaactgggcttgtgggttatcagttttctgaaattctatggcccaatttgataggtacaattccaaattgtaatttcaagcacaatctagttgattgccctcaaaatgctgaccctgacccataaagactagtcaaggaccacaggatttcagcttccttcttggacaggctgggtgttggccacaccgcaaaagtaacagggacatagctgatgtattggcttttctacacctgctgatttctatttttgtttaaatatttagggcagacagatagttaggtcagcgtcttgccttctctttgtaggacttaattcctagatcaacccaggagccctcttttgagggagtatatccatcaaagctcccatgtaaaaccttgtctctgatttcctttaatttttttaaatttaaaaacaataaaaataatctttctttctctctcttttcagagaagcctagatctcagggactgatgtttcagactgaagaattcacaacactgcattgaaaatattccttcctcctttaaaaacatccttttctcgtgacacccacctcctcattcaaatatagtaaaatcgtgagaagaagacgacaatggagaagctagaatcttgggactggcaacttttcaggagtctctaacaggatggaatcctctaccttggcactattgatatttgaggcctgataatgaaaccgcctttgcaaaattatgacagtaagagaaatctgatatcattgactccatcttacttctgacctttaagctgtccttgctcattcctgggcataggccaagctaactttgggaggaatttagtttatggtttaactttgaaataagaatgattatagtccctccctaaaaaataatcccctcccttttaggggctgaaaccacctttgtaagactaatgaggagtcagaagatagacatagtttctctcatcccttactgctcaggagtcatgtggccaactcacaagatttgtgacctacccaatcgctcctatagaaaacatcactactgttgtttttttctgagttgtttttcaggctgaccccacccagacccaggactcattactgcactgttcctgtggtcctacccagaggtggactcagtgcatggagaccgctttctacacttctattatttcatccccagccaagcagcagtacccattccctatgcccctgcccaccaaattgtctataaaaccctctaacctctaagccttcagggagactggtttcagtgataactccagttctgctgcgtggaccagtctcatgtcaattaaactctttctccattactgcaatgctacggtctcagtagattgattttgtctgtgcagtgggcaagaagaacccacagggcgattacaataattctctgtgatggggctgtcctgtgcattgcacgatggttagcagcatttctggcgtccacccactagccagtagtagagcactcccctacctctaactattaaaatgtctttggacattgtcccctggtggacaaaattggcattgcttgagaaccctatgatgttaagaggtacttacccaaagaatatgcaacaattattattatctgcatagctataacaaaattctccttactaatgtaaaaccctttttctattgtaatgctttaaaaaatattccactttgcattcccaaatcattttactaaaaaagatttactcttctcatttcaaggttttgagaaatccaggtggccttgaatgttagatttatctttttggatagaaaaatcctaagtgttttctgtctcgcagataactggctggctctgtttcacaaagttctgcaaagaatgaacacatgttctattcagtatacagccatgttaaagattccagaagtttttctgctccaatgttaccattggactgaatttaatgaaattgaaattgatcaatggaaaaaaaaactccataaaatattttaaagatgtttattctgagcccataattgatcgcagcccaggaaaaacacaaacccaagaagccttgagtaagtgaccccaaggcggtcagattacagtttagttttagggagacaggagttacagacaaagacataaatcaatatgtggaaggtagatattggtttgacctgaaaggtggaataacttgaagcaggggcttccaggttataggtggattcagagattctttaatttgcagcaggctaacgaactaagactctttctggaacttggagtcagcagaaaagaatggttagattaagataaggaaactgtatgggaagactgatggcctgcaggcatgacttaacctttgcctggcatggcctgaggttctatttataatttggtgtctaattgccacagggtcttgtcagtcttgcggtggagaagtttttaacattaatgctggtcagttgtatctaaattccaaaagagaagaggtataaagaagaatgtttcacttctgatatggtttggctgtgtccccacccaaatctcatcttgaattgtagctcccataattctcacttgttggaggagggaccccatggaagacaattgaatcatggggggcagtttcccccatattgttctcgtggtagtgaaagagtctcatgagatctgatggttttataaggggaaaccattttgcttggctctccttctctcttctctgctgccatgtaagacgtgtcttccgccttccaccatgattgtgaggcatcctgagccgcctggaactgtgactccattaaatctcttttcctttgtaaattactctgtttcgggtatgtctttatcagcagcgtgagaacggacgaatacaacttcccttcctgtcatggccagaactcagtttttcaggattctctggggttccctcagtcaagacaggatctgatcagttggtggagagcttaggattttatttttagtttacaaatttaacaagatgtgtgatcatatagtgttttcgaacagtacttctgataccatctatgtgtcactttcttatcccaattctgcaattctctgatatcaactgggtttccaacagctccattcgattctgacactaacacctcgagttagcacagaccacacaggttaagggttcagtcccacagggctgtcatacttcaagtcccagagaccacctatatttccgacccactggctagaagtttgggggttcccataatgccttcttcaggctcaataaaaattctctagaatgactcacagaacttaggaaaatattttacatcactattactggcttatttacaggataccaatcaagaatagccagatggaagagacatatagagcaaggcatgggggtgaggaggggcacagggccaagaacttccataccctctgcagacactccaccctcccagcacatcagtgtgtgcacccacctggaagctccgcatatcattgcttaagggttttcatagaattcagtgcccagcttcacttccctatggtcaggggatggagctgaaagttcccattctctaatcacaggtttgcccttgctggtgaccggtcctcactctgaggctatctaggggtcccctcaccactcattggcataaactcaggtacgctggaaagggggtccttatgaataacaaaagacactcctctatcactcaggaaatgccaagggttttagaagctttctgccaggccacagagatcagatttttatagcatagtgacaggcaggagcactggcccaatccagccacaatatcagggcctggctaggaggaaaccaccaaaaggggagaagctctgcgtgttttgctgagctaaaggcagcaagattctgcacaactaacattcctaacagctcctagaaatggccaacccctcccatgggcattcaagttgtagcatgtgatagaatttcttttctctttaaggctgaatactagtccattgaatagataggctatgttttatttatccattcatctgtcattgaacattagggttgcttctacttcttggctattgtgaatagttctgcaatgaacacgggtgtgcaaatatctctttgagatcctgatttcagttcttttggatatatatccccacacaaagattgctgaatccttttaattttttttttcaaagaaaatgggcaacatagttgaagtcagcatcggggaatgaaattgctgacacttagatacatttagataaagataagataacaatccagggaaaggagtactttctccacatttatttccccagagctctgtaaacagaaatctgagagacaattacaatttgaggagctggagtccctggaagtcatgcaaattctgtatttacagtagcttccgtgtcttcatttccaaatatttttcatctctacaatgttttcacctaatcaggtttttggggactatttgtgattctattattttacttgaaaaaatggtatgtcgggccctatgtgatgttgtttatcataaaatacctgaggaggaactctggtcctgtgatagtcatttaaaaccagccattaggctgggcgccgtggctcacgcctgtaatcccaactttttgggaggccaaggtgagcggatcacttgaggtcaggagttcaagatcagcctggccaacatggtgaaaccccatctctactaaaaatacaaaaattagccgggcatggtggtgcctgcctgtaatcccagctactcaggaggctgaggtacaataattgcttgaatccaggaggcggaggttgcagtgagccaagattgtgccactgcactccagcctgggtgacagaggaagactcccccttgaaagaaagaagaaagaaagaaagaaaagaaagaaagaaagagagagagagaaaggaagaaagaaagaaaggaagaaagaaagaaagaaagaaagaaaaagaaagaaagaaagaaagaaagaaagaaagaaagaaagaaagaaagaaagaaagaaagaaagaaagaaaaaggaaggaagaggggaggggaggggaggggaggaaggaaggagaatggtagttatcaggcgctgagggaggggtaaatgggaagatgttcaatgagggtagagttttagttgtgcacaatgtgaaaaagtttcagagatctgttgtacagcaatgtgaatatattcaatatatttaatgccactaaactgtacatttaaaagtggttaagatggtaaattttatgttatatgttttttactgtaataaaaaataagtaggaatatattgagttgcacattttaaacgggtgagcattatggcatgtaaattatatctcaataaagatgctaaaaattaaaagaaaaataaatattgtgaattccagaaagtgttatggtctacttaagagaatctcatgttttgcctttacatgtatgtgtacaaatgtgtacgtatatatagattttggcaattatcattcttttcttttcttttcttttcttttcttttcttttgtgtgtgtggcagggggatggtgtctctctctgtcagtcaggttggaatgcagtggtacaatctcagctcattacagccttggcctccaggactcaaacgaccctcccacctcagcgtctcgagtagctgctacacctggctgatttctttagtttttgtagagataggttttgccctgttgcccagtctgatctcaaactcctgggcccaagccatcctcccacctcagcctcccagactgctgggattacagatgtgtgccactgcatctagcctcattatttcttttagaagacatttatcaattgttttcaatacacatcagcattaaaaccttcattttcatgtagccatgcagaaataaaacaagtcattgtcttctctgtggctcatgttgaggaggaaaaacttttcctgtccccgcttaagtcctaaaattgagaatatgtaaactaaactgacaaaatacagatttgcaagagaaaaagcagatcgttatttacttgtatgtgggaattaacagaaaaacatgactcaaggaaagagaatttagggcctatatactatcttagcaatggaaggggaaggggataaggttttgagacagggtcttgctctgttgcccaggctggagagcagtggcacaattatggctcactgcagccttgacctcttgggctccagcaaccttcctgccttagcctcccgagtagctgggaccacaggtgggcaccaccatacagagctgatttttaattttttaaatttttttggtagagacggggtcacactttttaaaaataatgacttttaggaaagacaagtgggcccttatagatacaacagttttgtgacaatgtctggtgttatgccaacttcttgtctctagtgataagagttcatcttccctggttgctccaagaaaggagatttatgagaattgagtcgctcatctgaaaatcatatttatgcatattctggactccttcacttattctggctccccacttctgcctactccaaaactttttaaatttagtgggattcgaattgcctttacttagcaatcaagactttgcatttattggtgacctctgtcatagtctaaccttatcatagcgactatgtgcaaatagtgtccttttatccacatccacccagtggggaaatgaacaaggaaagacagatacagtattggagacagagttaaaggatcaggcccagagaaagcagctttggactaagtcttgaggggctagcaaaccacagcccaacaaaggattgggaaaagggttttaagcagagggaagcttgcgtacaagagtagaaaagccaaaacaggcaggaatctcttaccaactgtcagtatctgacggagccctaggatttgtgtagaaatttctctggattggtagtaatttatggaatctcaatttcctcctctgggcaataaagagctcataagaaatatgagcacagcggtggtgatatgaatatacttgaatataagaaatggcatgctaatggcactctcctatgcctaatttctctcctaaggtccccaagtttgtaaacttatttacttctcctatgctacctccaagttttcccacatacagactctctgtaccttttgtcagtgtacagcgagcattagaatttctaattgcctttgcagaagaaaagaaatatgcagtgtacaattaaagagctgatttcattcaggtcattgcaacagggaaaatgttcattaatgaggagcatctcaaaggacaggattggagcctggggttttgtagagggaagtcgacagataatcatccttatcatctgctaatcttaaggatagaaggaggtgggccttatctggggatactcatttaaccctttcccggaactcaaaagtgtgggggcaatcatccttgtcatctgctggtctcaaggatggaaggaggtgggacttatctggggatactcagttaaccctttactggaattcaaaaatgtgggggcaatagcaaagtcatggaatcaatctaggtgcccatcaacagtgaattggatacagaaaatgtagtacatatacaccgtggaatactatgcagccatagaaatagaattaaatgcctttgcagcaacatggatgcagctggaggccattatcctaatcaaattaatacaggaacagaaaactaaataccgcatgttctcacttacaagtgggagctaaacactgggtactcatagacataaagatggcatcagtggacactggggactactaagagaggaagacagatgagcaagggttgaaaaattaactgttgggtactatgctcagtacctgggtgatgggatcatttgtactccaaacctcagcatcatgcagtatacccagataacaaacctgcacatgtaccctctgaatcttaaataaaagttgaaaaagaaaaaaagaaaaaaaaattgtgaggggaaattgttaactcttgctatgttctgggagcttagggctcaggtaatgttcaacattgtcaccctgctacccatgtgccatggtgatgggcttgacctctacttctaatagagagagagaaacagcacatgtactagggagatctctggtgttcacatagctatatgcacgttttattttagggtgagagggtttgattgcatattttcattaattataatttgaaaaatgtctttcactgttgcagctcattatagataacatcatgtagattttcaagatgggaccaaacatggaaactgcgatcgagtagttctcatatgcatgagctgttacaaatgcattggccatttgtagtcctactccagcggatttttgcccaacaaacacagtgattcaccaaattgaattacgtatttatcctttaatgtattgtatgatgtagtatatttctgacagaataaaacttctattttatcagacattggtgagaattgaatattcccctataatattataagtctgaaactggaagaggggagacctactgaatagctctgtctttacatatttgaaaggatattcctcctcctttacccacctgcttccactgctgggcactgaggatacattcatatacttgtcccttctcacaacgtcaggtgaatgaggcagcaggtgtatttctgaccaaaggcaataggtgtatttctggaagccaaccattataggccaggaaagctaggaaaatttagcattacaaagaagtgactgtgggcactcacatccaaactaaatgtattaccaactcatcttctgttttttgtgatccacagaatgctctggtcaccccaacatggcctggtacatggtccaaaatgtcttgtcagtcacaagcttggatagaatccatccgtatcaccatctgagaaactaagagaggagacgtgtatttcttccagaagaagacaggaagcttatctcaaaacatcagccatggtggagttaagcttgaagggggaaaattaattcaaagcaatcccagagaaatgcagttcaaagaagaaaagaaagttcaaaataaagagaaaggggagaagaaaaatgtaacactgtactccaccctctagaggattcttccttgacgttgggcaactttatgaagacgtatgtgagcaccagagggacagtgcctagaaaaaaggaaagttccctctagattattatatgcagctcacagctctgaggccatctcttggaaaatactaaatttttctttaataagtactgatgctatgtctttttccatgactaataatgcattgtgcttgaaattgttaaactcacaggagagtaaagtcatcacagccataataagatatcaaaatggatatattttaataactttattttttaaagcaactttacataactcgttgattgagggaactaagcagattgattggttccaaggaaaagctttttgaaaaatcacaaatatatagatcaggaaggctgaaatggatatacaaatggagtcttaactggtttctctatatggaatggggaaaaagtcaatcataccacataattcagccaatgtgggacagaaaagaatctgcaaatctctaagaattattttggcatactatctgttaaatacaatctacacagttataaaataattcagaaaaaaatcaaaggctaaaatcatgtaactcaggagcgtgtgctctatgttgaaaatgcatattcttaagcattttttttggccactgtatccccagctaattggacacctcactgtttgtggttgacttgtgataaatccaacactatgctatttccattctaaataccgtgtgactctaaagttaaagtaatttatttgttgtcaatgacacagaatgtaaacacacagatgtgcattatctccatcaagaagaaaatcattgtttgaagcacttaaacacactgtaaatggtcaagctaggttttcaagtctatgcttgggattatttttaaagcctgccacaaagtacaaataacctcattggttgcaaatttattttcttcatctcttttgagagagaaggactcaaaattccattgctgaagggggcttcccatggaaacactgagtggaaatgcaagcagcctctatgagcaaagaccagcctccggttgacagccagacaaggaaatgggcactgcagccatacaactgcaagggactaagtttgactaacaacctgaatgagctttgctgtggatctattaggccttccacaaattaatatatgttgaagtcctaattccccaatgagactgtatttggagatcgggtctttgaaaaagtcttttaattacagttaaattaggtcataagggtgggaccctgtttcaataaggcaggtgccttataggaggaggaagaaacactagagtactctctcatgtgttccctctctctctctctctctttctgccatgtgagaacacaccaagaaggcactattggcctggcacagtggctcacgcctgtaatcccagcactttcggaggctgaggcggatggatcagctgaggtcaggagttcaagaccagcctggccaacatggtgaaaccccatctctactaaaattacagaaattacccaggcatgatggcgagcacctgtaatcccagctactcgggaggctgaggcagagataattgcttaaaacccaggaggtggaggttgcagtgagctgagatcacaacactgcactccagcctgggcggtagagtgagattccatctcaaaaaaaaaaaaaaaaaggcaccatccacaaaccaggaaaagagtactcaccaagaacagaatctgccactgacttgaccttggacttcccagcctccagaactgtcagaaataaatgtctattgtgtaagaaactcagtctatggtattttgtcacagcagcccaagctaacaagtacaagcttggaaggagatttatccccagcattttctgtaaggcaggcagcctgacagacaccttgatttcagccttgcaagctctagaagagagctcagaggaccccacaagatttctgacgtgtagtaactctaaataatcaatgtgtattgttttaagcctcaatgtttgtggtcatatgttccagtatcaaaaggaaactaatacggttgcctcctaaatgttctttcccacagttaagaaagctgaaaactcccaagtgagtctcaaatttttctgcactatgagcaatggctctccttggaagaggtgaggaaatagctccagcaggaacctggggttgttgcccagttataaagatgtattatcttttcataaaatatggtatgagatgtcctcccagaacttctctcttatgacagcttcccactctatccatagcttcagcaaccagttcctactgataaaagaaaaacttcagcagaattaaatttaaaggagtttaattgagcaatgaacaatttgtgaataagttagccctcacaatcacagcagattcagaaagactccagcgtagctacgtggtggaagaagatttagaaacaaacaaaaaaaggaaatgacgtacagaaattaattggaagtgaggtacagaacggctggatcggttacagctcggcatatgccttatttgaacacagtttgaacactcagcggtgtatgaatggttgaagtatggccactgggattggtcaagacttagctattgttacgggtgcatactactaagttagattttcaattttatctgcctattaagctaggttacagttgatccacaaggactcaaatataatcacggagtccttctgaggccatatttagtttgccttaacactgtatagctccacacaggtgcacttggccaggtgtgttttgccaaatcaatgatacattccttttgtctcccacacagtggcttctccgtgaataccttaggaaatgtcccagagctccatcatgggcaggaagtaatcatggagggaacttctcactcttgggagaaagaaatggattgatctatgtgtctcattttttcctcctcctctttccttggatagactatcctgagatggctgtcacttgacttttcaggtggccaccagctgctcttgcaggtgaccaatgtattcttgccatggctaggtcttctctaattcactgccccagccctcttgctgcctgggatggcatgaccaagggaagcactgtcctctaagccactggccctggctctgctctcaggagaaagcaggtgaagatgggcagccctcagcctttgcattctagtctacaatgtatttgagtttgtgttgatgatgttgaactgtacccaagccctgtgatcctggaaacagcaacagttaaagaatttctcccacattttgagttctggaaaatggattactgcaaagaactatccttacccatatgacttagataatactcatgaatgttcccccagtttacataggaaaagaccagacccagaccctccaagtttccattctttgcatcacaattgataactgacgaggtgaacctcttgtccccactaatcaatgggaacaaaatgcttgtgaaccaaacattgggtcagttcttcttctccccaggacctcggactttagctcaccctcaacatacgccaacagaacacccctcctttagggcctcttctgaaaacagcctgctcttggggtaaaccattctctgaactactgtcctataatatcaccctttatccaacttcccctctcctgtttttctctagcctcatttcctcttgcccataaaagaaaaaccctctctgcctaactcttcagacacttgcagacctatagtcagagcattcttgctattgcaataattcatatttcccaattaaaataataggtgaacagtcctcctcaacccttgcaataattatttcaaagaagtcttttcttacttagtccagatttgttttttcattgacactattaatataaaagtaattattctatcccctattccctatgcctccagagacttttttttcctttttcttaagatatggagtctcactcagtcacccacgctggagtgcggagtgcagtggcaccatcatagctcactgcagcctcaacctcctgggctcaagtgaccctctcgcctcagactccagggtagctgggactataggcatgcaccaccacgtgcaactaattcttttttattatttgtagagacaaggtcccaccatgttgctcaggctagtctcaaactcttgggttcaagagatcctcccacttcagcctcccaaagtgctgggatttcaggtgtgagacaccacacctggcctgattatatacttttgaaccatattcataagtaatatttccccccaaaattggaggcctgcatagggttaccagtaaaacaaaaaattaaagggtaccaagtaattactgtaattcatagcataaaggatgtggagggcaaaattgtgtgcttctgcagaaaactgctcgttgtttctatcacacccctactggtattggattctgattctataaagctctgtgccacccatcgtctttgagttattttacaactctgtacgttgcaaatagccaagggtaatgcaaaataattcttgtctctagacatgcaaatttactcctgtggaagtgcaaatgactcccaccacccacaaaaataaaagtctgttttgcctctatttgcacatacatattgatatttttaaacctataaatatgattgttccttggattgttttttaaatgtgttataagaccttcctggtggttcgcacaccaataatgagttaaataacatctttaacactggtttatttttagctatctgagagtcataatttttccttctttggaaattatcctttaaaagatatttttcatggagtggacttagttttaggaaaggaaaaacttcccagggaagaaatattgacaaacttacacctatctattttcccctagatatgtatttgaaattttcatggagaaaacaattacaagataaaactctgttctatgatattgcactcttctatgaagtttgtcagtttcctgaccttctttgctttcttccaatgcaaactggaaatggagcttgaatgtcaagcttgttataaatcttttaaaaaattgataatgcttgtcatccaaacagtttttgtttttgttcttgactctcagtccttccttgctgtaataagaatattctgagaaatgaggcctctggctttcttctctctttcctttaaagaatcttgctatagtttggatgtttgacccctccaaatctcatattgaaatttgatcccgtagtgggaggtgtttgggtcatgggggcagatccttcatgaatgtctgggtgtcatcctcacaataataagtgagttctcactttattagttcctcagaggttgttaaaaagagcctggcacctcctcctctctctcttgcttcctctctctccatgtggtctctgcacatgccagctcccttccccttccatcctgagtggaagcagcctgaagccctcaccagatgcagacgctggtgccatgcttcctgtacagcctgcaaaaccatgaacaaattaatttcttttctctatagattgcccagcctcagctattcttttatagccacactaaacagactaagactaacccagtaagaaatttggcaatggcttgctggatgcaataaggaaaggggtttgcagatagaggaaaaccttgcctgtataaaggacaccagttaggaactgatctgaaggaagtgtcaaaacatgaagagaacacctcaacagtgagcactagcctgtttaatgacatttgggagccatagccttatactcctaacttttactggaggacaagctataattcaatggaggtcttcattttcttctttattccttcctactctgcaacaattactcaagatgattcttgtattgttggtgaagctgtcttttgtatgcaatcgtttgcacatttgtccattgtattaatcagctctcatgctaataatatagacatactcaagactgggtaatttataaagaaaatgaggtttaatggactcacagttccacatggctggggaggcctcacaatcatggcgaaaggcaaaggaagggaaaggcacattttacatggcggcaggcaagagagcatgtgcaggggaactcccccttagaaaaccatcagatcttgtgagacttattcactagcatgagaacagcatgggaaagatctgcccccataattcaagtacttcccaccaggtgcctcccaggacatgtgggtattatgggaggcacaattcaagatgagatttggatggggacacagccaaaccatatcatccattaattggatggttattaccagattaacaacagaatatgtaacacattatttttcaataatgacattcagtgagatcatctttcctttcttcagactgaatgaatgctgtcttctgtgcacttcttctaaatactctaaatgatccattttcccagtaaggaactacaagctaactgtattcattttctaatgcttcgtaacaaatcgctacaaacttggaggcttcaaatgatatatgtttatttccttggagttcccttaagccaagtgtccatgcatggcataggtgggtctttggctggcttttgaaggctgcagtgatcatctcatgtggagcccaggtcttctttccaactcagggctgttggttgaatttattttcttatgttgcagaatgcatgatgactaaagggatctgctgtttcagatctcttgctcctagactttctcttaaaaggctcatcaaattagtgaggtctcccaaatataatctccttaactcaaattcaactgattaggaaacttaatcacaggtacaaaatgacatctacaaaaatccccatagttatgctaaatattataacctagtctctgtcttgacatcaatcacagtgaaaggccctgactatactcaaaggttgggattatacaggacatgtagtctagtgggtgggaatcttagaggctgtgtgataattctgcccctcacacttagcatagaaccagatattctcttataaattctgtgccatgctgtaaaatgacacagcaagtcagttttgtctatgacttaagcaatgtcaattttatttcaaaggtcatctttcttttcaaaagacttaattaacctgcatatacctctaatgagagattttgctggtgtttgagaaatggggtttatgcaagaactgtgttcctctatccattttttaaaaaacttctgctagtagctgatttgatttagactctgaatttcagagtcaggtcagtcatgcagattcaggagagagctaccacataattctcagggttgggaattgtacttgttcaaaatggcaaaataaaagaacatcatgcacagttcagatttattgctgactcttaaccatgcatacagaatgttgagtgaagttcaggcgctaagtaggactcacgacttaggatggaaaccaatagattatagattgtggaacttgagatctagaaaggaccataaacattttttctcaaatatctttattctaagagctgaaagccctgacacattagaggcttcctacaggttgcagaggcagtggattcacacagaagaataacctaggtgtcagagtcccagccccctacatactccaatttgattctgtctactgttgtttgtgggtgacaaccccctacacgctgttgacgtcttgacagccaagaagtgctaagtcacaatgttggaaaccaaagagaaaacataatcctatctgtccgtacaactataatgtatcttcacttgtaattcccagagcacaatgctggccttcgagcctcaggacagacaggaaattaactgaaaaacaactcaaagtgaaaatatcaacagatgcacacaaacttaaaagaacattcagataaaccaattaacatccaaagggttgaggtggaaggaaggtgagtgggaggtatgatgagaataaactgaaaaaggtcagggtctctctgttctagaaaaaaaacgggaaagagaagaatgttggaatgatgattctgttctataaagtcagtccaggttgagcacggtggctcacacctgtaatcccaaaactttgggaggccaaggtgggaggataacttgaacccaggagttccagaccagcctgggcaacatagggatgtcccatctctacaataataataataatactagctgagcatggtggagcatgcttgtggtcccagctactcaggaggctgaggcaggaggattgctggagctccggaggtcgaggctgcagtgcaccatgatctcatgattgcactccagcctgggtgacagagtgaaatcctttgtcaaaaaaatacaaaataaaaaacaaattttaaaattaaaaaatataaagtcagtcctgccctaacatcagctctaggtacatctgattctgcacctgggttcagcttcaggtgaacttgcaacatgatctcttcatggctgtgtttcagcttgtcatggaaattctgagtcactaagcccaaattcctgccccaccttccaccatcttatatcccaggttaataacaaaagtcttgccttgctctccatgtctaaaatcttttcttgccaacctatcgagttctcctgtttcttcaagatttgggccttactttcttcttgttgatttttaccttgaccaaagtctttctaaagcaaactgaaatgtacatcagaagcctctggaggacttgttattaataaaacactgattgcagggccccacctcagagttcctgattcaggaggtctggcatgcaggggtggggttgaagtgagaatttgcaattctatttttgttaagagataggatcttgctctgtcacccaggctggagtgtagtggtgcaatcacagctcactgcagccttgaactcctgggctcgaaggaccctgctacctcagccccctgggtagctgggactactatgcctgcctggagaattcacacttctaacaagcttcctgtagatactgctgcagctggtctgggcaccacactgaatctgaagactaaagtagcaacattatttttttcctatactatctgcttccagcaccaccattgccaaactcaacctatgtggctaaacttcttcaagtgatctacagctggtcaccactatagtcctattatatgccttccccaagtgctgtaaggtaggcattactatccttgttcaacgtggaaactgagcttagacttggagagtaacttgctctttgcacagagattttaaaaggccaagttaggaagccaatccagtatctcctggcttctgtgtcttattatttctcaccatattgctgcaccaaaggttaaccatcttctttctgaaatctggattttgacaaatgctagtttcctttccttcttccatctctttctgatgcttttgaaaggaccagcttataaacagtccatgaggagggaagaacaacatggactgaaggtcaacaatttggaaagcagaaagttcagctgttcctcacctggccaagacatgctgcctgtttttggccggattttcttctccccaccttgtcacgactctaatgctttgttttctgatgtcagtgagcacctgtccttgtgagatggaaaagtgcagttgagagaatgatccaattttgcagctttctctgattggcaaattgagttacacagaggttaattagctttcctaatatctcaagttggccacggtattgaaattagcaaggcggagtgagtaattgacagccctgtgctgtgatggctcaccaattgtcctctatagaagagatcattgacattttccaggttgctcttaaactcattatctgcaaacattaaaatggaccctgtaaacttattatagattttgataaatatattcatttacagaaaatcaacaggcaaaccatctcaagttaattaggtcaatgacagtttagaaccttgaattcatagcagcagtgctctctaaatatgtaagtgcataaacaaaggctggcttgaaatgaggaaaagaatagaaaggaacaatgtgtatctcattgggagggtgttctggaactctgtgaatgaggtaatgcataggccaatgtagcaatccttacccaaactcccgaaccatccactcaaaaatacaaaaaatgaaaaaagaatttcaaactggttgattctcctaaaatgaataagagggaaaaatgaccagagagagaaactgaaaatggtctttttaaacttaattttatccttctggaaactggacctagctggaaaaggtcacacaaaccacatatctcattcaacaaaatgcggcactttgccattttccaatgccctgctgtgggtatttttccccctgaatgaacccaataagttgttcgagcaaaatgtcctatctaagtagggtagcacatctgtttcaatttcctacatttgatctattttagcagtatcctcattgtgtcatgagagctaactgagctatcgaagcctaataaaaatgttacccaactatcttgcattaaaaaactaaaaacttcagaatctatttatcttttggtttaacgtttatcatagcttctctctctccatatacatatagtaatatatacagtaacatatgctatattactataaaatataatttgtataaaatagtatattactatataacatatagtaatatattactgtactactggtaatataatgtatataatatttatatttataaagtagaaatatttatatataattcatatttgtataaaatatttttacatagtgtgtgtatacacagtatatttaacacacactatacatattatatacattatatacatatacactatatatacacacatttaaacatatacactgtattacattacatatgtaatacttacattatatataatacatatataatgtaatataattgatcttattatatatataatgtagatagaaaagagtaagaaaaaagagtgaagttgttttttaatgcaagatatttgggtaatatttttattagactttgatagcacagtggacttctcacatgtatgtgatatttatatatatgtatatgcacacatacatatatatgcacacacacatatatatgtatcttatgtccagtaaagaacatgtttcttgagattagtgtttgtatcacacttaagtttcgtattctatttcttccttttcagaaagtaagacttgatcacaattattttatcctaagcaccttaatacattatttgaaaatcagaggtatttaatagaatttgttgaatgaatgaatgatttaatagccctattgagttattaattgcggtattttcctctgtctccataaacaaagttatctttatatggaaattggtagtttactgaggatttttcaggttttgcaagtactgatttttgggatttgggggtactgaaagtctggcatcctgggagagacccagttttggacagaccaggaatggttagtcaccctgtttggagagattatactttcacttctttttgcattctttattgtcaattcttgctagtgtgttgctccctatgtaacttaatccttccatctttacatgtttccaatttgtcccacttcagaaatgagccatatgtttctctaactgaacaaaagccaccactaatggcccagtgtctaagctatttctccacagcctcctttaaagaactgtgtgttagttaattcaaggaacaaggggaggagaagatagactaccccagtcctcactgacagataaaagtttacattaaagcattaaacagaccgatagttattgggtacctatggggggaaactgcccccgatagtcacataagttcttttctattttccctaagagtcagccagtctgagaaataaagggacagagtactaaagagagaaattttaaagctgggtgtccaggggagataccacatgtcagcaggttccgtgatgccccctgagccgtaaaaccagcaagtttttattagtgattttcaaaaggggagggagtgtacgaatagggtgtgggtcacagagatcacgtgcttcacaaggtaatagaatatcacaaggcaaatggaggcagggcgagataacaggaccacaggacggggcgaaattaaaattgctaatgaagtttcgggcatgcattgtcattgataacatcttatcagcagacagggtttgagagcagacaaccggtctgaccaaaatttattaggcgggaatttcctcgtcctaataagcctgggagcgctatgggagactggggcttatttcatccctacagcttcgaccataaaagacggccgcccccgaagtggccatttcagaggcctaccctcagggatgcattctctttttcagggatgttccttgctgagaaaaagaattcagtgatatttctcccatttgcttttgaaagaagagaaatgtggctctgttccacctggctcaccagcggtcagaatttaaggttatctctcttgttccctgaacattgctgctatcctgttcttttttcaaggtgcccagatttcatattgttcaaacacacatgctctacaatttgtgcagttaacgcaatcatcacagggtcctgaggcagcagatatcctcctcagcttacaaaggtgatggaattaagagattaaagtaaagacaggcataggaaatcacaagggtattgattggggaagtgataagtgtccatgaaatcttcacaatttatgttcagagattgcagtaaagacaggcgtaaaaaaatataaaagtattaatttggggaactaataaatgtccatgaaatcttcacaatttatgttcttctgcgtggcttcagccggcccctccattcggggttcctgacttcccaccacaggtaccctaaggtatttcatcttcctaagtttttttttaatttaatttaaaaaaaatttttttaaatagagacaggatctcactatattgcacaggctggtctcgaactcctggactcaattgatcctactgcctcagcctcccaaagtgttgggattacaggtgggagccaccatgccgcccagccacttttcattttaaacttgtcatgtaacatcctctctgaagatgtacatgcctagtgatagatcctaagaaagattccgtataggtctcctgatgctgttacaaattcccacaaattcaatggcttagaacaacactaacttattattttacagttttggaggtcagaagtcaggagtgggtctcaatgggttagaattgaggtctcagcagggctgtgctcctgctgaaggctctaggggagattttgtctccatgtcttttccagcttctagaggccacttgtgtttcttggtttgtggtcctttcttcaattgtttaaaggcagcagtgtagtgtttcaaattactctttgcttccatcatcacacctttttctcagacccccttaccttcttatagggactctgaggctgaatgcagtggctcatgcctgtaatcccagtgctttgggaggctgacttggagaattccttgagtccaggagttcgagaccagcctggataacacagtaagacccagtctctacaattttttttaattagttgggcatgatggcactcacctgtagtcctagctacttgggaggctgacacaggaggatcacttgattccaagagtttaaggctgaagtgagctgtgatctcaccactgcacttcagcctgggtgacagagcaagactctatttaaacaattttttaaaaagtgtagaggcaaatcctgaccaaggtctaactctgctgtgcatactttacttgatcagatgatgctttgccacccaacaagagtgttggattctgcaatgagcaaaacactgaaccatttggactcagtcttggttaaatgaagggccaggggaatctatggtcagtcaaatagtgcccccccaaaatgtctacatcccaatcctagatggtgtgaacatgtgacataacctggcaaaaaggactatgcagatgtgattaagaatcttgggatatggagataatcctggattatctggtgctgatgtactcacaagagttcttttgttgttgttttgttttgttttgttttttgagacagggtctcactctgtcacccaggctggagtacagttgcacaaccacggctcattgcatcttcaaactcccatgctcaagccatcctcccccctcagcatcccaagtacctgggactacaggcatctgtcaccatactcagctaattttttattttttgcagagatggggtcttgctatgttgcgcaggcttgcttctactcttaaaacagacccatctccttcaaggctcctctatcaaagacaacactcattcttaactgactctttagctcctcaggctaagtcatcagaagaaggaacccactgctttgttgtcccaaatgcctcatcttgctgggtgaacattaaaagaaacatttaccaatgaccaaaacgtgttgtgtaatcaaaagagtgcacacccaaactgagcattttggcatcctttctgatttttgcttagctattttcccagaatgagatgctatttacatatctctaactcatcttaaggcacttttttctgatgttgctaaagaaaagaagaaattcccaaatatcagccaaagactgcaaatattagcatacagctgatattcaactgtttttgacctataaaccaaagtggcaatttcttgtagttcaatctagaaataattcattaactgagaactcactgcatgtttatgttttctttccttattagaatgggaattgaaagagatgagagatggagattttggtttcattgtctgaagtgctttgtattgaattcaggaagtaatggttcattgattcgctgactcactcattctgtgaggatttatggatattcattgtgggtccacaaatgtactgtattgtttggctacaaaacagaaggaagcagtttgtgccttaagggaaaatttgatgtggactggttctagcatgttctagaagaggtggtaaaatcagaaaacttagcacagcatctgtattggtctgttctcacactgctaataaagacgttatctgagactgggtaacttataaaggaaagaggtttaattaactcacggttcagatggctgaggaggcctcaggaaacttgcattcatggcggaaggggaagcaagcatatcctttttcacatggcagcagaaaggagaagtgctgaacaacagggtgaaaaaccccttataaaaccatgagagctcatgagaactcactcactatcatgagaacagcagcatgagggtaaccgtccccatgattcaattatctcccattgggttcctcccaggatacatggggattatgggaattcaagatgagatttgggtggagacacagccaaaccatatcagcaccattcttcactactttgccatttgtgttgtgatgtttttactacagtctcatagtattttaaagagcccatagaacacattgcccagtgtttattcatttttaaaaaatttttagttaaggattggaaggctagtacagcatgaagaagtcaggctggatataaagaagaatgtcctaactataaagcatgctgtccccaaaagaagcaatagacgttcattttccaggaaagggttaatctctacgtgtattctcataaagtacacacaggtgacaatgacatctcaaggtttatttgttgagtcctgtgattctcctccaatgcatcacatttttattcccctgtccctgtggggaaaaataaagatacggaataaagcacttttacaactttcattaactttacacagaaggacgagatcatgtatttggaaggtgaacttgggatttgtaagatgatgagtatatttagtagcatcataaagaataatgacctgctatggaaaatggttaagcaacggcataatgtctccaactctttattttctgggagaaaaaaaaaaagctctaataatgattattatattttataatgggatttagtggttgtctgtgtttagattttctgggattagtgctcggtgccataattgtaatttcttctgattgcagactgctttgcagtctccaaccactcagtttcttctgagcaccagcctctgtgttctttccagtctgatttgaaggcaatgaagcaatctatatttaggcattttgcagaggtttttatttttggctaaatgttaagtatacattttcctgtagtaaatgctgctaacagcaaaggagtaaaatggattttcaggagaaagtatttgaaatctgacttgcctttaatcagtatcatctcatctctgtagcgcaaagccctttaaatgcagataaagaagaaattagaagatggactacatttgctaaagtctatccaaatgccagcaaacatttgatgtggagtacagtaaataacttaaaagattcctccatttagactctaagcagtagaaagtttggtacagatacgggctaccttgggagcacaaacaactcaacatcctaacatactgaatgtctggccctcataggtcaggcatatggaatgcatacttgcctaaatcaaacccctggtcctactttatgtccttattctagttctctcctttccattcttacctgagtttagtgtttggtttgttcatattttactcatttattattcattttctatatttattttatatgtctttctacaccactttttcctttgtggaaaaagatagaggacagatggatggatgagaggatgggtggatagatggatgaattagtggatgagtggtgaatgggtagatgaatggatagattgatgatggatggatgtatgaatggaaagatggatgtatagaagggtgggatagatgaattgatgaagccaaggatgaagtgatgagtgtatagatggacagatggaagtaaacaggtagacacatgtgtggatcgatggatgaacgtatgtaaggttgggatggatgggagaattgatgaagagatggacaaataaataggtagatggatctatagagggaagcaggtagatggatgtgagaataaatggatggaaggaaggatagatggatgaatgaatggatggagagtgggtggatgaatctaggaacagactagtggacgaatggattaatggatggatggatggaagagtgggatggattaattgatgaagagatgacaaataaataggtagatggattgacagaaggaaacaggtagattaatgtgtggatggatggatgcgtggatggatggatgcatggatggatgtatagaagggtgagatggattaactgatgaggagatggtcaaataaatagacagattaatggaaggaagcaggtagatgaatgtgtgaataaatggatggaaggatagaaggatggatggatggatggatggatggatggatggatggagagtgagtggatgaatgcaggaattgatgaatgaatgcatggacagatgtatagaagagtggaatgtaagaatcaatgaagacatgggtgaataaataggtagatggattgacagaggaaacaggtgtggatagatgatggatggatggaaagtgggtggatgaatgtggagatggacgaatgaatgggtgaataaacaagcaagtggagaaatgcctacttacataagtgaatcttttgaataaccatagcattctaccacatgatcatttatttccaggccttctcctcctctctgtcatcatcaacattgccattgctttagtttggttcttcattcctcagctcaaattatttctcttccttcaagtgtctttcctctgagaaacccttctttcttttgccctcctctctctttttcagactttagagactcctttttttctacagccaaatcgtcttgaatataactgtatgatagcacatctcacaccttttgtaatctttcaatctcctttaacaaacagtgagcctctttgagactcttgttttggtattatcttaaaattcctgatgctagacatagtgttctgcgcactgcagtaatagaagcttgcatttatggtgttcctacaatccactgtgtctgttatatatacttctggtatcttgtgtcctttaatcctcctaacagtagtaagaggtaggttctattgtgattctcattttgcagttaagaaagctgaggttcagaggtgttcagcgacttgcctatcacaaagctgataagtggtgggacagaaagaaacaaaggagtctgagtctatagcatgctccttcggcatttttaatggggataatatcttcccaaagggaatgaaaattggttcttggaaggtgaaaaagccattcatgtacgaagctcagagatacagacatacacagataaggagtatatctgttaaatttgcatggggggtgggttaaaaaatgtgtaaaatatttcttagtgggcaatgatgaagaaaggttgaagaacattgagtaacaccatttactctcaagcgctatagcgtacagtctgtcattagaagatgaaaagatggataaatggatgtgcagaagaatacaacttctggtatttgttctggtgcttaagaaatatggtgaacagacactaagatggcactcaaataacctcaatctggtgtgtgaactgccatagtgacttgattcaaacatatagaatatatcaaagatggcaggatgtcacttccacaatgagttacataagacaatggcttctgtctttctagtagagtttcttttgctggctttggctaaaataagctgtcctatagagaggtctacaagacaagaaaatgaggctgacctcttgccaatagccagcaaggaaatgagccattctctccaacaatctgcagggaactgaatcctgccaacattcacgtgaccttggaagaagatcccgccccacgcaagacttcagggaaacccacttgtggtcaacactttgactacagccttgggagaccctgaagcacaagacccatctaagctgcccctggagtcctgacccacagaaactgtcaaataacaaatatgtgttgttcaagctgagaatgtcgcagttatgtgttacacagcaataggtcatgaattcaaggagtttaaaatccttgatttagacccatgagaaaaacccaaggcagctacataaagtgtggattctgtgtgttggtttgctttcacatcacatgagatcaactaaataaagtttagccagacttaaaatttatgtttgcagttgtcttgacttcaaagtgtagggaggtcaccaacttttttactggttgaggggctagaactgtgcaccttaaaatcattgcccagaacagctacaggtaatggttgagctgatttgtttatgcacggatgtgtggcaaactccataataaatgtatttaatgatggttagctagttgcctggcaaggttgatgttttatgtgggtggccagcatcccctgctggactctggtcagcccccgaccagagatttatggatgtacagacagatgactagcagttaccaatggataggaaatagttgattacacactcagtaaatggcaagaggatttcccaaagagaagggctcagtttcactctagagtggaaccagagcaaggggtttgggggcagtggctctgagttttcttgtggttgggagatagggccagggtgaagcatcctgcctgaacatgcattaggatgtgcatggcttaaacttctcccactgctttccaagcgggtagctcccaggctttctcattggcttgtccagctgtgggacaaaaacaaaaggataaggcatagaatttgaaaactatcagtggtcagccattaaaaattgattcaggctgggcactatggctcatgcctgtaatcccagcactttggaagtctgaggcaaaaggatcgcttgaggccaggagatcaagaccagcctgggcaacacagtgagaccatatctctaaaaaaatttttttaattagccaaccatggtggtgcgcgcctgtagtcccagctacttggggggttgaggcaagaggactgctcaagcccagaaggtcaggactgcagggagctatgatcacactactactgcactccagcctgggtgacagagtgagacccagtctctaaataagaaaataatagattcagatcctttattacagttgttacttagagatagagtatattacaatgatcattaagacagagtacatatgatatgaccaatcaggaaaagactaaaatgatcaagtattggtctagcttgactgaggcaggagggtttcacccattctgaaggattcatagcatcacctgatatggtttggctgtatccccacccaaatctcttcttgaattgtagctcccataattctcacatgtcatgggagggacctggtgggaggtaattgagtcatgggggcgggccttggccatgctgttctcatgatagtgaagtctcatgagatctgatggttttataaaggggagatcccctgcacaagttctctcttgtctgctgccatggaatatgtgccttttactcaccttccaccatgattatgaggcttccccagccatgtggaactgtgagtccattaaacctcttttttttttttgttacaaattacccactctcgggtatgtctttatcagcaacatgaaaatggactaatatatcacctttgagatacgaagataaacacaagactagaatggagagaggagttaggacttagagtcccccaacctggatgcagtcatcatcatactatcggtttccaagttctatccttatagataaggtgaacgcatgtcctggtttgcctaggaaagtcttgatgtatacgttgccctcccaatggaattatcaagagtgtttccttttgctccccagaatgtctcagtttggtggatagagtacatgcttttccttctcccctacacatgcataggaactaccataatacacaccagaatctgtgggcttttttccaccattgtggaacttaatatttaagacaaagcaattcaatgttaatcataactaatatcaaaggatggtttaaatgcccactacgaagaactgttttattcatgaagacctgggcacaaagtctcaggtgttcaatctctgaaccgatgctagcttactgtcatacagggctctgtggtctcatgaggctctttcatctttttgtcttcctaaatccagaaaaagagtctgtgaggtagagcaggtattaatatactcaatattgagataaggaaattgaggtttggaagcatagattaatgagtttacgcacatttgtacaaaagagagtttattctaggttgctggaatctataatagtctagtgggctttccattcccacagttagtctgagctgccctgctaacctgtgtatccaatctgggtgtatggaagaaagatagattctacacactagagactggaaacttgtggcacactttgagaaatcttattaatcatttagagaattcataggagaattaactgttagaagatctaataaaaggacagaaaatttgcaatgtgactgccctcctccattacccaccaaagatactcaacgcagagaaagaaatagccttaccttagtttgactgtctccattctgtagccctacataattgctttagaataacattattccctatatccctatggcaacaacaagttctgatgataaaagtcacttgttttgaatttgcttttcaagtctcaatgctaaacttttcagaaatgctacaaccattgaattatcaaagtagaagacagttctcagccaggataagacagaaatttctcttgcaccagttatgtgctttgccgaggaaaaagatgagtcaaagggaaatagagacagtggaaactggaggtgttatctctaatatgtttgctaaccttgttttatataagatttctgaaaatgttctatctcttggtggtgtttcaaaaaggacattgcctgtttcgcattgcatattggatattggacctactgtgttaaacaaaagtcacctacaattttgccagccaaatattctttctatatattttatctcattgttattataattctgaggatcctggaaagttttatgaccacaaaaatagaagaggagtgcttcttctttctttttctttttctttttttgaaacagtgtctcgctgtttcccaggatgatgggtggtggcaccatcagctcactgcagcctcaacctcttggctcccacctcagcctcccaagtagctaggaacacaggcacacgccaccttgcccagctaattttttttttcatagagatgaagtctcagtatctttccccggctgatctcaaactcctgggctcaagcaatcctcccacttcagcttcccaaaatgctgggattacaggccaccgaacctggctgaggcatgcttattagtagctataaatgacacagagccactgtgtggttgaatcagatagccacaccttttattctaatctcttctgacatgggatgtacgtaataaattgcatgtgtcaaacagactaacagttctcccatgaatgtaaactccaagggaaactcagtaggcaacagaaaggagaagtggagctcaataagtttatctgaagctaattgcatgatatactcaagggctggccagctgcaaacgcctgtggagcagctttgagagcatgtgctgaactttaatctttacttacggaaactcccatgattccacaggaattttgcctctgtaaagaccataacatatggtccatttgcagagacatatgtttgagtaatgggccctggagcaaaacattcacaaattcttctcttgctcattttgaaatttctagcatgctgatagtcggtggatagttactctctatctccttggcctctaaaggtagggcatgagtgggtacctttcagatcattgtctctgatgatctgtctccataggaaagaggaaggaaagacaggtcatcaggaactttactcacactgagaatactgttttgctgttaatctgtaaagagcatgaacaactttctcattgccttcggccctagaagatcaaccatctgtcgtatgagaacacatggctactcggtgtaaagtagagtcaaggagattcaggcaaaactattgagtatggaggggctctggcaaagaaagaactcaccctcaccagcaacgtcaacatctggccccaagggggtaccttccctctgctccccaagtagagagtgttgaatgaacatgccattttctactggggatagaagagcccctctgtctctctattagtgatctctgaagatatgtttaattatctctctttgctccaacttcaccaatgctgacgcttcttcagcaacaccaagacagaatacagccaggtacagtggctcaggcctgtaatcccagcactttgggaggccgaggccagaggattgcttgagagcaggagtttgaggccagcctgggcaatatagtaaagaccccctgcccccatctctacaaaacaatttataaaatcagccaggtgtggtagcaagtggctgtagtcccagctactctggagccttagcaggtggaattgcttgagcccaggaaatcaagcagtgagacgtgattgcaccactgcactccagcatgggcaatagagtgagaccctgtctcaaaaagaaacaacaaaaaattaaaattgaaaagacagaatagataagacagatgtctcttaagcttgtcaattccccgtaggggttatgaaccaaaggaggtgaaatggcattgagagagtcagcaacagtacatagggaagccagtgtgcacaccctacctaacacaagaggcttccatactgagggtgactgaattgcagctttttcacagcagggagtctttttttttctcctctgaaaccaaaagtatctatgtagtatccaccacttggatcagtcattggagagactgcacccaacaggatagatgtggctcctgccttcagggaactagaaatgaaaagcatgggttatctacacaattgagcctagtcaaaggaaaactatgggatcttaggagaacacatagaaagaaaattttaccacagtgacagaaattataatgtttttcatgagaaatgggcattctgtagctcttgaaccaccctgcacaacatgatttctgctatgatcagaatgtctgctttcccccaaaattcttatgttgaactctaacccacagggtgatggtgttaggaggtggggccttttggaggtgatgaggtcatgtgatggttaatattgagtgtcaacttgattggattgaaggacgcaaagtattgttcctgggtgtgtctgtgagggtgttgtcaaaggagattaacatttgagccagtggactgggagaggcagacccaccctcaatctgggtgggcaccgtctcatcagctgccagcatggccagaataaaagcaggcggaagaacgtggaaagactagactggtttagtcttctggcctacatctttctcccatgctgggtgcttcctgccctcgaacatcagactccaagttcttcagctttgggactcagactggcttcttcactcctcaacttgcagacggtctattgtgggacctcaccttgtgatcatgtaggtccatattccttagtaaactcccctttatgtatacatctatcctattcgttctgttcccctacagaaccctgactaatacaggttataagggtggagcctcatgaatgggattagtgctcttataaaagggaccccagagagctcccttgcccctttcaccgtgtgaggacacagcaagaagaagcttgtctataaactgggaatgggtcctcaccagacgctgaatctgccacacctagatcttgaacttccagcaactaaaactttaaaaaaaaataagtgtcttgtttataagccacttgatctagggtcgtttctaataggagctcgaatgaactgagatcgtctctttttcacatgctatcttgcaagattaatccattaaatctaccctcacacttacacgactctctgcacttaaggacaaatttgtccactagccatagctactaggaagagaattgtaaagtgttgctctgttttgtgttgtttttaattggggtgggatgagaagaaattatgagagcaacaggcaattttaaagctgtggggtgggcaagcaaagaacgttacaacagaggactggtgagaattaaggaagcagagccggtactgacaacgaattttctgtcttcctagtctgcctaggatgaggacttggctgccacattttagctaacctgccttctggacaaatccccagctgggacctcgcacaatccatcccactctctttattctctcccttgaatcagagcttctccttactagcagggtaaacagaatcttattaaaacatctggctaacgtcaacagcttatctgcatggaaatgcgactgtaaatccatccaccaacaaaatgaatgtgtacaaagtgcaagcagctctccacgccaaaaaaaaaaaaaagaaacaaatttaaaaaatagttcatgggaaacaactgcaagggattgaaaataattttcaagctctacttacagatatttacatcagggcgtgagtgtggtagacaggccatattctatcaactcacctatgcatttatgcaaagaaagtaaacagaactgatattgggagaggtgcctaaactgtggcaccatgtgcgttttccaccttgcatttgtcattttcatgaatcgaggagccctagttttaagactgaagctcttttccttttattgcagctccttgaactccacattttattattattattattattattattactatgacttcctaaatactgtgctttggcactcttcacttacttcctttatccctgtgatagcaatgccagcaacggctgcctactcctcttacaaatcccttgataaaactcacatattacactgagcctcgaaacactgtttgcattgcggctcctatctgctcacttgagtgttttgccaaagtggcgtgctgtcgagaagagtatttactgctggcggtgaggatgtcgtctgcttaagttgggtaaactactcacagagctacactgggagacacacagggatcttccttgcacactacctgttcagagtgaaagggtacagtgtgtggcagatgacaaagacccatcacctccaagttatcagctgcaaggagggtgcttagaaaattgttccctttctctctctctctttctctctctctctctctctctctctttcagtatgaattgagaatgaattgtctctgggtttccttggtcacccattggctggtccagttggaaggggaagcaaagctgaacctcaaaatgatgcacagagagggagatttgccaggtacagtaactgagaagaagaaaacccagcctggactcccctatccaaactctcttttctcccatgctccctgaaggaggatagaggggatgagggaagaatgatcctagagccagatccatagctctgaggttttttcctaaaaggaggttgggatttttgtgggaacaaataaaagaggaaatgctctcctgagagatctgaatctaaagatagaagaagcactaagggtttgtttcggtttgatttgggtttgtttgcttgctttttgaatttaagaaaacaacataggaagcttgaagtttgaaaacattctcctatttttatagttccctgtatttaactctaacataagcaacaacctcaaattattagtaagaacaaatttaatcacacatatagcaacaattcaacaaatactgttaatgattactgactggcaggtaagtaaactgcttacaaagatagccttgctatgcacgatcataattatttgcaaacaccagtttgaccttgacagtgaggagtacaaattatagggttggcactgacctctcatagtcacctgtttctgttgcttatgtggaaggagaatatcttctccaggggtactaggaaccaggcagtttaggtaatgattagcaacaagacaagctatgaatgatccaagtcagagctagaagaaacaacataaacattatatttacatcctgggcaatatagtgagactctgtctctacaaaaacaaaaaaaaaaaaaaaaaaaaaggagacgttagccagaagtagtggtgcgtacctgctgttccagctacttctgaagctgaggcggaaggattgcttgagcccaggaggttaaaggtgcaatgagctgtcattacaccactgcactctagtctgggtgacatagcaagaccctgtctcgaaaaaaaattaaaaataaaaatagacactacatataggaagcaatggtagagtggacaggatggtgatgggcgtaagagaaacctccatctccccctaacagctagacagaagtaatctatgggggtgctgaggatggtattttggctaatgtatagcaattactttccatgcctgtaatggttataacttctactttccagataaagaaatgaagcctcaaaggacatgtaactttttcaaaagatacacagtagccttgctcctagtgtaagttccatgccttcattcctagcctaagtcagaagagagctggcatttcctacagatgactgacttctgctggtttaaggtgttgaccaatttttttttccttatcaagtgattcttggcactttgatttaacaataccttaaccggtaaaacattatccaaagctgtttgaaaatctcgtcataaagcatccagtgaactgccattgtctccagtggcaacaatatctttgaacatcccttgtaatggtgctttaacaaaaacctctgcctcctaaatccttgctggctatttctaacaaaatagccctttctgaggtggtctctcaatatgttttacaaaattgactacaatatttcccccacaatggtggaagttataaagctaaccattgaccttcttattgaaaaatggcattatacatgtcactttggaggtttgaataaatcaacagaaatgcagggatagaactcaggttatagaaaggtgaaggtagtagatttcctgtttttttttttaaaaaaaactaattcatcttttaagaccatttttcagtcttttctcctacatggtttctaatccattgtgaaaattaaggttaattctaagctctatctggtgagataaagagaatgggggacatgggttttttttgtgtgtgtgaacaaccatttcagtaagaactagtctgatgaactaaaagagagagatcagaatgtggccatagagagaactggctcagtccatttagtgatgttcactttagctatgtgcatcagaaaagcgaataccgcatacctgtccagataagtgagtgatcacaggcaaacacacccaaagaacaaccaccaaagtccaaaaattaagcactgcatgcatctccaagcactcatgtatttgttcattctcacaatgctataagtacttatccgacaccaggtaatctataaagcaaagaggcttaatggactcagagttctacagggcttaggaggcctcaggaaacttacaatcatggcagaaagggaagcaagcacatccttcttcacatggcggcagcaacgagaagtgcagtttgaaggggggttaatccccttataaaaccataagattttgtgaaaactcattcactatcatgaggaaagtgtggcgataaccgcccccatgattaaattacctcccactgggtccctcccacgacatatggggattatgggaactacaattcaagatgagatttgggtggggacacagccaaaccaggtcaacccacctccatattcccttccaataattaccactacccagagccaaaataattacattttaataccatagattgggtttctctgtttcaaactctatataaatgaaataatacaatatttattattctaaatgtcttcttttacttaaccttatgtttctgagacgtagccacattgttgtataaactgggtagtttattcattttttacctctatatactattctgctgtatgaagaacacggccttacagagaactgactcagtcgatttactgataaatgtcaacgtcagcattatattggctcttcagagggaaataatcgcattagtcactgtgaatagacacaaatactagcctttcttatttgctttttccctttagtggtcagactaagaaaagagttagtgagtgtcaatgattctattcaactaaccatccaaaaaaatgtaccacattataaacaaacaagcatctccattatggaaatctgatgagagaaaacagatagcatttatatcctccttagcctcttgccccacctagtttcaaatcactgggcacatcaagtttcagaactctccatatgaataggaatgggttgaaaatcaggccacgtgtaaagctgcagtttctggggaaaaaaaaagtgcattgttgtacctttgtagtgctgcctaaagctaaaagggaaaagaatattccattcaggccagaaaggggaagagagggagaaaataaatttcctagaaaactcgtaaaacttctggtttaccttaggtttgaaatgcaagtgagattttatttcctgcaaaaatcagcccttaggtccataaagtatatggggacaggtgattggtttaatcaagtggcattaaaaagttatgtttctgttgatgtgtgacattgaagaaaagtgcacacagcatacctacacaggtaagtgagtgatcacaaggtaaacacacccacagaaccaccaccaaagtcaaaaaatgaagcactgcatgcatctcaaagcacacccccatagtcccttccaataattaccactccccatgccaaaatacttacatcctgggtttgtttgttttcaaactctatataatggaataacacagtatttattattctgtctagcatctttcacttaacattatgtgaatgagacctagtcacattgttgtatagactgggtagttcattcatttttatctctatatactattctgttgtatgacgacacctcaatttatttattcattctactgttgacaaatctttaggtttttttcctgttcttggcttttatgtatagtgattatattaggccattcttgcattgctatgaggaaatattaaaaagtaatttataaagactggataatttgtaaagaaaaatgaaatattaaaaataatttataaacactggtaatttataaagaaaagaggtttaattggctcacagttcttcaggttgtacaggacgcatggtgccggcatctgctcggctgctggggaggcctcaggaaacttacaatcatggcagaaggtgaaggggaagctggcagaagatgaaggggaagctggcatgtcacatggctggagtaacaataaagagagagagaggaggtgctacacacttttaaacagtcaaatctcctaagaactcactcactatcatgagaacaacaccaagaggatggtgctaaaccgtttatgagaagtctgcccccgtaatccagtcacttcccacctggccccttctccaatattaggattacaatttgacatgggatttgagcagggacacagatccaaaccatagcactgatgctatgaacattttgaaccaatcttttggcacacataaacacacatttctatctggtatatactgaggagtggaatctttgaaaaatggtcagcttcttcaagcttcttctatggccagcttttaaagacacagccaaccaattttccaaagcatatgctccctttctggtaactcccaccccccagcaatgtacgtgaagtccgatttttctgtttctttgctaacacttgatgatgtcagtctttctcattttagccatttcggtggtggtgtagatgtctccccccttgtggttttaatgcaaatttctccaacgcttgatgagtttcagtaccattttcatgtgttgtattagaccattcttgcgttgctataaagaaatatctgagactgggtaaagtcactgcatccttgatgtcctgggcttaagcaatcctcccacctctagagtaagtaactaggactacaggcgtgtgccaccacatctagctaatttttgtattctttttgtggaggcaagttctcgctattttgtccaggctggtcttgaaatctggactcaagtgatcctcccacttcagcctcccaaaatgctgggattacaggtgtgagccaccacacctggcttaattaattcctttctctgaagacttttccctctaataaaatacactaatacttttcaaacagaaccagtatcagtcacttataacttagtacaattaagctataaaattcatcttatttatatgatgttaggaatataaacactatgaaacaaaaatttactgtgtacctattaagggaagaaaagcggaccaaaagtcaagttggagaaaataaaagataatttcagcctacttcaataatgggcaaattgctaaatcttgcaatatattactgggtaaaagacattaaatcattcattctatagcagttgaaataatacgagtaagaactattagaataatgaagacagcaacaattcaataagcactgttcactgttaaatactgacaggtgagaattcatcgccttcagaactcatctgactatagctcataactttgcttccacagaggaacaaaaatctcacacaacttttcacactagcatagattgtcatatataaaataagaatggcattataaagtggggtatagaggtaatataggagtaattagttggatttattttaaactgtatgtcttcaccaatttatatgattcttatgaaaaataaatcatgattctatgtaaacttcctgataattttcagtttggacccctattacactacattttcttagcccaattattttcataaatgcttcatttaaataaaatatgattctttaatgaagaaaatctgagtaaactattatatttttatatgaacaaaatgaataagcatcggcaaagaaagcataaattattaattcaaggttacacatacttttcagggctacattcactaatacataaagtctttcaaaaaatatttttattgttctgttaaaaaataaaccctttggttttttgaataattttttgaccagattaaaaattgatcaacttttgctctggaaaataataaaatctgtagcaaggctaaaagattgatttgtggagactgttacaatgaatgtagagatgaaatgagatgttttttctttcttcatctatattcaaatctaccctttatgtgaaagttgagtgaggtccattagtgttatatttacaggtgctggactttatgaattatatacgcctgccaagaatttcccatttagggcttgcatttgcacctggagacttttatctaatttttaaattaagccaaaaatgcatttcactctcaacctcaccagtgaattttttaaaagggatattggcagaggaggaatagcaggggtgatagagattaattcaaatgacagaataggctttaaataaacagaaaatagtaatgtgaggaaatatacaaacaccatcttatttgctgtatcccactctggagaaattccttttttatcaatacatgttgctgtaaaataatcttgcagacttaaatttcacaagacagggagtttttgtgcatccacccaattcaaaattgctttcaagggagctggcatactgagacaattttccaggcaataagttggaatttcccaatttcacctaaaggagaaaatagaaatacttgaaatctattatgtcttgctcaagttggtgatggagtgatctctctgatttacaaagtcccctctctggaaactctagtcgtgccgttctattttttacttcaggaatttttaacccaatgactatttttaagaactatcattggaaatagagaaagacggaaatacatttgggaaaagaacaaggaagggaggcattggcagacatgaagaaaagtgttcacagtttagaaaagattaacaggaatgaggcaaagtccatttctaaggagttaacttccagctgtggccaggaagatcgctgggtgcctgcagaatgccctgcagtgttctgatgaaaaactgtataaggctatcttgtgggagccacataaccatggccatcagggaggagtggtgaataacacgttttttaatgagttttgcggattaaataaatgaaagatgtcagacattttcgtcttcaatcaatcaagtagtctctttcagggaccatgtttagtcctgagagatggaaaagataataattcctagtggtaaaatgagaaggatgtggaatatgacaaagtaagagtagcctaataaaacaatgcatcatacaacacaaaaataattaaaaatagacatgttgttcattcagtaaagagtaattaaatgcttacttgaaacaggtgccttgtatgataggagacacctggaaaacgatcagttaagacctgtatcgctacaagctcattttccttgagtcctgttaaaagagttttctgtaatgttagaagttgaaaaggaaatacagcatttccctccatgtctgagtgcttttctacatatataatgttgccatgaatatttttttcaagtctagactcagttccagtaggtcagttcctggtatgtcacactctcctagagtctccagataatgaaaataatcttttaaaactgaaatgatgaccttgtttctaaaacacctactatatgccaggaaatgtgttacggactttaggtataatctgttttattcatttaaccttcaaaataatcctgcatggtgtggatcatttattgtgtctttacagaaggggaatctgaatggaaaataatttgatatatctaaacttccaagaaagggctgaagaatctgaactcagtccatcttaggcaaaaactgaagctcttttaacttgtctgcctctaatggattcacaatcaggtacccagtgatatgacctggctctgtgttcccacccaaatttcatcttgaattgcattctgaattttaatccccacgtgttgagggagggaccttgtgagaggtgattagatcatgggggcagtttccccatgctcttcttgtgatagtgaatgagttctcatgagatctgatggttttacaagggacttttccccacttcgctctgcacttctccttcctgccaccaagtgaaaaggacatgttttcttccctttccgccatgattataagtttcctgaggcctcccagctcaggggaactgtgagtcgatgaaacctctttcctttataaattacccagcctcggaagttcttcacagcagtgtgagaacagacaaatacaccaaggaagactgaaaacaatttttcttcttcccttttccatttcaacacagccatgacattatattgcaatgatgggagagaaggcatgatttaaaacaatggttctcaagcttaaacatgcatcagaatcagtgagaatgggagtccacaagctttttctgtaaaaacccagataataaatatttctcattttgcagttcatatagtctctatcacagttattcaaccgtgctcttgtagcacgagagcagtcacagataatacaaagtgaatgagtgattgcattccaataaacctttattcacgggcatgaaatctgaatttcatataatttccatgtgttgtgaattattcttcttctttgtaattttccctaatcatttaaaactgtgaaagttattcttagttcagaggcatgaaaaagcaagtggttgttctgctactggaaaggggtccggatccagaccccaagagagggttcttggacctcatgtaagaaagaatttggggtgagtccataaagtgaaaacaagtttttaagaaagtaaaggaataaagaatggatactccataggcagagcagtggcttgagctgctggactgagtatacttatagttatttcttgattatatgctgaacaaggtttggattattcatgagttttccaggaaaggtgtgggcaattcctggaattggaggttcctcccctatttaaaccatatagggtaacttcctgctgttgccgtggcatccgcaaactgtcgtggcgctggtgggggtgtcatttaacatgctaatccattataattagcatataatgagcagtggggatgatcagaggtcacttttgtcaccatcttggttttggtgggttttggcagccttctttactacaacagttcaggtttggcccccaggtgagaaccattcatctacatggtggatgaagaaaacagttcaaaaatgagcttatgggccggttcttcttcaataaagtgctgatgtttctattattttcatattattttcaaatgtgcttgtgctacacgtactttcttctttaatcaaatcagttgccaacatttgaaaatttggatatttacataaaatctgaagttttgggactgttcttgaaaaatgcagagaacaagcaatataaaagctgcattcctgcctggtaatccttgctccactcaggaagagctgatgccccatatgaagagccatggtcttttcctagttggtcattgtattacttcattcttatactgataaaaagaacttacctgagacagggtaattttgaacaaaagagtttaattgactcacagttctgcaggctgagcaggaagcataactggtaggcctcaggaaacttacaataatggcagaggcaaaggaaaagcaagcacgtctcaccatggcacaggaggggagagagcgaagggagtcagtgtgacacaattttaaacaaccagacctcctgagaactcactcactattatgagaacagcaaggcagaaatccacacccatgatccaatcacctcccagcaggtccctcccccaacactggggattacaattcaacatgagatttgggtggggacacagagccaaaccgtatgtcattttcgtcctttatttatctggcctctgtggtttgccttcaccattcctaaagtacactaatagaaaaggaacactctaccttacatcagagaacttattaaataacacatcatttgtgccaggcatggagccatatatcatatagatgtacacagatgaccctagaacaatctaggtttgagctacatgggtctgcttatacaaaattttttttttaataaatatgttggaatttttttttattgagattgtgacaatttttaaaaactcacagataaactgcatggcctagaaatattgaaaaaaataggaaaaaggcatgtcattaattcacaaaatatattcatgtcacgaatgcataaatcacacacatttgttaacacatatgtataacatgtacatatgataaacagttggctaacacatacgtgtgtgtataacataaacagttggttaatacatacatatgtgttaacttatgtatgtgttaaccaacagtttagttataaacatacatgataaacagtcagttaacacatatgtatgtgttatacataaacacataagtatgtgttcatgttatcaggaaggctggccaacaggaggctgtaagtagttaagtttttgggggaagtcagaagttatatgcagattttgaactgtgcagaaggtcagcacccctaacaattgcattgttcatgggtcaattgtatataaatgtattcatttatccattggccagctatgtaggcatagtgtcttagtctgttgttgctgctataacaaaatatcttaggctgggtaatgtataaaaacagaaacttatttcttacagttctggaagctgcgcagtccaaggtcaaggcacctgcatgtggtgtctactgagagccttcttgctgcaccctcttgtgtccggaattggtgggttcttggtctcactgacttcaagaatgaagccgggaccctcgcggtgagtgttacagctcttaaggtggcgcgtctggaatctgttccttctgatgttcggatgtgttaggagtttcttccttctggtgggttcgtggtctcgctggctcaggagtgaagctgcagacctttgcggtgagtgttacagctcttaaggcggcacggctggagttgttcgttcttccctgtgggctcatggtctcgctggcttcaggagtgaagctgcagactttcacggtgagtgttacagctcataaaagcagtgtggacccaaagagtgagcagcagcaagatttattgcaaagagcgaaagaacaacgcttccatggtgtggaaggggacccaagccggttgccactgctggctccagcagcctgcttttattctcttatctggccccacccacatcctgctgattggtagagcccagtggcctgttttgacagggcgctgattggtgcgtttacaatccatgagctagatacaaaggttctccgcgtccccatcagattagttagatacagagtttcgacacacaggttctccaaggccccaccagagcagctagatacagagtgtcgattggtgcactcacaaaccttgagctaaacacagggtgctgactggtgtgtttacaatccctgagctagacataaaggttctccaaggccccaccagagcagctagatacagagtgtcgattggtgcactcacaaaccctgagctagatacagggtgctgattggtgtatttacaatccctgagctacatataaagactctccatgtccccaccagactcaggagcccagctggcttcacccagtggatcccgcaccggggctgcaggtggagctgcctgccagtcccgcgccatgcgctggcactcctcagcccttgggcagtcgatgggactgggcgccgtggagcagggcgtggcgctcatcgggaaggctcgggctgcacaggaacccacggaggcgggggaaggctcaggcatggcgggctgcagtcccgagccctgccccgtgggaaggcagctaaggcccggtgagaaatcgagtgcagcaccagtgggctggcactgctgggggacccagtacaccctccacagccgctggcccgggcgctaagcccctcactgcccggggccggcagggccggccggccgctccaagtgcggggccagccaagcccacgcccacccggaactccagctgacccgcaagcgctgcgcgcagccctggttcccgctcgcgcctctccctccacacctccctgcaagctgagggagtgggctccagccttggccagcccagaaaagggctcccacagtgcagcggcgggccgaagggctcctcaagtgctgccaaagtgggaacccaggcagaggaggcgccgagagcaagtgagggctctgaggactaccagcacgctgtcacctctcactctcatagcaagacagaatacactcactccctcaagccattttataagggtcatggtcccatccgtgacactccaccctcatcacctaaggctccaccccttaatactatcacatgaccaattaaatttcaacatgtgaatttggagggacacatgaagaccctcgtacatttgctacctccatttactaggtacaaaaagagaattacaaggttaaataaattgcctaagattacacagctgacatgtaggaaagacaattgaatgccagatctgtcttactctacattgcatggcctcttctctacatattaagcctctaacctctcaagcacagagcaaaggaaatatctcccacagcaactgctaaatcaaaacatgaaaagttcgctttgtagatgtgcaataaaatatacggcagcaggttgtttaccagaaatgaatatcgaattttatacattttgtatcacttatagtttcatggctttttaaaaatgcagcagtagcgtttcttaaaaaatgcgttcctttgcaaaccttgcataatattttattccccaacacataattgcataccaatcagttttattttttattcttcaacaggcaatatttctttaaaatatctctgatttgggtcttcaaaaaacaagctacgtcttgaataggagaatcagaattgatgttgttaaagactggctatgctatttggaattgccatgggagactggtactgcttcaaaggttatatgtcaaaaccacttcagaaatttataaacttcaggaatactatatatttatggaaaaatcagcatgattaatagttgttttaatctatgtgatgttataaaagtacacgtaacataccctacattgcaatatatatagatgacaaagcaatatatgctaggggaagtttttgtaagtatataagctaatatattttatgaaatataaaataatactgctataatttttatattaaatattgtatttatatatttttatattataattttatatattaatatataaaatatattatatattaaaacttgtgatatatattacaacttgtgatataaattaaaacttattttttaatccatacagtgtcataaaagtgtatctaaagcatgctctttgtagtacatataaatatatataaatataagtatatataaaaatgagtacatatatacatatatacagttactatatatggtataaatatatactgtgtaagtaaatatatatgcatacagtaactatatatgtatatatagcaatgcattgcttaacaatgggactacattctgagaaatgggtcattagatttcatcattgtgcacatcacaatgtccttacataaacccagaaggtgtagttactacacacctagactgtatggtacagcctactgctcctagactgcaaaccttcacagcatattactgtactgaatattgtaggcaattgtaacacaatggtatttatgtatctaaacatatctaaacccagaaaaagtatagtgaaaacatgatattataaccttatggggccacgatcatctatacagtctattgttgactgaaatattatatgttgcatgactgtatatttatatttacatgtatatagacataaaacaaagagtacattttagatttatttttatgacataggaatttaaactgtttatgaagagagtcaaactctgtaaaatatttgaagagatttactctgagccaaatacgagtgacatggcctgtgacacagccttcaggaggacctgagaacatgtgaccaagactgtcggggcacatcttcgttttacgtttcagggagacatgagatatcaatcaagtacatttaagatatacattcctttggtccagaaaggtgagacaactcaaagttgtaggggtgggggatgggaggggtggaggccttccaggttataggtagatttaaaagttttattatgaatagaaaggaaggaatgtctgggttaggataacagattgtggagaacaaagtttcattatgcagatgaagcctccaggtagcaggcttcagagagaatagacggtaaatgtttcttgtcggacttaaggtctcttgatgttaaatgctggtcggctgttcctgaattccacaagggaggaaggcataatgaggtatgtccgaccccccacttccggtcatttaactggaaccagtctttcaggttaaattttggagtgctctggcccagaggaggaagttcatgccatggttggggagagggggcttaattttgatgtaaaccacaattgttcacaattgtttttaacaagtgaatttcgggtaacacatgaagaccctagtacatttgctatctccattttctaggcacaaaaggagaattacaaaggttaaacaaattgcctaaaattacacagctcatatgtaggaaagacaattgaataccagatcacacatatcaggtattcaattttaatctacaatatgcatacaatatataaatatatataatataaatatgtatttgtatctaaatagatattttatattatatatatacgtatatgtgtgtgtatagacatgtatgtatatatatatatttcacacacgtaagacattcttatcagaactcgtattgattatgagaaccatgatccctggatgttactctatgtccagttatttaattaattttcaagagctatatttttccgttctgtgatcgcacagtgtgtgtgtgtgtgtgtttgtgggcgcacgtgcactatttctctggaaccctttcagcggttttcccacaagattcagagttacacagagttggggccgtgggatgttcattgttgcccctccagtattgatcccagcccctaaaatatattctgtactccttgcatgctcagtaaatgcacaataatgtcacccctctaaggcacagccagcagttttgcagctattgtgtgcaatgaacacaccaaaacctgcagaaaagccttttaacccgaaacaactgttatttggattagaaacaaaaagagaaaatcctgtctatgaacactaacactaagattatcatctggaagaaactgaagagctgaattcacatttaatgtattttccagtataatttatatataataagaacattttaatgtgtatgaaacttttctttttattcttttctttcttctttttttttttttttcagtagcttttgcccctttcaagtggagtcctgcctttgaccacattgcgggagctcaatctcttcactgaattgacagatcaaaagacctaggaattttttccagaaatcctggcattgttaactacactccggcctgccatgtttgtctgtgaaagtacaggaaactgctttgaggagatgcaaaaggagataaatgtgagtgacaccgttaacatttaaaataaagggaaatgccagtagagaccaggaatggaaatgattgtctttttctctgctggttaaatgaagaaccctgtccacgctccttctgtgatttaaatgtaatttctcttttatttaatctttggagggattttcgtttgtctacatggaaagcataagttctctcttcagttttcagggctgtagatggacttaggagtggcaataaatgattgcaaatagatgcttagtgggtaaagtcttattagcgcaatggctcagaagtgctgaaaacaaagatttttaaaattcaaacaggccgaagtggagaaaaatatacttaatcaaattcacaatgtctaagtagtacataataatgctatatttttagagaacaaaagcactatctttttaaaaggaaagttaaaacttttgctctgaacacatatataaatactgaaaataactgtcatttaatccaaaccttggttaacataggcccgacattttcctgcatcacgaacccaaagcccttcagtgaaaacgctacattgttttgttttgtttctcttggtgcattgaaacatgctttgcagttttccctgaacatgttcttctgtcagatttgccctgaagtgttcaaccaactcatttcatgcttacccagcgtttcctgtttggataagtattagaagaaactaacacaagtgctcaatttagcatgcaaaaaatcaccttggtaatttgagcctgagatggcaagaacaaagcagttgcctggctgaatttattacatttaaactcattttttatattactttacatttttctttaagactagagaacataggttgtacaattctgattctttagaaaatgttgacacttcttgcatgcctaggacatcgttaatttttctaaaatgtaatatcttaaaaagattgtggatggaaaattcagtgtatatctcatgacgcatccttattaatcgcattgttcaaaatgtaacatctctacttctgaaaccacctttgcaaaattataactgaggaaattttgacactaaaagaaatcacacctaaccgactccatcttgcttctaacctgtaagctgcccttgtttattcctgggcatacgccaaactaactttgggaaggaattcagttcatggtttgattctgaaacaaaattgacaatagccctttcccaaaaagacccccttcttgtctggggaccagtctacctttgtagaactaacaaattagctgtgagattagaaattacagtttagggatcatgcagcctctggctctaagagtctgaacctccccaaattgctcctgggaataacatcactgttgtaaaacctaagatcagtgctctgctccccgaatgctcagggagactgatttgagtaataatagaactccggtctcccacatagccagctctgcgtgaattactctttctccattgcatttccactgtcttgatagatcggctctgtctaggcagtgggcaaggcgaacccattgcatagttgaacttctttatttattattatttgacagtttgatctcttcaatttccaaacttaaattacttatagacaaaatttttcctgaagctttgtcagtcatacttgacagggtttgatgctatattgtttgattccacatgttttcaaatgggcaaactttcttattctataattttcttatctagaatatagcatcttccttgaacctttaattataaattgttcatctaaattctatatagtcagacaataaaattgctaccccaaagcagacatttcttagaaatacagaaagaattaaacataaaagaaaaaaagacatattagactttgtcaaaggtaaattgtttacttatcaaagcttactgttagtaaacagttataaacagtttattataaaaagttataaaaataagccaaagactgagaggaaaatagctgcaatacatatctatgataaaagatttcaatgtagaagatttaagaaactaaaatatcaataataaaaagaaaagcaatccactgaaaaatgagaaaattttagtaaagaaaatagagaaatggccaataaatacaaaaaaagatgctcaacatgattagtcatcagagtatacaaattaaaaccatgaaaacatcacttcccaccaactgcaagaattgaaattttaaaaaatggtagttgcataaattggtactttcccatattgctgatggaaaccagcattttcttataaaaccacacatactgaccctatagtctatacttccatgcttagtattgacccaagataaataatatttttatgtccacaaaaatacttcagcaagaatattcataaaaactttatttctaataaccaaagactgtaaataatgcagaggccatcaacagaagaatggtggtatactcatacaatggaatattactcagcactgaaaatgagcaaaccactgatgtatggaacaatatagaaggtgaaatatggtcctactgggtgcatatgaacttcaaggaaaagagtctaatctatggtgatgaaaatgagaaaacttgatgcctatattgggtggtggagatacactggaagtatccataagggaactttcttatggtcatggaaatgttctacattttatttaaaatgctggttacatgagagtaagcatttatcaaaatgcatcaaattgtacacttaagatttgtgcatttcatagcatgtaaattttaatatatttagacacaaaaaatgtgaaatgtgaggaaaacatataaaataaacttcttatataaaataaaaacgtttctcaaatgcatgaaagctaattatctcattgaagttattaactatctattttaagaataaaggacaaaaatctacttatgttttgtttcaaaatctcttaggtaattaaagggctaaaaaatcaagaacaaaacaagataatcattatcatcattattatttgacatcattttgccattttatcccaaaacaaaatttttctccaaccaggccaggcctagtggctcaaacctgtaatcccagcactttgagaagctgaggcaggaggatcgcctgagcccaggagtttaagaccagcctgagaccccatctctacaaaaaaaaaaaaaaaaaaaaaaaaaaaaaaaaaatcccccatctataaatctattatgattaaaaaaacatgattgacagtgatgaagctgactaacttgtttattcaaaaccaggaatacaaatttatctagaaatttccctccagaccaaaaaaacaaatgcagttttcccattgaagagtgatgattatttttgtttcaggatatcagtgagtcatgcacactataaaagaagtattatcagagtagttttaggttgtagatgtaaaatatggagttatcatttaacctgtgttcccttggactgaatcgtgggactgatggagaaagactgcaaagattccctttatggaatcagcataagcatgttcccctgttcaggattatctacaacttatttcttctgcaccaaaaaggatagcttcagttgggagaaataacaatgagcccctgcaccctcttgacttacataatccaccaaaaacaaactcagccgaaggtacagagagcaagtggaggcaaccttgaataaggaggcttccaggattcaggaggattaacataccagcactcagatcttctttgagttctatgctacttctaagctggttagaaatggtttgcaaattctgtcatttccttggtctacacagttacagaacaaattatgttttatatatgtaaaaagtgtgcacctctttctttttctctgtatctctgttcttttcccctttggagaggggagattttggcctggaaacaaattaaagatacaaagtctaaatggattatttctttgaagttcagttaagcctgagaaagcacttttttccactctaaaaattcaagatacaggtataatacaaacacattgcactggaagttagagaataaaaattgggggttttgtttgcttttatgttttttaactctatttgctattgggtaagttcttgactctgcagacactcatgataataagcctcactgtatttattgagaatcatgttgcaaacattctgaaaatttttttctttttttcttttcttttttttttcgagacggagtctcgctctgtcgcccaggctggagtgcagtggcgcgatctcggctcactgcaagttccgcctcctgtgtttacgccattctcctgcctcagcctcccgagtagctgggactacaggcgcccgccaccgtacagttttttgtatttttagtgagacggagtttcaccgtgttagccaggatggtctccatctcctgacctcgtgatccgcccgcctcggcctcccaaagtgctgggattacaggcgtgagccaccgcgcccggcctgaaaatatttttacatatatggatgtgaaagtatattgtggagagctgaagttttggtattagatagatagatagatagatagatagatagatagatagatgataggatggagagatagatacatgattgatagatagagatgttagatgatagatgaatgatagagataggtgatagagagatagagatacatgattgatagatgatagagataaatgattgatagaaacagatgataagtagatagagatagatattgatagagagatataggtgatagatagctaatagatgatacatagataatagatgatagatatagatgactgatataaatgataagtaatagattatacagatagatagatgatagatagatagatagatagatagatagatagatagtgaaggggattagaatatgctaccccaaatgtgccattttggcataaggattattttttagctgaatgtacctgacaagcaacagatagggaaagaaatctctgctctccctcttaaaatcatgacataaatttcactttttaaagttgatgtaaatttctatttgtaaagggttcccctttcccataagtggtttagtaaggtgtaataaaccttactaaacgattcttaactaccatatatttcctaatcaccttcccacaatttattgtcccaagaagcccaaatcccctccccacctcttttttttttttttttttgtcttgtcatttcttcacaattcatcacctcttgtgaaagtggtagataagccctggggtctaactgcctctttcagtttttgacctcttttctgtgggggtctcatgcacatagaaaaattaacattaataaagaaacatatgcctttttaaatctatattttgtctatttagatcacaggccccagtcacagaaccaacgagatacaagaaaagttttttgccttccttaacattagtatgtagatagatagatagatagatagatagataaatggatagataaatggataggcagaaaaggtagaaacaaaaaaggatggatagatataaggatggatagatggatggatggatggatggatggatgaatggatggatggatggatggttaggcagatagatatgtagagaaaggtgatatgtaaaaagattccaagttctgtcttcaccagagtgttatttagaggactaaataagataatctatatcaatatctattattgtctgctgtataaattttattactatttttcatattctcctacattattatttctgaatgaacatttccacttattgaagcacttccttttttaagcaataaattgtgtgtagtgaatgcagtaaaaaagcactgggaagagaacacatttttaaaactttgaattccccataactcttatcaataaagttgccttctttggggtcttcagtccactctgcttcctacagagtttagattccaatggctattgtctttaagaatactctcagttcaactaatcagccatctccaagaaccctcattgcaagcactgctggggtaaaaacaggcactaaacttatctgtcattactgccatcaatataaaatccaacaggaatgagtccttggagctggcgatgatggctcacgcctgtaatcccaacactttgggaggctaaggcaggcagatctcttgagcttaggagttcaagaccagtcttggcaagaccctgtctctacaaaaaatacaaaaattagccaggcatggtggtgcatacctgtagtcccagctactagggaggctgaggtgggaggatcacatgagcccaggagatcaaagttgcagcaagttatgatcacaccactgcactccagcctgggtgacagagtgagaccctgtcaaaaaaaaaaaaaaaaaaaaaaaatgggggtggggtggggagggaaatgagtccttggaccagatgttaagatatctgggctatagcctgtagttctcttttgggcccaccattgactagcaattactttgggaaaatctctttacattgtttgtatctcagtcttctctataccaaatcttgttaccttgcccccactgctaatggagacagaataaacctcgtgagattaaattacagcatgttatgttttctaaaagcaagagagataaacatcggcctggagatatgtagtggctccctattcttggctgcctgactatgttctatcccaggataccattatgcaccaactctggtaatcccatctcttctgccatgcatggcagaaagacatttacgggatggggctcctgggaaacaggccagtcaactctcctatcaagatgcagatgaggaaggcctggttgctgtcagcaactgcctgtggctatgatgacgctgatgctataaaaggcaatgtgaggggacagctgagttattgaagcaagcttttctgagttctgccctacacctgaatttagtggtttaagtagcgctgtctgtgctttacagcctatcacctctccactcatgtttattattaaagtatcttcacttattggccaggcatggtggctcacacctgtaattccagcactttgagaggcccaggcaggcagatcacttaaggtcaggagtttgagactaacctggccaacatggtgaaacccgtctctactaaaaatacaaaaattaggcaggcgtggtggtgcatgcctgtagtcccagctactcaggaggctgaagcaggagaattgcttgaacccaggaggcagatgttgcagtgagccaagatcgtgccactgcactccagcctgggtgacagagagagactctaactcaaaaaaataaaaataaagtatcttcacttattaatcatctgctgcaggactggaactgaagagtaaaagctatgcacaaagcacagcctctcctctgtgagatcttacaatattttctttctaagtttgtttgttgaaactgcgaactgatcgtcaaaaaagtcactcctttgtaattcaaatatctctccaaagaggtgaattatttttcttctttattcaactgaaaatgtacatgttattttgtgtccaatatagttaactgtcaaaaacctaaggtgattttccaagtatcttttctgaaaatgttttgattcgtgtgcttactttttctttcatctcaagatggacccacaaagaataagatttcaaagtgttaatctgtataaatatctgtggtatattcttaatgaaataaacaaattccaagtataggataatcccatcctttaaacatatgtatcaagtatagaggtataaacttgttatgtgcaagtatctaagtatccagttatataactttgttcttaattgcatagaaaccactgtgctgcaagattatctggcaatgaaattggggactttaaacaaatcacttgattctttttttccatagaagtgaatctaacatttggaatagcttccaccaaattcttatgctgtatccaaaaacacatttaaaaagtactcagagaatgcaattactttttgtctctacaaacagaatataattaacgagataaatgtaatgccagattaatgaatcccaacaattttttattcacctgcgtctttagagaaccattgcttctgtgcctctacgttataactagaaatgaacaacagttacataattgtctcttgttctgtttatctgttttttacattgccagtctctgagatcttctctaaaatcacccaccaaaaaccttcaacagagaaatgagtgctcattagaaatatattgactgcttagctctgatcatgatgcattcaactctacagatgttccaaattccatagagtagatattatggattagtcagaaggggcctgccatttttgtaaataaatataatttttgtgagtaatctaatttgagaacatttgtgcagcaagcttactaaaataaagcatgttccataattaattgacttagatgaagaagtagaaactgtcatgcccatcattccccctcccttaacaaatgctttataaagtcaatcctctaaaaatcactgcaaaaaaagtttctattaatatttacaattggtcacatttgcaaatatattctctctttcatttggatttacagatttatattttatttatttattttggcctgtcacccaggccatcatgagttaccacactctcagtctttggggctcaagtgatcctcctgcctcagctccctgagtagctgggaccacagatgcatgacaccatgtctggccaacttttgaatttttttgtagaggtggggtcccaccatgttgcccaggctggtctcgtactcctgggctcaagcaatcctcctacctccgcctcccagagagctgggattagacatgagccactgtgcctggccccctttgttttaaatagcattagtttatttcttggtggatatgaagactaaccaaatggttttcatttattctgcaattagaattcaaaacacattgcttgtctaaccagtggttctcaacctagagcacatcagaattacctgaggagcttttaaaaatatggctggggtcattcccacattttggaatgctatcactgatgtttcagtttgacttgtttgttgacaaggttgttttcctctctcaataatatggacattcaccctgaaaagatcactacatagcttgcatctgcttgctttcttacttaactagccattcagtaatttagttttctgcttcatttttctgacggttacttcattaagcaatgtatgctcagctattggaaaattattgacaaatacaagatagggagccccagagggtctcactgaacctttcatgtgggaggcagtttgaacctgcagagagaggtttaatctaaaccatgctctgcctatattagcacgtgtgcccttgactatttccaaattagaagcatgtgtgacaactgggttataggatgatgaaggtataaagggaagggtggattagtcaggggtttccagagaggtagaaccaataggatggatggatggagatggagagagagagacagagagagagagaatgatagatgattgatagatagatagatagatacatacatacatacatacatacatacatacatacgacaggtgcagtggctcatgcctgtaatcccagcactttgggaggccaaggcgggtggatcacaaggtcaggagattgagatcatcctggctaacacggtgaaaccccgtctctactaaaaatacaaaaaattagtcgggcgtggtggcgggtgcctgtagtcccagctactcgggaggctgaggtaggagaatggagtgaacccgggaggcagagcttacagtgagccaagatcgcaccacagcactccagactgggcgacaaagcgagactccgtctaaaacaaacaaacaaaaaaacaaagatagataagatacattaaatagatagatgagatggctagagataaacagatgtgatagatagatgaagtagatgagagaaagatagatatatgagagatgaggtacatagatgaaatagattagatagattagagagatagataaatgagatagataagtagacagattagatcagtacataaatagattagacacattaaatagagagatgagatagatagggatagagagatgagatagctgaaatagatgagatcgagacagagatatgagagatgaggtacatagatgaaatagactagataggatagatagatgagataggtagattgataaaatggattagataaattagatagatgatagatgaaatagagatagatgagatagataagacagatgagatagacagatagatagataagataggtaggtacgtatgtagttagatagatgatagataggatagatagaggagatagagagatatatatagagagatgagataggtagattgacaaggtagatgagacagataaatgatagatgaaatagataagatagattagatacatgagagagatgagatacatagatgaaatagacaagatagctacatagatacatgagatagatagatagatagatagatagatagatagatagacagataaatagataggcagaggtagagatgtagaaggggatttattatgggaatgggttcacatgatgaaggaggctgacaagtctcatgagaggccttttccaacctgtagacccacaggaacctacagtgtggctcagttcaagtctgaaagcctcagagcaaagcaagctaatggtgtaattctcagtcccagactgaaggcctgagagaccggtggggcattaatgcaagtcctggggttaaaaagctggagaacctggagttctgaggtccaaaggcagaatcacaagggtgtgccagctctggaagtgagaagaattcacctgtcttctcactgttttccattcagggccgcagccaactggacagtggccacccacactgagggagaatttccaccactcagtccaccaactcctatgccaatctcctctggaaacaccctcacagacacacccgaaaacaatgcttaaccagccatgtaggtgtctcttaattcagtcgacacctaaaattaaccatcacaaaggactttggcttgttctgttatttccttaaattcacttaaatagaattgtgcctctgcaaaagaaattaataaacattcagttagaaagcaccaattactatttcaaggttaaccgtatattcacacatgaaatattggcaaaacaggatgagtgtcttctgcaattccattattttaattgtcagaggaatacaatatcagcatagaaagtttaaaacaaaacaaacaaacaaattcagattacttaaataataaacaaaatgtggtgtatgtacacaatggaatataatacagccttaaaaggggaatgaaattctgatacatactacaacatggatgaacctagaggacatcacaccatgtgaactaagcatcatgccaagttaaacaagccagacacaaaaggacaaatattgtatgattccacttccatgtggtacccaggatagtcaagttcatagaaacaaaaagtagattcgtggttaccaagggctggggaagtgggaaaggagtgatgaggagttattgctgaatagttatggagtttcactttggggaaaagaaaaaagctctggaagtgaatgggagtaccaattgcacaaggggaatgtacttaatgccactgaaccatgcacttttaaaaggttaaatgagccaggctctcacctgtagtcgcaaccattcaggaggctgaggcaggaagatctcttgaggccaggagttcaagactgcagtgagccacgattgtgccactgcactccagtctgggtgatagagagagatccagtccctaaaataagtaaataaataggttaaaatgataaattttatgttatgtatattttaccacaacttctaaaagattaccagagtagacatcagtcatcatatatgataatttcttaaaggatgggtggaattcaatacacaaaagaaaagtgaggtgccgtgaaggtggagaagatcagaatacgacacccaaaatatgccactgtgatgtaaggattattttgagaaaaggcagacacacaatgaggctctctgccctttgccagctgcctaaaagcaaaacaaattttgccttgcttcccttcttcccgaccaggggcaagatggcaccaaaaagaatctaataaacacaccttaccaaatgaccctcatcaaccatcagcatcccctttatattcaccttcccaccatttacagcccctaaaaagtccaaaaacccttgtcctttgttgtgtcacttgtctacaagtgtatcattctttgaatggtataaaagcgttcaagtctaggtgcttcttgggggatgaggagggatcttttctttgtgaagcaccccccaacaccaccaaccaacaatgtaacataaagcttagcatcaagtaaaatatctatgattttctcctgttaatttgtcttttgccagtttgtgttgcaagctcatccacacaacccaagaaagtagaggaaattttttctcccatgcaaagaggaagaaatcctactagagggtccttcactagtaaaaaattctactagaggattccaagcagtgcaccacactcagacctgtggctgggtgcatccttctacagcagtagttcccaacctttatgccaccagagactggttttgtggaagacaatttttccatggactgcagtggggatacaggggcatgatttcaggatgattcaagtgcattatatttattgtacactttatttatattattattacattgtaatatataatgaaatacaacttatcatcatgtataaccagtgggagccctaagcttgctttcctgcaaatagacggtcccatctgggggtgatgggagaaagtgacagatcatcaggcattagattctcataaggagcacacaacctagatcccttggatgtgcagttcacaacagggttcgcactcctatgagactctaatggcatcactgatctgacaggagacagaggtcaggtggtaatgtgagtgatggggagcggctgtaaatgcacaggaaacttccctcactagcccgccactcatctcctgctgtgcagcccggttcctaacaggccacagacccgtcagtggctggggcttgggcatccctgctttagagcacaggatggattgcaacagagtaacaagaaacatggttggaaacacaatttaatggcagcctatgaagttggcactttcttttataaccttgtagcaactgtggagaagcacctatcatcataatccatattattttccacggttgagccctgtttcacaatgtcactgttaattttcgacgaagctcctttaaagcaagaaacttgggtgggatttcctgcaatcctggctggattacccagaaaatgcacttcccaccctaaccccctcaaaaaacaagttgaattcttaaaatacttttagtaactcaaaacaaggaccaaccaaggagagatgccctaaagaaagaatagcctgtctgtttccacattcctgaatgggggagtcatctttttgtcaccctcatagaaagaattcttctgaaatgccaacagcctctggtagcatttgggaagcaaggatgccccaagcagtgtgagaagggctgtgttgagagaattttccaaaataagacttgtctctctgccagggtagaaaaagcctctgcagcccgaggtaggacacttggtgtctcccttttgcttccttaatctataaaccatggcccatggctgtcaggtagctccaaagaaatgctgaggagattaatgagattgtatctgtggaatccttggggcctctgggaaaatgtactgcatacaaaattagctgcattttgacattagcctgtatgctaataccgctcacatcaactagattatttagcaatgacagaaaatgtaactccttctcctggttctttatcatttcatcaaatgaaaatgacctttgcaaataaataatgtatcggtttctttggctgccgttgttttcatcatggtccatttattgccaggatctccatgaccaaggtcccaagacaaccctctgaggatgaatagcatcaaggaacaagctctggctgaggtcccagaaatcctcgtttctccgagaagaactgtcccttaaacgtctaaaggtatgaccagcctaatgctgtcttcctgccacaccctctaaactgtgctgcaattagtggtagtgactaatctactcagttttaaacacagcagagacctcaaggcaagagctaccctagatgaagccacctgtgctcacaggtatatatattgaacacacttctaagcaagacagtgcatgtagagtttgttctctgaaaacactgaacagatgagcatggctcagggaattggaagatctgaaaaagagcacatcactccaaggctttacggtaaagctgctagaatcatcctcttagaagatttagattaggaaatgtcactccccccacttcaaatccccattgagattgcattgcctgtgaaataaaacccaaggtatttagcatagcacacaggatcttccagggtctggtctctcacttgctgtttaatcttacctcccaacacgtggtgttattgtgccctgtgctctgatcacacttctgtttaattcatgattctcttgataaatcacacactctcaggcccttatacccatcctccagtcccaaatgtccttccactccactccccttctatcttcaagtccacttatccgttaaagtccagcttttagtccatctgctttggaaaatctttcttgatctcccagacaaaaggaatccctcactcaacaatggtgcctccatcacccgaagcgtttatcactgggtttagtacgagagtcattgacagtctctgaattcaaagtgacattggtgagaagtctcagccccctccttccttggacattcgacaaaagttgcttgagtggaattgagtatttctgactgatgttcttaaaatgatgtaattttatgctcagactatagggtgatgtatttccatcatctgttggacaattcgcttttaagtcagggacttagatacattttatttgtaaagtttccttattttctcaaacctaaggcacaaccagagaaactggacgttttaaaaactaaatttgggccaggtgtggtggctcacacctgtgatcccagcactttgggaggccaaggcaagtggatcacttgaagtcaggagttcgagaccagcctggccaacatagtgaaaccctatctctactaaaaatgcaaaaattagccgggcgtggtggtgggcacctgtaatctcagctactcacaaggttgaagcaggacaatcacttgaacccgggaggtggaggctgcagtgagccgagatagtgccactgcactccagcctgggcgatagagcaagaacctgtccaaaaacaacaacaacaaaacaaacaaacaaaaacaaacaaatgaaagctgaatttgggagcctagcacactctaagcacaaaatgttctaatcactcccaatcttcagtccacactaatgatataatcgtccatatcatctgaccaattcaagacagactcagctgcagctggaagcaggtaacacctcgaaacagggcagttgactttgacccatgcattaaaccactgcttggcaatgcagtgtaaactataaaactgtagctaagttgaagacctcgccacccttccactccattcccagagttaaatagaggtgagtcttgaaagcaagcctcactcactcttcatggactgcattgctgtgacctctcaggactcacatcccctaagtcagccgcctgttcccatcagtctagacccagcagaaatggttggcgtcaaatgttcaaggagcaacactttggcagtgtcattattattaaatgcaactaaatgaactattaacaccatctgttcattgtggtggatgtcagacgtgccattccaaatagtgcaggagctgctgacgctggatttcgcagaataaaatcaccttctgctcactcgaccaaacagtaggagcacataactgtgtgccaaaggtctggggtttttctgtgtgtttgtttcatttataattatttttgattatccaatttcctccgaagccaataagaaacactgtgtacgtcccagttttcctccatagctggaggttgtgacacacccaaagcctcattgttgtaaatctcttcaaagtacacagctcatcaattgaagactgggttccatggagaaaggggggaaaagtgtggagctgcactgatcacgtatgtaaattccgttttgtggaaatgtcccaactggaaggaaatatcactgagaatgtcagggacaagagaaaacatccccttccccctctgaagtttcactgaaaatcactgacaagaggcagattaataggagaaatggcgcaaacatttattttataacatttttatgtgacatgggagccttcagactgaagacccaaagatacgagggaaactgtgcattgttatgcttaggttcaagcaggtatgaacaaaatccatgtagaaatagcatcggaggaaaagggcctgatctaaagcaaatggactgagggtggaaaccccgccaggcctgtctgtgtagattcttcttgcttctctctctgagcagcgctccttccttccgggtgtgctgcgagaccctctctggaatgcgggtcttaggatctacagtcaaaccaggtagatcagaggatttctttacggccagttttgacactgagaggtgatggagggtaagttagagtcctattttaggttttatgtctggctttggggcaaaaggggctctggtttctatgaaccaccttggggaggagaaattctagtttttatgaggcctggagggagaatgggactgacagacaggagggcaggagaaggtgaggaagaaacttttccttccgaggcttcttctgaggccttcgttttggggtagtgttctctgagcacaacattagctaaggaagagatttaggctttgtctccttagtaaattctggtccacgtggggctgcacaaagccttcattgtgtccaattcaccgcagcttatgggaccttccctgctgtgctctcaaagccaggaagcactgcttctccactgtgtccagctcacagggcctgggtgcctcaggcacagccaatattctgcttttacatttgatcacctatagtcgcatcctcagactgtcaatctacagcatgtgcagcattcaatgtttctttcctggagtcagcatactcgggctctctggctggagttgactcatctctaaactgctctccacatccacaaaataactgcatgccacctattggtgcagggctagggaaccaaaggatgcaatgccctcaaggagccacattttattttattttaatatttatctatttatttattttgtgtgtgtgtgtgacagaatctcactctgtcgcccaggctgtagtgcagtggcgtaatgtcagctcactgcaacctctgcctgcgaggttcaagcaattctctagcctcagcctctggagcagctggaattacaggcatgtgccaccatgcctggctaatttttgtatttgtagtagagacgggtttttgccatgttggccagaatgtctccaactccggacctcaagtgatctgcccgcctcagtctcccaaaatgctgggattgcaggcatgagccaccacgcccagcctatgagccaaattctagtgggaattttggaaacagtgctttggaatatacaaatcatgagagcttaaagtcgggcaatgataaggagctcctcatctctctaggcaacaggcagtaagatgaagcggttcaatgattttggctagaagaacaagggtcctgcaccttcaccatgttcatcttggggattctggggagccatatactgtggaagcagccctcacaggatcaggactccaaaactcaagaaagtcaaaagccccatgctactaagtcttccctgggtccttgcaattctgcataagaaacaccaaaaggggcgggcacagtggctcatgcctgtaatcccagcactttaggaggctgaggcgggtggatcacttgaggccaggagttccagaccagcctggccaacatggtgtgaccctgtctctactaaatacacaaaaattacctgggcatgatggcgtgccctgtggccccagccactcgggaggctgaggcaggagaattgcttgaacccaggaagtggaagtttcggtgagccaagatcgtgccactgcactccagcttgggtgacaaagccagactgtctcaaaaaaacaaacaaaaagaaacaccaaaaggcttaatgttggggctcagaaaacaattcctggctcctcctcctctgagcctggaatcctgtcttttcatcttcacatcccccacaatttgcacaatggcaagtccatggagattcacaacttaatggaaaggatcactaattatttaactttgtttttttccatttgaagcacagtgtctagaaacaagatgccatttccaaaactttacatttatttacagatagtccttgtcttatgagggtttgagttacaatttttggacattatgacggtgcaacagtgatatgcattgagtagaactcatactttgagtactcatacaatttttttttcactttcagtataatactgaaataaatttcatgagatattcaacactgtattataaaataggctttgtgttagatgatttagcccaagcataggctaatgtatgtgttctgaacatgtttaaggcaggctgggcaaagatatgatatttgataggtgacgtgtattaaatacattttcaacttactatatttattatgggcttatcgggatgtaaccccatcgtaagtggaggaacatctatgtatctcccaggagaggccacagtgagcatttttctgttgggatatacctttctttcttggctgacacaaccaggccagggcatagggtgtggtctgggagcccgggaagggactgtcgggcactgtggatccatagattgaagccgtctccagatggaaaagtgaagagcacagcttaagagggaacaggtcccattttaaactaataatgttaacaacagagtctccaatggtttagaattattattattattattactacgaagaaagggtcttgctctgtcacccaggatcgagtgcaatgattttaccttactgcagtctcaacctcctgtgctcaagcgatcctctcacctagcttctcgagtaactgggactccaggcgcacaccaccatacccggctaatttttgtattttttgaagaaacagggttttactatgttgcccaggctagtctccaactccttgattcaagtgatcatctcatctcagcctcccaaagtgctgggattacaggtgtgagccatcatacccagcctcaactgatttattcattttacatgaaccatagtatgtatttattacagaaaatgcaaaagtttaggtcattcatctagattcaaccatcaagaaataatcattggaaaattgaggtagggagataaatcaatagctagatgatagatagctacatggataaataggtgatgagtggatagatagacagctagaaaggtagataacaaggtatgacagatacacacaaacgacggaggatacacatgtgtgtaaatgaaaggatagatgcatagatagatcagtctatatgtcttttgatgtatagatagatatgatagatgatgatagataaatggagatgatagatgatatatagatatgatagatagatacaatagctagatggagatgatagatagatatgatagatagatacatagatacgtagataaatggagatgatagaatgatagataaatggagatgattgatagatgtgataaatagagatgacagataaatggagatgatagatgattgatgatagatagatagatataggtagagatatagatgtatatatatagataaagatgtgtcttgtctattggatatattttgttgactcatgtattgcaagtgattcttcaaaccaaccttcatttattcctcctttaacacatcattgtcaccactcagaacttatgtgtcctaaattgactgcctgttccagttaatctagacccaataggatatgtatatatattctgcaggagatagatatagatatgtgtgtgtatgtgtgtgtgtatatatatatatgtgtgtgtgtgtgtgtgtgtgtacatattttataaggacatacatccttataaatcaaaatgtatatatacacataaaatgtaaaggaacataaatatgtatacacacatatttttataaaaatattttttaccaaaaggtagttcatattgatcatgttttattttaattttataaactgacatccttgacccatattattttttcatttaatgatagatcatgatcatttttccatcccaataaatatttgtacatcattttgtggcccccgcagcattccattgtgtggctatgcttttattatttaatcatccatgctctggatacttcttagttttgctaaatggccttaatctaataaaattgtgcacctgatctcacccccaaaatggtgtcaagtaacaggtaaagattttctccctgagagaaaaagatgcatagaagaaatgcaacattcagtagttagactaagctcagacactgtcaagtcatggctaatgatacatgccggtatattaccttactcatggaatgtattcaataaatgatgccttaatcagtgaaactatgtaattgcagataactagactttttttaaaagggctaaacaagcaaacatttgtaagaggctgaataaatagctctccttcacaacatgagttttgcatcagttgaggtagacagaggactcaggacgaagtgagttcaaaatgttggtattatcactggtgaattgaatactggaggccatgattaggtacgtagcagccctggggttccctggatagagatccagaagtgggcaggcttaccctcagaactgcaagaagcacagaaccacccactgccctatcttgcatggctaatagcagatctgaagtggggtgtgggagaagccaggctgagctgccaaaggcagggaacccaggtgagaggccaggggtagggaccagggaaatatcttccaacagaaacccaaggcatgtcagagaagggctcccacgaaactagatcatgttcttgattctatctaatatctattaatcaccaaaataaaagaaaggcttagaggttcttccaaaatgataaatacatacttgtgagcctaaatgaatatgttagctaaaaaaaaaaaaaaggtctccaattcgcttacatagctgtcttccccatttttgagaagatgctgattatttcagtgggaagcattatatgtaagctggtggaatggctctgggctgaacttacccagaatggtaaatcatcatcttacttgtgaagataatgtgtcagcagaattcatatctgtgctgattatttactttaatgctgataaaaagtgaaatgaactgcttgaagaaaaaatattcatggtagacagcagcgtgcagaggctggtactgacagctacaacgaatggcttggtggaccctgatagtaaatgcaattactatccaactctgtaattagacactctgaaaagaataaatatgcatgtcgaaaggaaagtccagaagcagataaactgagacgtgaaccatgtgctgatgggattacacatgatctttgttcccttctttaccaagtctctgaatttctgaaatttgcttttcctttaaatatatttctatgtatgtatgtatttttttttttgagacaaggtcttgctctgttgcccaggctggagtgcagtggcacaatcacagctcactgcaacctcaaactcctgggtccaagtgacccctgtgcctcagccttctgaataactgagagtagaggaagacatcaccatgcctagctattttttcaaaatttttgcagagctggagtcttgctatgttgtccaggctggtcttgaacttctggtctcaagtgatcctcccacttcagcctcccgagtagctgggaccacaggcacaaacaaccatgcccagctaattttttaattttttgtagagacagggtcttgtcatgttgcccaggcgtgtcttgaactcctggcctcaagtaatccttctaccttggcctcccaaagtgctgggaccatgggcatgagccactgtgcctggccagaatatattaaatcttataatcagaggaagtatatgttacttccagaagaagagtgactgattcatcctcaccttcggtaggagagaatgcaagtactgtgctattggctcatttttaaccatttttaggactcccatcttggctttaatatgcttccacctttgatggctagcacctggggcactttttcagaatgatacccttgggttgctggagcgattgcccctttatgcacagagagctgtaagtgtctgggattttgtatctccctttcactagtggctggcagctatggggcatcaaagcttgctgctctgggttggaacaatactgagtgtattgacaggatgaggctcctctctgctgtcagtacccgatacctggcctcacatctattcttggtttcttttccttctgtcctccttcctgcacttcctaccagactcctcctggaagcactttgtggtgaacacctgtggtccctgccctcttgtgctcacagcctacataatcctctccccttcagcagggacgagacctgtgacttgtttctggccaacagaacatggccacagcaaagaacttttgcagatgtcagtaaggttccaaattagttgactttgagttctctaaaaggggaattatcttcggtggatttgacttgattaggtgaggagcagtaaaaggcagatatggccttccctgaggtcaaagattttctctctaattaatttacattttcaccaacagcataaaatcattccctcttctctgcatcctcaccaacatctattgtttttcgactttttagtaatagccattctgactgatgtgagatggtatctcattgtggttttaatttgcatttctctgatatgattagtgatgttgagcattttttttacatgtttattggtcatttgtatgtcttcttttgacaaacgtcttttcatgtcttctgtctactttttaattttttttttcttgttgagttatttgagtttcttgtagattctggatattagcactgtgtcagatatatagttttgcaaatattttctcccgccttgtaggctgtgtggtcaccctgttgattttatggaaaacaatatggagatttctcagagaactaaaattaaaactaccattcgatccaacaatcctgctacagggtatatacccaaaggaataaaaataattgcatcaaaaagatgcttgcactcgtatgttcattgcgcactattcacaatagcaaagatatggaaccaacttaagtgtccatcaacagaggactgaataaagaaaatctggtatacatattccatggaatatttactacttagccatcaaaaagaatgaaattatgtattttgcagcaagatagatggaactgggggccattacctttagtgaaacaattcagaaacagaaagtcaaatattgcacaatgtcacttataagtgggagctaaataatgcgtacacttggacataaagagtggaataatagacactggagaccaggaaaggtggaagggtgggaggagagtgagggataagaaattacttaatgggtacaatgtacactattcaagcaatggctacactaaaagtccagacttctccatggaatttatccatgtaaaaaaactgcacttgtaccctgtaaacctataaaaactttaaaaatcaaaaaatgccttaaaaaacaaagactttctccctatttctggactagaagagacaaactcccatgctgtgagggggcttatgaagatagctacagggcaaagaacaaaccgtaggtggtttcttggagctgagagcaaccgctagctgacagccaaaagggaagtttcagtgctacagctgcaaggagatgaattctgccaacaacttgcagaagcacgagaggagatcttccccgagagaggcctgtgtggggacctcgaccctgactgacacctggattggagcctgtgagaccttgaagaagggaaaccagctctcttgcttgctgaggctgccatgacaaactaccacagacggggtgacttaaacaacagaaatttattctcttatgctctggaggctggaagtccaagatcaaggtgtgggcaaggctggttcctcctgagtcttctctccttggcttgtagacgctgtcttctccctgtgtcctcacacaagtctgtgtcccaaactcctcttcttatgaggacaccagattggattaggtcccaccttacaaactcatttgaacctaattacctctttaaggtccaaggcctcatctccaaatacagtcacattgcggggtagggcttcaacatatgaattttggggaaacacagctcagtccatagaaacatctaagctatgcctagggattcctgattcacagaaactgtgagatagcaaatgtatgttgttttaagttgctactttgcagtaacttgttatgcagcaattgaaaatcaatgaaacctgcttcaaatgaggtgaaggtgttaagattggtggatatccctgtcaatcatttctgccccagaggaggttacaaaagaacctagaacatctcactgccctgtcccattgatctgtatgtccacctctccaaaagtccagattttctgggagaaagaaatatgcttagcaaatcactagtgcatgagttgtctagtgtattaggtgcacgcccaatccacagtcaataattttctcaattaatattctttaagatgaattttgaagtggatgtttcacaacatggtaagcttcaaataagtcacattgataaactggcacagccactatggatgacagtacagaggttcctcaaaaagttaaaaatagaactatctgatgatccagcaatcccacttttgcatatatatccgagggaaacaagatcagcgtctcaaagagatatctgcaccctcatgttattgccacattattcacaatagccaagatatggaaccaacctaaacatccaccaatagatgaatagataaagaaaatgtttatacatacatatatacatttattcatatatatatatacgtgtgtatatatatgtgtgtatatatatgtgtatatatatgtgtgtatatacatatgtgtatatatatgtgtgtatatatatatgtgtatatatgtgtgtatatatgtatgtgtgtgtgtgtgtatatatatatatatatatatatatatatacacacacacacataaatatgaatagtatttggccattaatcagaagtaatttctgccatttgggacaatgtgaatgaacctggagggcattatgttaagcaaattaagccagacagagaaagacaaataccatatgatctcacttagatttggaatctaaagaagttgaattcccagaagcagagagtagaaaggtggttacgaggggctggggagtgggggacactggagagatgttggtcaaagggtacaaagtttcagttataaataagttctggggatgcaatctacagcatggtgactatagttaccaataccgtattgtttacttgaaattttttaagagagtggatctcaaatattcacactatccccaaataataataataataataataataactatgcacagtgatagataagttatttacctagtgcatagtaaaagtttcataacgtgctcgtttatcaaaacctcacacggtacacagtaagtatattccatttttacttgccgattatacctcaataaaggtgggggaataaaagaattcatatctctattctatggccctgtgttctctgattccctcagtgtctgtttctggaatccaaccaaagagactttcccttgcccatcagaagaaaaacatgctggggaaaatgtcacaagaacgaactgtttaggtacagctttgtgtcacactttgaggtacattattatttcatgatatcctgggtcaaattccttttcattagtttaaatttactttctttatttaattttatttttgaaagaaaagatgcaaatatcccatatgacctttaactacagtcctcaggtaagtgacagcaacaactgagagattttcttcaggctgataaatttaacatgatttaatgaaaaaaatgaagaaaaacacaagttaggcttgcaaagtttctgtgagaaatcctcctttagaaattacgccagcttttcatggaaagcaattgcaacacagcagaaagcaatctgctcatgcaacccatcccaagtgaggtgaaggtgttatgactgatagacatccctgccaaccatttctgtcctaaaagaggttataggagagcccagaatatctctcttacctttgcaattgacttcactcatctacttctccaaaggtttagatttgcccagaaaagaatgaaaaggaagaagtctcgccaaagctgagggctgaaaaccatgttggtaatctccaaatgttgtggttctaaaagaacagagggcaatggaaaaatacaaaacatttcagatataaagttatctaaaatatacttactataggacataaaagcccattatgaggagaaataactttatgtgttataggacataacagaagatgtaacaaatggataggtgcgtgatgttcactaaagggaaggttcaatatctttaagatgtttgtcatccttaaattaagctctatattccatggaaatcacctatcaaatcacaatacagcatatccttaaactggacaagttgattcttatttcatatggaatgtaagtggccaagaatcgctaataatatattgaagaatactaataaagatggggaaatctcctagtaaatatcaagacattagaaagattggtggaacactggatagactacacttagcagaataaggagacaggaaatagaggaatatataaaaagacattgacaatatggcagaaatttggtgtacaacggtgggaaaggaacaggctagtcaacaagcaattgtgtgtagaaatggggggagagggtggcagatcccttcatcgcactaccaaaaaaaaaaagaattaaaaatctggtggattaaaaatctaaatttgtgctgggcatggtggctcacgcctgtaattctagcacttttggaggccaaggcgggtggaccacttgaggtcagcagttcaagaccagcctggcaacatgatgaaaccccatttctactaaaaatacaaaaaatagccagaggtggtggcacgcgcctgtaatcccaggtactaaggaggctgaggcacaagaatcacttgaacccgggaggcagaggttacagtgaaccaagattacaccactgaactccagcctgggccacagagtgagactgtctcaaaaaaaaaaaaatctaaatttaaaagaaaaatgcccaaacaactagaagaaagtatattaaaatatttttatgatcttggactggagaaagtttcctgaagatactaaatgcataaattttaaaggagaatattggagtaccaaactgcaagaaagtcaaaagtttctgtataaaagaagacattggaaactacgctaaaagataagccatagacgaacagaggtttaaaaggaatcaaaccctaaatggattatttcctactcccgcaagaactcctgcaaatcaataaggaaacagaagacttagaaccaagtgatcaagtaatataagaaggtgattcagagtaaaggagattgaacaactaaaaatatgaaaatttgttcaaaccctaaaaattaagaaagtatgcctttaaacaacatttgataccaattagaatggttaaaagaattacaagataggatagcaccaagtgttttcaagatagtggaaaatgaaatttttcacactcttgataattctgtaaatctgttaaattattttggaaatacctagtaaagttgcaaatgtacctcattgtgatattacaaactagcaatttcatacacacaaacaaaaaaagctcataaataaccaacaatacacaaagtattgtttgcagttaaaataaaaaccacaataaccttaatgtcagggcatatgtacaacagtgaaaaataaatgaatagatgtacatatgtgaacctggatacatctcaaaaagtatacatgacagcctgggcaacacagtgagacctccatctctctaaaaacgaacaaaaaacaataaaaaaaaaaaaaattagccaggcatggtggcacatgcctgtattcccagttactcaggaggcagaggttggaggattgtttgagcccaggaggttgaggttgcaataaactatgaccgtgtcactgcagtccatcctgggtgacagagagaggctctgtcaaaaaaaaaaaaaaaaaaaaaaaaaaagagaagaaaaaaacaagtggcataaatatatagtttgatattatttatgcatttttgttaaaaagagaaagctatactacagattgtttttagagatgtatgcatattacataaaaatgtgattggctcaggagactaaggcaagaggagagaagatcacttgagcccaggagttcgagtccatcttgggcaacctaacaaaaccccaccaaaaaaacaaaacaaaacaaaacaaaacaaaacaaaacaaaacaaaaaaacgcctgattgatttggaaagatagattctccactacttgacactacttgaggacagtgggtatttctagggaagatgaaaaagtaaaatgtaagtgtggcttcaactgtatatattatattttatttctggggaaaattgaagcttcagtaaatacggcaaaaatgttagtatttgttaaacatgagtgttggatttatgaatgttccccatattactcaaaaagatttttttttaatttaagaagctcagttgattgggttcagcaaaatatgtcgatggcagatttaattcaaaattggaaagaaatctgttactgttttattccaagattagccttattttatcttgcattttaatcttttccccttacattttatttccgttaaacggcactgcctaaaatataacaattccaaataaaagcaacctcacgtataatgtaatttaatgtgcaataatgtcaaaagtcacatcccatggcagagatggaaaaaagcacaatttcagaatttcttacaaaaacatgttgcctgagttacaatatctcaaacaataaagtgaataaattcaaaccctgaaaggtcaaggaataataaaaccatctcattatgcatttactaaaatgagcaaacttatacttcataaaacttatgaattgctgctgtttgcaactgtatgctgtacagttttcatttctcttttctattcttcatgacattttcatgatatttggaaagaaaaatacaaaaacatgaattagaaaccactcattctctctccaaaaaaaaaaaaaaaaaaaaaggaaggaggaaagggtgggggaaccaacaaaagtaggaaaatcctgctagcatatgttcattgcaaggttaagtgaaatttgtgatttcaggacttatcttaaatgagctccatttgatctcccagtttttatattttaataatttgtgcattaagcagtgttctaaattaaagtaagaactgctcttgtatgcaggattgtttaaccagatggctttttgatctcactcggttaaatcttggagaaatatttgtaagagtgagggttcccaccccccatccaccatgagctgcggagaaactgcagcttatcaatatgggttgaaggagttagaagaccttttcacaagtctcttctaatcaacccaaccctgcagtctggcagcatggagcactcttaataccaggtacttgaaagaaaaagaaggagttctttttaaataaacaaactggcaatggaacaagaggcaactgctaaccgtcctttcccctaattttcatcacatgcccatggtctgtaaacgcttcctcttgggtcgagcacggttggtccccaatgacatggccatggatggtgatagaactggcacaggtgtgtttcctccccaaggatgccaccaggggagggcagagagaatggaactgattctcagaatatcatccctacaggatggatgaggaattcccaaggttatgataaagtggaggcatatattgtcttgtcttgcatatattagtggatacaagtgcagttatgttgcatgggtacattgtatagtggtgaagtctgggcttttagtgtatccatcacctgagaaatgtacattatacccattacataatttctcatccttcacccccttctcactttcctatccttcccagtctctaatatctattatttcacactctatgtccagctgtacacattatttagctccctcttataaatgagaatatgtgggatttgacttcttgtttctgagttatttctcttaagaccatggtgtatatataacacattttctttctccgatcatccactgatggactcttaggttgattccatatctttgttattgtgaatagtgcattgttcaaaagaagacataaaaatggccaaacaagcacatgaaaaaatgctcagcatcgctaatcatcagagacttgcaaattaaaacaatgatgagatattatcttactcctgcaagaatggccattattaaaaagccaaaaagattacaaatgttggtgaggatgcagagaaaagggaactcttatacactgttaatgggagtgtaagttagtacaacttctatggaaaacagtatggagagttcccaaagaactaaaaatagaacgaccattcgatccaacaatcccactactgggcatctacccaaaggaaaagaaatcattgtatcaaaaagacacctgcacctgtatgaaggtattttataatcctccctggagctcgtgaacacacaaagcaagcaggaacgtgtcctcttttcctcccttctcaaatctctcacctttcagaggatggtttatctctcattgccttacttctcctactttagagaagtagcaggtttgaacatcagtggcccttcttcttgatcatgctgaaggtgacacattataacaacacttaggaattaaaatgggcatggccgtgtgtcccaacatggcctctggtacatatgttaacagtatacattctactgtggttactaaaggctgggaagcacagagagcaggggagactagggagaggttggttaacggatatgaacttactactaaataggaggaataagtttctgtgtgctgtagcattgtagggtgaaccatgattatcaataatttagggtgtattttcagaaaactagaagagaggatttttaatgttcccaacacgaagaaatgataaacgtttgaggtgatagatatgctaattaacctgatttgatcatgacacattgtgtacatgtatcaaaatattcctctgcaccctataaatatgtacaattgttacctgtcaagtaaaaataaaaggaaaacatatatattctaaagcaaatcctggtatgatttaacattttcttcttctcaagttgagatggtcataaagcacacagttatagaaatgtcacacacatctaaaaccagccaagggagatttttttaatgtgtaaggacactgaaaacatattactcaggaagccttcctggaaatacataaacacttggagatgtgctccaataaaatgagagcccagtcaattgaagtcgattcatttaatcaattaaattatattaaataagagaccaatcaattaaaatcaatttcaatttttttacaatttactatgaaaggcagtaaggcatgagaggagaagtgctaaataaagggtctctttaaagtctaaataattccaagaaacaccattacaaaatggaatgtaaatgctatattcttgaaagaacttacaccagtgtgataaattacgattatgtagttttttaaaggtatatatatttgaaaattttttcttgggaaagaagaagaaataatgctaacacacaggtaaaatttaatggatgacaaaatgaaaaaatcataaaactgataaacagattcaggtataaatctgtgactccctcttaaaaatgttcaagaggaaaaaaagataaaaatagagatggagagaaagagagattgctaaagtagaaaacaatagaattgataaatgggctataattatatagataaggatgacatgacagaatcttagaagtacttaatagaacactatcctattaagttttaaaatctgtataaaatccatgcttaaaatataaatttataaattaagaaaatttagactaactaaaaagaccaattaccatggaagaaatctaacatgttgttaaggatcttgacttcaaagaaggcaaatttccccttcgaagaattttggagaatttattcctcagcactttttactactgggtgtgcactcctgtcttgttggatccaggtggcttaatgagtcgaccaatcatatttgagaaggaggaacatggtcgtaggtggagaagaaataattttaaaaccagctgtcttagtcagatggccaacctatttttatatccctgtggccagtgggtgtggctgtcatcccagcatgcacaccagctgtagaattatggggggctacctgcttcccagagctaggcaccctcagagaggtggtgcaacagcacaggtggcacaggatgacacaggtggtcttcagctgaacaaacagattcaagctatcgatgtcactgtgaaacctgagactgaatgcctgcaaatcaaagaaaatgactgagccaagtctcaatcaggaggttgaggtttattaggaggtttatttattaggaggtttatttgctgtattagtccattttcatgctgctaataaagacatacctgagactggggaatttataaagaaaaagaggtttaatggactcacagttccacctggctggggaggcctcacaatcatggcagaaggcaaaaggcatgtgttacatggtggcagacaagagagaatgagaaccaaggaaaaggggtttccccttataaaaccatcagctctcatgagacttattcactaccacaagaacaacatggaggaaaccgccccccatgattcaattatctcccaccaggtggctcaagtctgtagttccagcactttgggaggccgaggcaggaggatcacttgaggccaggtgtttgagtccagcctcggcaacatagagaaacataacacacacacacatacatgcacacacacacacacgcacactgttagacattagaattgcacaatcctaacataggaagcaatcacatcatgtttatgcttatttacagcaacatgcttatgcttatttactttatgttattggacaattttcccgaaactgttctaagccctttatgatgttaatactatccccattttgcagatgagaaaaccagggcacaaagggattatgtgacttgccgaaagtcacgtaggcagtgagatacaggcttaaacttttaattctggaatacttttatgttcacaaaatattgaaaaggctattaaagagagctcttggttaccccacatccctttccctccgttagcatcttggactgccatggcacatttgttgcaacgaagtcacccattacttttagtaaactccagacattattccaatgtccttggattttccctgatgtcccttttttattccaggatcgcacccaggataccacgctgcagtgagtcatcaagtctccttggactcctctggctgtgacagtttctcagaatttccttgctttttatgaccatgatggttctgagaagaactgcttaggtattttttagaatgccctgcaatttgggcttgtctggcgcctttctcatgattagactaaggttaggtgtttgggggaggaagatcacagaggcaaagtgccgtgttcctcacatcacattaagggtacaactctcaacacgacttatgtgaaggaaaatatcttgggcccttaaaatgactacgctaaagggaaaagtccagctgggaactgcttagggccaaactgcctcccattctgttcaaagtcacccctctgctcactgagataaatgcatatctgattgcctcctttggagaggctcatcagaaacccaacagaatgcagccatttgtctcttatctacccatgacctgggagccctgtccccactttgagttgtcccgtctttccggaccaaaccaatgttcatcttacatacgttgactgatgtctcatgtctccctaaagtgtataaaaccaagctgtgctctgaccaccttgggcacatgttgtcaggacctcctgaggctgtgtcacggacacgtgtcctcaacattgacaaaataaactttctaaattaactcagacctgtctcaaatatccggggttcacatttttgtaaccatggagggattctgagttgtgggatatgatgaggtttctcttcaaatagcctgatcaatcctttattctttaattcatagtacctccccacacatacacacacactcctttttcctttttctcttttttcctttctgccttcgttacacgcccggacacgccacagtaccaggcttatcagtaccagctcacattcctttccttatttggaagcaagactagctctctagctcattgcagacagcccttccccttttaccctctctctcttacgtgcccaccttatctaaagaaagttcaaatgtttagccaacccggattagtccaaattgtgccacccgaccccagccaatgggaaaaggataccggggcaggacttgcatcaggaataaaggctttcatgccccttagttcaggtgtgctctcatggtgactggccaaggagaagcaccctctgcgcagaagtaaaattgctttgctaagactcctttgtttcagtgttcaatttccttagggttttgagtgttattcccaacatgagtggaggtgcccctgacctttgacaaatctcctgttggtgcttggtaacagtttgaggtaactttatggctcaaaccaataggacaatttggtgaggtctggaagcacccactccagagaatccctgacctcccactgatgatgctgacatgatcgcctggctgaggccatgactgtcaggtttatccactgtaaaatgacttcttcctctcctttgcacattgtactccttggaaataagtctcgaagcacagcctacactcaagggaggagtggagcatggattttcacacaagatgtgtgttcttagccattacacaatcacaaaactgggaatcactaaatgatgggaaaaacaaattgagttccaatcctgtcttcccatcctcttttagttggttttgtgtgcttctgagaagcacactccctcatgggaaacctttggtctaggagcgagacccacaagtcaatagaacaaaggttacagtatgaggttatgaatagaaatagcaaagaatatcgctgctgggtgttcagagaaggtctggctgagggggtgacctttctgctgaatcttgttgaataagtaagagttatccaacataaaggtaaattattgccaactaagaaaccacccatgctaagagctgaagacttgagtagagacctaagttcactattcttggagcccacagtgctagaagtgaggcaccaagtgacagacctgaaaagaaactcacaaagcacatcacaaagaactgtgaagttcaagactcaagacttgaacagaaacatctggcagctagtgggatttgagagctgacgttggatctttaatttccaatagagaacatcaatatatcagggtaccaactcacttggtttctaaagccatggcttactcaactgtagaacatctatagtccaaacccttgccaagggatgtagtctttttatttttattttattttattttttttagacacagggtctcacactgttgcccaggccagagtgcagtggtgctatcatatttcactgcagccttgaacttcctgggctcaagctatcctcctgtctcagccccctgagtagttgagaatgcaggtgtgtgccaccatacccagctaatttcttttaactttttgtagagacaaggtcttgctatgttgctcaggctgatcttgacctactggcctcaaacaatcctctcaccacagcctcccaaagcactgggattacagtcatgagccactgcatccagcccaggggatacagtcttaagctacgagctgtctgagtcttaacaaaatctcagtggactaaaaactggtgaaaaaccaactaaaataatgggatacccattgtcactcatcccattagcaaagattaacacatttcaaatacccttgaaaatatggttcttggctgttcctgttcaacattcaaaatgtatatgccctttcaaataacaatgtcattttcatagtataacctgcaaaataagctacagctacactcaaccaaatgtacaaacaggttcatataattatatttcacagcgtttttgtttctagtagcagaagctggaaacgaagtcaatgtccaccaaaggaaagaagaaaagaaggagggaaggaaggaagggagggagggagggagggagggagggaaaagggaaggagggaagggacggcggaaggaaggaaggaaggaaggccattaaaacctccggtacttcatactgagttcctgtacatttcagtgtgatgataatttaaaatgccaatagataatgttaaatgcaggagaagttacaatataacgactgtagacaggtcccatttgtactccatcatatttcatatataaatacatatatgcaaagcccagaacacttatgaagagatacacaactaattgtcaaaagttatttctggagagcaggatgggaatagtttgatccctttatattcttttatttaaaaatcactttctcaacagttcagtttatgatagtaatttttgggggaaattgtaggaggctgttccaggcatctctcctccccagtattttgcatcattagatgaaaggcacctttcagaatgctgtcagcttaaaaattattattctgggctcccaaagatagatttgccctctctgctttgcattttcgtgtcctggggttggctcactgaggaggcctcatttgtctgtaggtttagaactgttttcctttatcaaccacaggaaaaccactgttttccctgacaaacttgtgtgggcttatatgtgcatactctcatacacacacacacacattctttattaaaatgtaaaatctcactaaaagcttttgaacaaagtaaaaactcattaatttatattttctttttagcttaaattagaggcacacgtgaggtaagtgaaagaaagagagagaaagagggagggaggtagggagggagagagggagggagggaggaaggagaagggaagggaaggagggagggagggaggaagagaggaaggaggggaggaaggaaggtaaaagtaagggaggaaggaaggaaaagaaaaggagaggagagaaatcagtgagggagtaactgtaaataagatggttgagactataactggataaatgaattaataaagttgtatgtaatctgaggtctctgataaatttcttccacttaattttcatatattttttatgaaaccagtctaaccactgagtaccatttttctttcctgcactgtaggttaactttaaagatacattagtggtccacagccaggaaaggatgctaatgtcagcggcccgcacggaccataaataaacatttcaaaggagcaatggtgcattcaggaacggtctctcaaattgcacgcgcaaaggtggcatgtggagccaacaccaggtaaaagactgcagggtgatgagaaggggcatggattgagccactgggcctgtgctgactccagcctttgcatggagctcatccacttacgcttgaagccttgtcttctacagggaaaaggaacaggaatgctgggtatggggagtggacaccaggtgacgggattaagtaaggcttttaagggagacggtatgggggaaaggagcaagacttgaggcagaggagggagccagccagtctgctcgggagaggcacgcttcgtcccggtgaagaccagaccagagcagccaatccagggggatctgactccttccaggaatgggaaggaggagctaggggcatcggcaggaggaaataaagtcacaggggtgaagtagaggtggaggaggcctgatgggggcggcgcctcagaacctcatggggactctggccttgactctagagaaatggtagccactgcagcgttttgagtcaagggctgacatcatcagatgaacagggtttcccagtcaaaggctcccttcggctgctgtgctgagggtatttggtatgggggaggcttctgcaggaatccagagagagatggtccatagcggctcagaccagaagggtgaaggaaaggtttggctgcggatctgattggaacacactgagatttagaaaggtgagagattgggccaaattcatgatgagaagcgggatccacagtttaaactcggagctgccctaaagcaaagcctttttttttttttttttttttttttgagatggaatctcgctctgttgcccaggctggagtgcagtgacaggatctcgactcactgcagcctccacctcccggattcaagtgattctcctgcctcagcctctggagtagctggaattacaggtgcctgccaccatgcccagctaattttcatatttttactagagacagggtttcaccatattggtcagtctggtctcgaactcctgacctcaaatgatctgcccaccttggcctcccaaagtgttgggattacaggcatgagccaccacgcctggccaagcaaagatcgtttctgggacagctgtttccgccttgacagggatccagactgcttccacctttgcaaagctcaacaaaaaaatctcatttcaagaatgttgccttgttgagtagtggagggaagaaacagggaggtgttatccaaagggtatgaagtttcagctagacaggaggaataagtttttaagatctcttatgcagcaaggtgactatagttaataaaaatttattgcatatttcaaaataggtaagagattaaatttcaaacgtcttatcaccaaaaatgataagtaaatgagatgatggatatgttaatagtttaatcattctacaatgcatacatacagcaaaacatcacattgtgcctcataaacatatacaattatgatttgtctattaaaaatattattaggcccggtgggctggctcacgcctgtaatcccagtgctttgggaggccgaggaggaaggatcgcttgagcccaggagttgaagatgagtctgggcaatgtagcaagaccctatttctacaaaatgaaaaaaattagtggtgtgcgcctgtagtcccagctactcagcaggctgaggtgggaggattgcttgagcctagaattttgaagctgcagtgagccatggtcacaccctgctacacagtgagaccatcctgggctacacagtgagaccctgtctctaataataataataattaaacaaaaattaaagaatgttgccttagattttgcagcagtggagtgctagcaaaggccatgtgtttgggggcttctcttggatttacgagaatcaggtgcacagacaaattacgtataggaggcctgatgcttgcggtttatcaatacaaagctggaatatgcattgcaagcaatttacaaatgaatgaatcatattaatacagaatgcctgctggatccgactggttacatagtattcaagtgctcccaaccacaatctgttctacatcaaaataattcatttaacctcttgcttatcaatgactttgctatgtgagccagtgatattcaggaagctggtgcatatcatgaacttttcctgtactcctcacaacacttcatggttctcagaggcccagttttactcagggcaggctggtttctttttaaccaagttaagattgcattctgttaaagagataaaaatatgtttccatggttcaggtagtgttgggctgagaccatctacacttgggacacagatctgtccacactgccctcttctccagatgttttcagtgaccaaccacctcggacactgcaaagtgaaggaaaacgttttgcctcaacataaaaaaaaaaatgttatgaggtcattaaaaatgctgaggaaagcagaaaagataaaacctccatagaaacaaaatatacttatttttgcatacctttctctctttgtgtatttacttattttacataagtatcacatagaaataaattcagacatagaagctacaatgtttcacataatgatctacccacttaagtgaagaaataaaatattactaacaactgcagtctcctgtgtatacttttgcaaccaaccttcactcccctccaccttgtagtaattcatccctctcttgaattaatcttttaatctgttccatgcactgctttatacttttacaatagtgttgttcacactccatttacacacttgatgtgtacagctttccaaatagggaggccaaatagggaggattgcttgagcttaggaatttgagaccagcctcggcaacatagtaggacctcatctctactaaaaattaaaaaaaaaaattagttgggcagggtggcatgcacctgttttcccagatactcagggtgttgaggtgggagaatgacttgagcctgggagattgaggctgcagtaagccatgatcatgccactgcactgaagcaactgatcaagactttgtctcaaaaaaaaaaaaaagaagcaagaaaaggaaaaaaaatctactccattaaggtatttctaaaccaataacgacacacttcatttgtaaatgttcattccttcattcaagaaaaaaaaacattgaaaactttattgagcttctagtatattctagatgagaaatatagtgaaagaataagaaaaaatttaaactcgtatcctcagtgaattttgtattatactgagggaagatacaatgaacaatcaatatgaaaaataaataagtggtctagtagactgaataatgccctcctatccccaaagatatcaggtcctaatacctggaaccaggaaaggttactttatatgaaacaggctctttcatactttatatgaaaaatgcaattatggattttgaggtaatggaattatccaggtgggccctaatataatcatgtgtatccttacaagaagaaagcagatattattgcacatatagccaaagaaaataaatcattctaccataaagacatatgcacacatatgttcattgcagcgcagttcacaatagcaaagacatggaatcaacctacatatccatcactggtagactggataaagaaagcatggttcatatgcaccctggaatactatgcgtccataaaaaaggatgagatcatgtccattgcaccaacatggatggagctggaggccatgatcctaagtgaagtaacacaggaacagaaaaccaataactgtacattctcagttataagtggagctaaacattgaggacagatagacacaaaaaaaaggagaaatagacactggggcctacttgagggtggacagtgggaggagggtgaagattcaaaaaccacttatcaggtactatgctgattacttgcatgatgaaataatctgtatacaaaacacctgaaactcacaattttcctaaacatacctgcacctgtaaccctgaacctaaaataacagtttttttaaaaaagaggaggcagagagacatctgtcacacacagaggacgagacaatgtagagaaaaaagatctgtgtgctgtgctgatcttcaagatgggattcaggctaaaggaagatttagattcaagcaaaggaaggccagctaccaccaaaagctgcacgagataaggaaggatcctcccctagaggcttcgaaggcagctcatctgttcttgatttcagactctggcctccagacctatgaagaaatacatttctgttggttttaaaccatgcagtttgtgctgatttgctaaagcagcccgagaaagcaaatacagttggcaagaaatattatgaagaacattagaggggagtagctagtgcttggggtagggagttgcaatttagataaagtggtgagagaagactgctctgagaaggcaacgtttgagcaaagacctcaagaagggaggggaggggattgtttctagaacctggtaataactctgggagagctttgcagtgagagtgagcagcaggtattaggaccctgaaggaggagcattcctggaatgccctaggcacccagagtggccatggatgagggagggagggagggagagtagtaggaggtggggccacagaagtgatggcggggacccatctttgcatgtcactgcaaggttctcaaattttaggatgcaggagaggggtatcgtaggatattgagaagtatccctggtctctgcccaaaaatgccagcagcaccacccaccccatttcctgtttccaggttgggaggttggcacaactttgtctcctattttaaaaggattactccatcaactgggtttagaataaccttgagggctttgtgctgtcgatgcgagcactgaagcaaaaaatacaaatagtattactattatcctgaaagacccaatggtagcagtttctagaaggtcatgatgagattaatgagaagaggtcatattctggatatgtttttaaagttcaacaggcaggacttaatgaactggatatgaaaaaaaaggagtagatgaagatgccatcatggcaccctagaaaaccttggacaatgctagcagatgcaggtgcaggcagtgcttgatgcaactcttggtttctcatatcccagggggtgtggttggtcccccagtccacatcatctaatttagtccatgtacaagagttcttagacactcagaaacacacacagtttctagaactgaggacaattctacagcttacaaaaccatcatggatgatgggcaacaatgtaatggaatctgttggtgccatgcgtgtcgatttctgagaagtgttgtgaagctttattggaactctggtcattattgtcttcttttctagatgagtagttcccaactctgtctgcaccttagaaccacctggggaggcttaaagaatcctgtaccccagctgaatcccacaccaatgacttctaagtctccaagcgtggaatccaggcatatgtatttttgaaagttacccttagatttttcctaaatgttttgagcaactgtccattttctcttcatctttatcccataaactagtgatactctacagggattattctttccctagggacatttggccatgtctggagacattttgggttgcaataacccagttagcatctgttgggtagagaccagggatgttactcagtacccgacaatgcacagcacagcccctaccacagagaatgacttcaccctcaaatgtcaaagttgagaaaacctaccccaaaccctcaaatgtcaaagttgagaatgagaaaacctgcctcaaacccagggaatttgattactgcattgatgggttcattaatcattgccagacatttttaaatgcctttcctctttttttcggtgcttttgaatttaattgacaaattgaaggtcgcatgggaagacagcaaagaaatagaggaagagagagatagagtacaaacacctgcgttgagtcaccatttcctgcagccctgagtgcctctagtagctagtgagggggacaattagcagtttttgagagtgatgagaacaactatttgcatgttcttttccttcctgaattgtgtttgtgagagctaagttaatcatctgatagagccacattcacacgccaggtgttgcggttgaacaccaatgtctgtttcttcaaggtttcgaaaatggttcacggaagggcctgctttttgctgaaatcgtgcacatggatgataggaacacttccactctcaacagtcacatggcatcccttaggaagctgcagtgacctagaagccatcaaggacaatttcctgaaaggggtttgcttttctgagtaaccgcttcctgagcttgcttctctgtttgtgggaccttatttttcagactggctcaaataggttatcaattcggagtaacattgctcctctccagggacatttggccatgtctgaggacatttttggttgtcgcaactggaaatggcagagtgtgtgtgtcgggggtgctgctagcatttgttgggcagaggccagagatgccacttaacatcctacaaagtataggactgccctccacaataatggtccagcccctgatgtcaatagtgtcaaggctgagaagccctagaaagagaacagtaggataaagaaaaaatgaatgaacttacaaataatttccactatgtgatttagatagaggcacaaatattccctctcttctccaaatatttcctccttcatctgttgatcttcaagggagttttactgtaaaactttgagcttgtcttcatgttccaagagggatggaacctgagctaaaatttaatacctggctatttttggagtagtattttagtttctagaacctgggaataggcagtgcccaactgatgctcttctcatttatttattagcctactaagattttgtgaatggttacagtaaagacaatggtcaaattttatttatcgcagaatgtctctgtcatgtttgatcatagacacctttagcagggtaatttttactattccctattcctttagggtgatcaactcatcctggtttgcccaatactgtcacaatttcaggagtgaaagtcctatatcctggcaactttccgtattgtggggtgggtggtcaccctgcattccatggaattggttttccaagtaataatttttgtgaaatgcagcactggtgtttgttattttattttatttatctggtattttatttggtatttggtattttcccaaaggataacttggtaattagcattctcccattgggaaaataattgatcaaaaatctgttgtcatggaatagacacttctttgtacacatggttggacctttaactagggagacaaaagattatatttttaacaattaaggatacctattttatagagttgtttctgaattattccagatttttcacttcaatattaaatttatttttatcagattttataaagctcaaggaccattagagatgtccctaagagtaaggtttttgcaaatttaaagaatctgtttttgcgtgcctgtcagtattgtaatcactttttccttttccaacataagatcatacattaaatttaaataatagccttattaataattggaacccactgcagagatccctgagaaggcccagaggccacatgttgagcccaagtgagtgcattcattgaaatgtcatgtcagtaataccaagagggctgataatgatacaccctctcgtgctcctcatcccacactttcacgacatcttatcaacgagttctaatacaataaacttacatgcacttgatagaataattgccattttaatttaaaaacttggcagaggccaggtgcggtggctcacgcctgtaatcccagcagtttgggaggctgaggtgggcagatcacctgacgtcaggagttcgagaccaacctggccaacatggtgaaaccccatctctactaataatacaaaaactacccgggcgtggtggggcacacctgtaatctcagttactctggaggctgaggcagcagaattgcttgaacctgggaggtagatgttgcagtgagccaagatcgcaccactgcactctagcctgggcgacagagttaagactccatctccaaaaaaaaaaaaaaaactcggcagagactgaaattgtttgtacctccaagtcttagttttcctctgcagctctaagccagtggaaaattgacaaattccaacacagtttttgagaattatctatgtgacttcaaacgtgttagtttacattcccacaatggattcacacatgcatacatatggcaactgttgcatatgtaaatgaatgcatctataggaagtcaataggaattcaatatatctttgtatgtgaatttaatcgaaactgatgtgtctgtatatgcatatatacatatatacacacatttatacatatagacatacataggcacacatgaatatacatagataagatagatatagatatatagagggatatatagagatagatggtggatgaatagataggtaaaaacagatatagacatatgtagagagatacataggtatacataggtaggtaggtagatagggagggagggaggtagataggtataggtaggtagataagttgattgactgatttcatgatacatcctggaaagttacatacaagtaaattcctaatatcaactcatttttatgccattttttctcctcaaagtagaatactacatgcttgtataaagatttctctctttttaaatctctctctctctctctctctctctttctttctttctttctttctttttctttctttctttctttctttgatggagtctcactctgtcgcccaggctggagtgcagtggtgcaatctcggttcactgtaacctccatctcccaggttcaagctactctcatgcctcagcctcccgagtagctgggattacaggcacatggcaccacgcctggctaatttgctacttttgtagagacagggtttcaccatactggccaggctgctcttgaactcctgacctcaagtgatctgcccgcctcggactctcaaagtgctgggatgtgagccaccaggcccggccttccctcttttttaatgtgtatagttggaggattctggataaataacagggaaatgatataactggatttactgaattaactctcaaaacccttttctggattcagacattgagtgggttgatttaggccaaggtccccaaatcactgcccacaggccaaatctggcccactgcctgtttttatgaatacagttttattggaacagtcacattaatttattcaggtattgtctgtggctgcttttgctgtacaatggcagagttgcctatttatggcagagactgtgtggttcacaaagccaaaacatttgctatctggccctttgtaaaaaaatctttgggctgagtgtggtggctcatacctgtaatcccatcactttgggaagccaaagagggaggctcacttgagcctaggagttctagaccagcctgggcaagatattttttagagacactctctacaaaaataaaaattagccgggcagttgtggtggagcacacgcctgtagtcccagctactcaggaggctgaggtgggaggatcgtgtaagaccaggcgttcaaggctgcagtgaaccatgcttatgctactgcactccagcctgagcgatagagcaagaccctgcctcaaaacaaacaaacaaacaaaaaaccaaaaacaaacacaaaaaaattttgcttatccttaagtcagattaaagagaaccaggtacagttatttttaagaacacatggtttgagaaagtgaaatacatagcttccgctcaggttacaaagtcacatatattcaaatatagtgttttcaaaaattaggaaaataaaaagcccccttttaaaatgctggacttctttgtttggaaaaatgggaaccattctgtgttgaccttgccctattctccttcaagatgctttcagtaggggaaactggatgaagaatacacaacggcttcctgtacatcatgctgcaacttcttgtaaatctgtatttgttttaaaataggtaaacttaaaaaaataaataagctcaagcctgctttgctctgttcttattgcagtgactgtctctatcattattgcatggttcccataagacgtggttgtctgagggcagccccaccagccagtcaacaagtttcatcacgaataaaattccaaattttgttttggatacaacacaagccactgtggcttccattgctacaggctaacattgacttagtgtttcccatttaccaagattgtaccagctaatgtaaagggtttggggtggtgggttcttccacatttcaccctctaaagaactcaatgaggacttgcatgattattaatacgtacaacctggttttatcttcacttccatgctttccattgcttttgtgtttcacatctcatttcctttgttccatatgttgaatttatatctgaagccatattcaatggacatggggacatgagagcatgcaagttaatcaataggtcagcatcgcaatagtttgcagctgtaacaggatgcccaggagtccagatttccaggtctgtcaacgtcagctccaccacacatttgccatgtgacttaaatcatccaaacacaaaccacagtttccccaggtgtgccatgacagggcgccagcaaagctggagtacccccaagttccaaaatgccaatttgttatttggcatacagggaagttataataaggggaagtaaaatgatccagaatcttgaattcataattcccaccttattttttggtgtcatttataatgaccacatctatgtagtaatcggaacgaccacagtgtcttcatgatgtaatatcctaaggcattttagggaacctcacccagtggcatctcttagctaccccatggaggtcaaaagttgttggtcacacatccagcaattgaatggcttgaggggaatgaggtctagacttggtgtcaggtatttgtctacatgctatttggaagaattagtaacacacaaggtttgaaggaggacaattttgtcaattatacaaacactgctgtgccccttaaaacattcctaaaaagtgttttctacttcatattatttccaaaaaagcaaattggcaagatagagcaagaatgttaaaaatgttggatgctttacaggtaattctgtttctgagtttttatgcctagggatggaatcatcaatgtgcagaattctttatgcacaaaaatcttcataattgaacaatatataacagcataaaactggacccaatggattcaaagatagaagaagtgttacggctacaatggaaggtatgcttgatggaaccttttgcaactatttaaaattatgatggaaagtgtatatattaccctggtaaaacatttcttataattctgataatcattgagtctgtatcttagatcaggcactgtaatgggttactttatttaaatatttattatagccctaatatactattaaagctattgtgttacacctgacaaaactggggcagggaggagataagaatcctatccgaggtctcacaggtatttcccaggggggcgaaagacatcactgaccctaacagctatgcgatgacccactagtcaagactacttcttcaggcaatatgcatgatacaatagtatctcttgaggccatatgcacaatgcaaaattattcatattataacattggtgcaatattttaaaacctagatagatggaagcaacaataataaaaacgatctcaatagaaaaatattaaacgaaatattaatcatcataataaatagtaaaaagacaatatcatcaacgagttagattggcgaaaagaatcaagaaaataaaaaccagtttctgccaccagtcagcaactactgtgacaatccttggtgcatatatttttatatccttttctctgctttttgcctgtttacatagtcctgctcgaaaattgcagcatgatggcagtatcaaggactgtgtcaacactctgtaaagaggatgagttgaatggggccataagtacaaatgtgactgtacttgggtgaaattaaaactctaccatgcagctgcgcactaactgaattctctctggcactgatactttacttcctcctcaccgctgattatagagacttccacgaataaacaaactctcttaactcacatatggggtcttctatctgcagaattcatgcaggaatctatgattccatttcatgatagtcccatgccagtactttctttgaggtaaattgtttagtagtcttggccactgcactgtgaccattgctcccaatggaaatgaatcaaggtgtcaagagaaagcttggagtaaacaacaaagatcacaccacagaaactcattattatgcattgttcaagaccagtactacctctaaatgaaaattggacacaggatcctcttttctggaagtggccagtgggtttttttcaaaatatgttatacaacagtatcctggatgtcacatgctgtttgtttgtttgtttgtttgtttttgtagagagatggggtcttgctctgttacccaggctggagtacagtggcacaattatagctcactgcagcctggaattcctgggcatgagcaatcttcccacctcagcttcccaagtagctggaactacaggcatgtgctgccatgcctggctaattttattaatttttgtagagatgggatcttgctatgttccacaggctggtcacaagctcctgggctcaagcaatcctcctgctctggcctcctaaagtgctgaaattacaggcatgagtcactgccccctggctcccatgtcctctttcattgacccaatcttgactcctcagaacttttccatagagaggggcaagatccactgatcacaaagcccccctggggctgtggcttaggaattgaaacaactgaaatttcttgcttaaagaaatttcaacaagaagtgctctatcttataggctgtttaaattggaagaacacatagcacctccctgtgactatatgttcttcctatgcaactccaacagcatcgtgttcaataacctccaactctgaccttacccagcccagctctcaaatcagaatcaatggttaatgcttgtgaacctgaagaactctctgtcagtgcctcccttgagaaatttctcttatttttacttgtgccacaaacttatttttctatctcccctttgagaccttaagtgaccagagactgggcactatatttgatttgccattttcttttttacacaacattctttatttttatttttagttctggggcacatgtggaagtcgtgcaggtttgctacataagtaaacgtgtgccatggtggtttgctgcacctgtcaacccatcacctaggtattaagcccagcatgcgttagctatgtttcctaattctctctctccccccaccccatcccccaacaggccccagtgtgtgttgttcctttccctgtgtccatgtgttctcattgttcagctcccacttataagtgagaacatgtggtgtttggtttttctgttcctccgttagtttgctgaggataatggtttccagcttcatccatgtccccacaaaggtcatgatctcattctttttatggctatatagtattccatggtgtatatgtaccacattttctgtacccagtctatcgttgatgggcatttgggttgattccatgcctttgttattgtgaatagtgctgcaatgaacatacatgtacatgtatctttgtaacagaatgatttacattcctttgggtatatacctagtaatgggattgctgggtcaaagatatttctagttctagatctttgaggaatcgccacactgtcttccacaatggttgaactaatttacattcccaccaagagtgtaaaagtgttcctaattttccacaacctcaccaacatctattgtttcttgactttttaataattgccattttgacgggcatgattggccgtttttaagtagagtacactagtcaatacatacttttgtaaaggtataagtgaataaatacatgaattattgatgcccaaaggaagatattatgtttcccctctggtttcagtacacgggcagtgtctgtgcttgaatttgtcctgatttcatgagctgggaagcacacgagccatggtttttcacccttattctcagaaggtacaatgccatcctatgactcatcttgaccttttcaggtatatgcatatgcatgagacccttgtcaatattaaaaattctttcaatttggatagacattcctctgttgctgcccaattaactatacatatcattttagagaattttccaattagtgatgagtatattgatcattggctaatgttaattagacaacataatcatttttggaaatacaggaaataatatcccacattgctttggaaaggtatatttaaatatcagtttaatctttgaagtacttatgaaaatgccccagtgggaataattttacgggatcataatactcggtaaaaattctaactagtctctgactcattattaaaattcaaaatcgcaaagcaccatataccaagtgatgtattgtacataatgactttcttattcaatttttctaatctattttttatcccctaggggttttttctcagtaattgtccagagtttaaataaaagaatagtagtgattgaatcttcatgcgtctttatttttagactcacatcttgaagtctgcagaactagcagcagagaacgtaagagaaaaatgggtgtgaagatgttctatgaaaatcattctaagttactacatgtccttcagttcatcacaccaaaaaagaagagaaaaaccttggaggggaaaaataagtctcctctgttttgtataagagcaaattgtctttccatatcaggacttgtttatttgacacctgggggtctcatcagtaataggatacagacatacataaaccctgtcatcttcattgcagaataaagatgccattcatgggtcatgacctggtagaaactgtgcaaatgtgtgttgaatcagggagtccaaatcaccacacctgtaccagatccatttttagttgtctctgaaatacagagccctcgggcccagagtctgaataattgctggggttcctgcaggcttcttttatgttcaaccataaagatttaatacaaattcttattgcagaaccatggtcacattactgttgatgaaatcattccttccatcaaaatcagtcagatccaacgtactcaattctcaaatacggtgcaggcagcattgtagtaaacatcactgaatagactcgttgttcagtatgtctcaaagacctgaacaggctgttcagccaaagcttaaataaatgcaaaaatcctaggaggagagcatgctgtttgaacaactcaggttcagtttaacactttctactcctttgaaaaaattaagacaatcccttaaaaaaaataacgaacaccactttttcaatcttgacacatgcagagaccatgcaagaatatgaactaaaagaagagattaaggttgcatttaggaggtcattgacgagtgaccttgaagatacctatttttgaagagtagtaaattctgaaagtagaataagtaggaagtgaaaaagttgtgacagtaggtgtggacaaatttgtgaatgtttgcccagcaatggatgtgctaaaattggaaacatactgatggatgacatttggcaagtatgttgagaaccacagagagctaattcatctgcagatgtgccattcttagaaaggttggcgataaagaagagaaaggagatgaatgatggggaccatcatgtggatgagatagaatttacagagcagagagggagattcttatctcggatcctatgcaccccagaggcggcagtgaagaaagaatgcaggtatagatcattttgcaggagatgcaaaacaccaacgaaggttattcctgataatgtctatttctctgtgcattagaaagaaagattgtgtgctgaaagtgaggggtgaagtggaggacttgagacgaattggagtatgttggcaaaagccagtgtgagaaatgggagagggacttttatcaggcagcagcatcgggattgtgcacaacaccagttaattttggtgctcagagagcagtaaagtcatgaattttcactgttggatgtgcctggtgatagtacagagggagtatatggttcgattgatctgggattagtggttggtgggactgagctgatttgaagaaagaagaagagggaaaggaggtggccgttgtgtttaggctgcaattgtctggataggagaggacggtaactgaagctgaattgcagggtggatggagaattatccagagagaaagaactatgcctacgtcagggaagacactaaatgatttgcaatggagacttcagaaatgaatcttggcaggatgagtttcacattgctgctgaatgttaggtgcacattaaatattttgtttccatgatgcctttgcctaagatatgggaaatgatcatttatacaagatgtttctgtaaccacagatctcatttttcccaacaagccacttaaaaatcagtctcctgcaacctgaaggaaatgaacacgttgagtcactaacaacctctcttgcattggtgtcctctcatgcgaccgtgaaaatggcccttaaaatctgcccatgaaccacagagatggagtgcgttaattttttctcctccctttccttccagcaatgatttttgcctgaaggcatgagattcgattatgaaatgactattgactaacagcactggaggatgacagaaaccaaagagtcgagtataaaataactgaagttaaatggaacgtatttggggagatgagaatacaataaggggatggatggtacacactcgttgaacgtttgctgtgcagcttcttgcattaagagatgacacagtcaaggctacacccagggaactattacaggtgttgtttcagagtgtggagccgttcatgttcaaaaggctggatctgcatttcaaatatataaaatctcacagatttatatgaatgatttcatcagattgaaatcgtttcagcaattgcagcccactggagtcttgggtcaccccctgccattttcattcagcacctagtagcattttgttcttactacattgatttgtgcttgttgattggtacctttggaaataggactttggatgaattgtgtgtgtgtgtgtgtctgtgtgtgtgtgagcgtgcattactcccaaacgaagagagtaaacccctgaagaggcagttcactgttaccattacataaacgcacactgcttaaagattttctcacttcaggtgctcggtgtatgttgctgactggctaacttcaggtagatggggttttctgctggaaacattgacccctggtaggctttgttgaaaatggctgggggtttgcatttccctcaaagaaacagtttcagtaaaaattccaaagacctcatttaagagcttcattccaactataagatgcactatcggcttcacaaaaacacttgtttccatcagtggcagtttggttattaacccagtaactacttcaacaggaagacctgaaggatatacaaagatgatctctgaacactggacactatcaagaatatccaggaaatttctagttcagaaatacaattgcggccgggcttggtggctcacacctccaatcccagcactttgggaggccgaggcgggcagatcacaaggtcaggagatggagaccatcctggctaacacggtaaaaccccgtctctagcaaaaatacaaaaggaaattagccgggtgtggtggtgggcgcctgtagtcccagctactcgggaggctgaggcaggagaatggtgtgaaccggggaggcggagcttgcagtgagccaagattgtgccactgcactccagcctgggtgacagagtgagaatccgtctaaaaaaaaggaaagaaagaaaaaagaaagaaagaaagaaaaaaagaaagaaagaaagaaagaaaaagaaaattgcaactgtgtcatgatggttgcaattgtgacctcaaaaagaatactacgttctttatatgttgaaaggaaaagggaagatcagatgccaattctggtgcccttcatcattgctatagatggattcccttaggtaacttgcttgacaattcccttcgcaaagtctctggttttcaataaagaaatcacagtagctggaaatggagggacattttggcactaagttctcacaattgcctcttccatttctatgttctatgaatttatttagtaaacaccctgttcatcagtacttgagcaatgaaaaataccagatatttcctttgaaaagagaagaaaaagaaataaaatagcaggtagccacaatcctattaggtaaggagaatctcttggaaggagctttgagatcatttttcaagataaaaagtgcaacctttcatctcactttaagagacgtcagaaatataaaactcattatcggccacgcttaggtaaatatttctcctcacttctcacctcagaaatcctcatatttgtatgaatgatattttgagtgcaaaaacctataaattatgcaagatatttttacagcaggaggaatttagccgagcactcaagcagaagaacgattggtgtttttgcagcttcactgcagttttgagaagtcagaattatgaggcagcatcacctgtgcttcttataacccctctctgtcctgaatcctccctggccactttgttctctctcttccatcaggagtcccggtgggataatctatgtttcatctcatcatttcctaaattcctcttcttcagtccctagcaggcaggtggtgctttattcttctcaaattgtttccccaagggacctcccacctgctacacccaggggactataaatcctcattcattctgacctccttcggaagcatttaaaccccatatcacttcaaattctctctcctttggcctctgacagcactttcttcctggtttcctaaacttcactcgattgcttcttcttggtcttgatccatttaatcattcctcctttttctgatcaaccaggaggcagcacccccaaaggttctgagttagactctttgcacatacctggccattgctgtattttcatctgacaactcactgcacagattctatgtcctatggaagaggtggactttcacctgaaggtaggggccatgaaaagccactgaaatattctatgcaaaggtggcctgatccaggctgtccttttttaaaagccacactgtgctcagagtggaggatttattaataactaggaaactgtagagacaggataaagcaatttgaagaatattttccttaatacaaatgaagtaaaggtggcactaaggctgtggcagtacaggaaggagtttatagaacagagtgacgtcaggaaggcaaagtcaagaagccctcaatgatgctttggatataagaaataagaaggagggaaggataggaatgtttcctagattctgcctggatgatcatggtgccatttactgagataagaaactgaaggagaaactaggaagaagagggaaaagatattattaagcaatcaaggttgcttaatcatatggttggtcacctaatacaggagccacgcattttattttctcaggaatatgtgattatcccttagatgtgtacatataaacatatatatgtgtaattagttaaatatatgcatatagatagaaatacaatttatatacacaaaatttgtaactgatatggtttggctgtgtccccacccacatttttttttaagtgcctagacatttattacctctttagtggtgatttgtgagatttcggtgcctccattacccaagcagtatatgctgcaccctatttgtggtctttcatctctcacacccttcccatcctttccccctgagtccccaaagttgattgtgtcattcttatgcctttgcatccttatagcttgactcccacttatgagtgagaacatatggtttggttttccattcctgagttacttcacttagaataatagtctccaatttcatccaggtcactgcaaatgctattaattcaatcctttttatggctgagtagtattccatcatatacatacaccacagtttctttatccagtcgttgagtgatgggcatttgagttggttctacatttttgcaattgcaaattgtgctgctataaacatgtgtgtgcaagtatctttttcatataatgatttttttttcctctgggtggataaccaatagtgggattgcttgatcaaatggtagttctacttttagttctttaaggaatctccacactgttttccatagtgattgtactagtttacattcccaccagcagtgtggaagtgctcccttttcactgcatccacgccaatatctactattttttgtttttttgattgtgtccatccttgcaggagtaaggtgttatcgcattgtggttttgatttgcatttccctgatcattagtgatgttgagcattttttcatatgtttgtcagccatttgtatatcttcttttgagaattgtctattcttgtccttagcccactttttgatggaattgttcgtttttttccttgttgatttgtttgagttcattgtagattctagataataatcctttgtcagatgtatagattgtgaagatttttttcccactctgtgggttgtctgtttactctgctggcggttctttttgttgtgtaaaagctcttaaatttaattaagtcccagcaatttatctttgtttttattgcatgtgcttttgagttcttggtcataaaatccttgcctaacccaatgtctagaagggtttttccaacattatattctagaatttttatagtttcaggtccacatctcattttgaactgtagttcccataatccccacatgtcataggaaggacccaaaggaggtaattgaatcatgggggcggttacctccatgctattcttatgatagtgagtgagttctcatgagagctgatggttttataaaaggcttttccccaacttcactgtgcacttctcttgtctgctgccttgtaagacgtgcctttgctcctcctttgcctcccgccatgattgtgaggcctccccagccatgtggaactgtgagtccattaaacctctttttctttataaattatccagtcttaggtatgcctttattagcagcatgagaacagactaatacaatataaataattatatgtaaattggtgagatctgcttatatactataacatatataactcatatatgtcatacattataaattatatcattatatataccacatataaaatcacagactattataaaatattagaaattatgatattgaaattgtataatattataacatagtttataaaatattatatattatatttattatagctttatacataatttagcacattatatattatagatatatgaattatatatagtggatcctcatcatatgaagattctgtatttacctgtctgcctactcactaaaatgtacttctaactgcagcatcaatgcttagggtgtgttcacagtcatttacagacatgtgcagtgtggggaaacatctaaatcacctaacagacacattctcagctgagaatgaacaaggttacactgtgaattcttggctcagttcatcctgtaaacgtgtgtcctttgagcagtcaatttcatatcatgttttttgcatgtttgtgttttttcttgttggttttgctgtgaaaatggccccaaatcacagtgctggagtgctgtcttgtgtccctaagcacaagcagggacatctgatgtcccttctggagataatatggtattagagaagcttcattcaggcatgagttagagtgctgttggccatgagttcaaggtgaatgaataacaatatgtatgaagttagctgtctctatacagaaacacacagaaaacaaggtcacatattcatcagctgacaaaaatgttataaccagggggctcataagaacctagccaatggttcagctaatccagtgtttttggtgactttatagaacatactgtaatgaccacaaacaatgagagtcaactgtatatacaaattatagacatttatataacataaattaattcaaccaacaatcactgaatgtctatatttcagacaccttgccaggtactagggaaacagagatttaaaaaaataatagtcatgttttcttctctcaatgtattcatactataataaagtgattcccgaatttttaagaagtctccataccttgtatttacaacatgctctcatcaataatatatttcaatctttcatcatatagagttattctcatccagttggatgaaaatagctaacagggtggatgttggtcgcattcatggagaaatgagtcagaggaggtgataggcacagcactgttttcttgagggtaaaatgtatatggagcatctgtgtagggaacttcatcctatagctcagaagtgagatctggggtgatgttacagattttgagtcatttgtgcaccgaatatctgggaggagtatgctcagtgagaagataaagttgatggtaacacgagagaggcatccaagtgggattaaaggaacaaaaaaaaaaataatgagttacgactaaagagagctttcccaggagatgagaatgttgtcctgaaaaccaaaggggaacagagctttttatgagaagagattaggaaggtcaaagtcacagagatcaaagttaaagaagtattgtaaagcccttagtggatttggcaacatggaggttactggtaacccaagagaaagagattccccataaactaggaagtaagaccacaggttgaagcagactgcatatggagggaaaaaaggtggggaaaagagtttcagaaaacagtctagtagttcctgaaaagcttaaacatagagttcccataggacctagcaattccactcctaggtctatactcaatagaaatgaaaacgtatctatacaaaaaaaaagtatatggatgttcatagtagcactacttatagtagcttaaaagtgaaacaacctaaatgtccatcaactgataaatggataaattaaatgtggtcaatacatgcaatggaatactattcagccatacaaatggttgaatgaatgttaatgggcacagggttgaatgaatgctaatgggcacaggccttcttttgggaatgctgaaaatattctggaaatagatagtggggatggttgcacaactttgtgaacaaaagccactgaatcgcacactttaaatggattaatgatatgtggttcatatttcaatacagttgtcatttttaaaaggtggggaaaatatacattattattatgactctagatggctgaccatgaagagtagaggtcatagcagtagctagatgaagatacgtaacagatgaagagacagattcctttaaaaaatgattttgtttcctgtggttttatttggttgtttttattttggaatgagatatacataattatataatcagaggggaaaattcagaagacatggcaagaaagactgagaaaataaacgagagaacaaataagatcttaacagcagacggatatttctcttaggctacaggaacaacatttcatccatgagatcagaaggaaggagttcaagtgggaagatttgtagatcacgggatacggacaaggtatagtgagttgcaaaacacgaagtgtcctcacaccacatagatcctatgttccctccgaagtagagaatagattatcctgagagcagagcagagagaagacggaggaggtgagaatgccttgagcaaagtgataaggatttagaattactaccccaaggaacacaaaagtggatcattgtgggcaggattgctggtggcattgggttcatgtaaattggaagtagatagagccggatgatccctgacccctacaaacactgagcagttagagtctgagaagctaattggttctctagccattaatatagtgaacatattttcagccagggtcaagaaatttacgaggcagaggaaacagaaatgagggttaagggaatccatagtgctagggagaagaaagctgaaatgaaaaactttggatgaaaaatggaaggaaaagaagatagttttcatgggtgtgggggtgggaggttgaaacaagtagtaaggctgacttggatggggaaaaccatcaggaactagatatattgataaggtcaaattttatcaacaagagataaattatttttttcccctggaagaaaactcaaggagaaacgatgagtgtgataagtgtttttgcaagagatgcaatgggctatatatttttcattttgatttatgaattaaaaagtctgaacaaggttatgcagaaaatggtagccccttaaattcagacacattcatttgaatgtgaacaatagagagagatgtcactgggcaggaaaacaatggaagttgatttacatatgtctcttaatgccgaaattatgcatttcagttttcactaagcaatatgtcgtgaaatgttggtaggcagatcttgttttgaacagtaagtctgtgctgccaccttttctgtaagttctgtgtactagcattcaactcagtataatcactttccagtgagacccaatgcttcaacgtgtgatttgtcttagtgacacgagatgctgtcaattccctcaaatggatatcgtttcgatgtggatcattaagagttattttctatggggatgcactgagagacacatttcccatgaactgttgtggaaaataattgtgtaattttaaagatggttgggacaatatactcacttctcagagaaatatcttcaaaaaaatatatcagtgtcaagctaccttggttaagcagtaatgaaataaaagtaggctgggtgcagtggctcattcctgtaatcacagcactttgggaggctgaggcaggagaatcacttgagcccaggagttcaagaccagcctgggcaacaaggtgatacccggtctctacaaaaattttttttaattagctgggcatggtggcatgcacctctggtccctgatacttgggacactgagatgggaggatcgtttgagcccaggaggttgaggcttcagtgagctgtgacggcgtcactgcactccagcctaggtgacagagcgagactctgtctcaaaacaaacaaaaaagtgaaagtaagcattgaaaagaagctcatccttggctcagttagccgccagaacagacattttgcaaaacattcttaatgcaaccaaggtaatattagatgatgggctgtgtgattatgagacaaagacctgacatggattttctaccatctttctagtcaatcctagcacagaaaagggagacttacagacacatttctagagtagtgtccatccacctgtattaaggcagagccctcagaaccaactggctctgaatcagacaaatcatgtgcaagatggcagccaaatcactacagtcgctctgtgcgaagttgaagagacctgcctcatcaacgtgcggaaggcaagcagaaagacatgatgaaatgcagaatccagccgtgtggcacagccttcggccagagtgataaaattgctgcacatgtaggctatgattactggccaagtggcaggttccaaaaagaagcatcacacagagattctgggtggagagatgaaaccacaactagtccctggccctgcaaaaggtgttcacccctgctaatcagaggacagatcctatgaaatgacagcccgattcttggctgtgagcttccctacttagacagtctctgacaaacatagcattccatattataaaaggaaattttagaaatacatacatcttgtcatttcatgggagcccaaagagtcagctgttcccttgttttcctgggtcatcaatctgatttctgtgcaatcagcttcattacatttttcagcacctttaggaactgtagtgggagttgacacaagtgcgacattttcctttatttttcatttgttttcttgttgacactttccccagtcaagatttttgtgcttcatccattatgccatgaatttatagaaagtagattctaacatcaagcttcttacagctggttctcttgaaaggttctctgcagagagcagggtttttcaacttcaactctggtgacatttgggaccatataatctttggctgtagggagctgtcctgtgcattgtaagatgtttagcagcaccttgacctctacctaccagatgccagtagcacctctccccaagtagtgaaaaccaaaaatgattccagatatggtccgatgtcccccagaaggcaaaatcacccttggttgggaagcactggcattgagtatgttggcactttagtgtgtaggtaattttctcggttgctttcatggttttattctgatcttttcctttgcctcaggacgtgttccccagctctaggagagatgaatatgcaacatactctcatgaattctgttggcaaaagtactggccttatagtgtttgtttacaacgatgctgccaacaagctctgtggcattgtggacgcttctcattcgccatagcaacatggagcagtgctcgctagcagtctgcatgccctcgatatcatggcaccctagctgtcaattcagagggaagtggccaaaagcacattgccatggtgacagaaccttcccacttcttccctgtgtgttgctgaattttctttattgatctattatttatttaggttttttttctttaatgtgaattactggaggttggcagatccaactgcaaggcaatgccatctttctacaaagtattcaggagcagagtcaagacagcctccatgtcagttaacttgtatgtatgaagggagagtgctgaaatttgttcagctgtccctcttttctcaactgggagtgaatttgtcccactcccatctgtcagccattctctgggttgagcatcaagatttgatttttcttttgagccctggaggctctgtctagcctcagcccactgtagttttatggcctgaatatgatgttgatgtgaaaagcaagcctcagccctttggcaaggcaggatcacatgttaccagattgccaaaaagctggtgaagatattgctcttgttaaaccagacactccgctcacattcctcagggtggggttcatgggaatctacttttgcagatacagaatgcatcccatctgtactcaggtggtagttttacattcaagcaatcatgcattcctgtttattactttttatcaattaactacccaaagtcaggaaagacaccttctgcagagccacacgtcgaaaatcagtcccaattttcaaaatctggtaagtttcttcctggaggcaggcatacttcatggacaaaatgacattcttattcttttttcttcttaaacttattctcccttatttttaacgtggagatttttctacctgtggaatatttccttttaaaattagcatcaaattagtaagcatcactaccgtccacacttgtcatacggtaatgatttaggatcattagcagatcagacttacatacattttaatggaataataagattgaagctgtgtttgattcatattttaaggttgtggactacataattcttactgtgtgtggatgagaacagctatagtagacttgggtactggttccaccactgattagctgtatgatcaaagaaagttagtgtttgtttgtttgtttgtttgtttgttttttccaggacccagttccttcatctcaagatcaggttagagccagttctaaccccatagcattgtttagatgattcaatgagatagggcatgtcaagtgcctaggacggcacatggtatgggatggatttgtataagccctgtgtaattagcattattcctgtacggtcttatttcctcttccttcataatctctccccacgtggcataaaagacaagggacttacactctgtagagcatctaccccgcatggttttcatgacaaggaatgtgcaaagcatctagcagttacctggctccactaagaataggaccctggcattcttcctcatttgcaacctccttgacactattttctgacccctttgtgaacacttggactatttcctttacacatggccacaccccaatgcttaatgctgacagtactattgcctctctggcttgaagccctatcttccttcattaattatagctcatttgctcacatagtgctgccaccttgtcatttctagtctttaaaacagtgccctttgcaaaatacacactcagtgaagagcagccatgcaaattaatagatacagaatgttgaaaaaaagaatcctaataggatttttcttaaagaacaggattgagatgctgatgggtttgaaataaaagcaagccacccagcacagcagccgcattgccttctcttcatggctgtggtgacggttgggcatctgcagcagaagaggaacgattacattaatgagaatacctgggatataaggggagtccttgtacactctttatgagtcaaatgagaatatcgtcaagaaaaggcaagccacttaaagcattcttcctgcacctggccaggcgcagtggctcatgcctgtaatcccagcacaggtgtgggaggctgagaagggtggatggctttgaggccaggagtttgaaatcagcctgggcaacatggcaaaaccacatcgctccaaaaaaatacaaaaatcagctgggtgacgtggcatacgcctgtagtcccagttgctccaggggctgaggcgggaggatggattgagtcagggaggtcgaagctgcagtaagccgagatcataccactgcactccagcctgggccacagagcagatcttgtctcaaaataaaataaaataaagccatacttcctgcgcctctgatgagagaatcttgacccaatggtctatatagaattcagtgtacgttaaagataaacctatttttaattgtcttcagtctggttcagttttctgttgaaaacatcacagttacaacattgagggattgctcgatgcccaagatgttaaaattactatcagtggctttgaaaggaaagcacacttttctaccttcattttcagtataatgaatatgtttaatattttttctcctgttggctcagaatagaactttgaaaaatgtcatacgtgacaaagattgttccagggagtggagaaaagagaaagaatgagtgaggaaatgagtgaaggatttctgaaaataaatgacaaatatctctgaaggaaggaaacagatgacaggcagaagaaataaatttcaaaataaggaaaatgaatacttaaaatagcaggagaatgaaccagcttgagaatgattttttaaagaacagtatgttttaaagtaacgttccttattgtaaaaataatactccttgtaaagcatttagcaaacacagaaaagcacacagagggagtaaaaatcattcagaggccaccctggagagaaaaacattttaatgcttttggctatttctttctagttcttcttatattcctttcttcttttaaaataagggcatactctaaaaataatttcaggttctactttttttcattcaatattatattgtgagcatattaccaggtgaaatagcgtttgaaaatatgattttagtggctatgccagtattaataaaccacagcccatggccaaacagtgtccccctgcccatgagctaaatatggcttttacatgttgaaatagcttttaaaaataaaaatacaaaataatatttcagggaggcacgatgcctcctgcctgtaatcccagcactttgggaggccgaggtgggtggatcagttgaggccagttgttcgagaccagtctggccaacatggcgaaactccgtctccactaaaattacaaaaattagccgggtgtggtgatgtgtgcctgtggtcccagctacttgggaggctgaggtaggagaatcacttgaacccgggaggcggaggttgcagtgagcaaagattgcaccactgcactacagcctgggtgatggagtgagactgtcaaaaaaaaattcgtaacaccttaaaattatgaaattcaaatttaaaggaaattttattagaacacaaccacacctatttctttacatattattgactattgctgcttttgagacacaagggcagaactgagtaattgtcagagagaacgtcggtccctcaaagcctaaaatattcactatttggcctcttagagaaagtttcctgacccctagactatgtaaccacatgacctctgtttatatcaaaacttggttaaacgcttccctatcattgagcaccatggggtttttgttgtttttgctgttttaaataacattgttgtgaatgttcttgacctaaattgtggttgacatctgtgaatatttttctaagtaattaattatggatcaaaggtcatggacctttttatacctctggatatattatcctttagaaaagcagaaaaggcatagataccttgttcagcagcaagggtgtttataagaaccaggggttctgaactggcaccataatgttttcctacacagagatttatgttttcaaccaagaaacaactaaaaattattggctggtgtctttctctttctagaattgtttcaaccctttatcatagcattgggagctagaaaataatccatatctatttttctcactcatctagagtgcagcaaatttttcatcttcatatccagtagggattttaaccaggaaaataaccccttggtttgcttgaccttcagaaagtaatcaaaccatgctggcatcacgaaataggatggtaaaggcagagagatccctgctaagtcgacagagaatcagattgatgggactaactgctttgcaaagcaggaggcaaagcagaagacaccccatcgtggtcttggcagcccgggttataaagaattcaaatttcagtgcaaggcagctgttgaaatggaatatcagaaacaaaggccaccctggacataactgtggcctggtgaatttgctgagtgaaaatggcttattggccctgtgggtttcttctgtcagttccccatctttctattgtgggaatttatcatgttggtcctgctttgtaagatttctttacattttaagactataaacacttgtctacaagtgcagtgtatgtagggtttctatgtattttccatgggtttttgatatgtatggcttgcatgtcagaaacagtgggttaaacaaggctagttggacccttaaatgcaggacttctcaaagcctttagtacgatacgatgaatgtgaatcagcacatgatgaatttaaatgtaacattcatcaaaattattgactatgggcaagtttatttattaggcatatttcagaatatgcctgaatctgttttgtggctaaaatttgggcatctgtggtaggaggtaagaaatccacaaggaacatactgaaaaaatactgactactactgataaacaactagcaattaattacaaattttaataaatggctaaatgtaaaataaatataagaaagcaacaggatttccatatacacaataaaactagttttaaaatattatctgaaaaggacctatcccaatatcaattaaagctgaaaatatgggtaggtgtggtggcttacgtctgtaatcccagcaatttgggaggccgaggcacgaggatcgcttgagcccaggagtttgacaccagcctgggcaacgtggtgaaactgcacctctaccaaaaaaaaaaaaaaaatttacaaaaattatctgggtgtggtagtgtgcacctgtagtcccagctacttgggaggctgaggcgagaggatggcttgagcccaggaggcaaaggttgcagtgagccaacatcacgccactaccctccagcctagacaacagagccagaccctgtctcaaaaaacaaacaaacaaacaaacaaaccaacaacaacaacaaaaagaaagccctgaaaatacctagaactaaccttaacaagaaatatgtaaaacctgtctagaaaatcgtaaagccttaagttaaactgcttgaaactgagcaatataaaattagacttgcataaacaggataaacaaatcacgtcacaggattcaaattacaaatattttaattatgtccatttttcatactatcatgtcgatttctacaatgacaattagaaactttagtaaatattttcaggaacttgtcagattttctttctaaaattcatctgaaatcactaataagcaatgttatcaataaaccttaaaaacattagtgagaaatgactgagatgtgatagcaaaatattttatacagaaagatcatagaaagtccacccagccctagcctccctctttgggcatgcaatgtgagctgtaattaacaattagggataaaacaactagctaaatgcctgaaaaagaagagaaagaggttggggctgagaaagtactcaaggaaaaggtagccaaaaaattcccaagtttgccaagagacataaacaaacagattcaaaaaactgagtgaaggccaaacggggtaaatctcaagaaatccatgccaagacacttcttaatgaaactcctggaaaccaaacacacacaaaaaatttgaaagcagccacagaaagcaacaccttacctctagggaaaaatattattcaagtaatagcaaattcattaccagaattgatggaggacagatggaagtggcacaatatttttcagatgcttaaaaaaaaaactgtcaacccagaactttatatccagtaaaaatatcccttaggaatgaaagggaaatcaggacgttctccaatgaagaaaatctaagagaatttgtcaacagcagacctatcctagaacaaatggtttaaagaagttctttatatagaggaaaatgataacagaataaatcttggagtgccaggaaggaaaatcaatatgcaaaactatgggtaaataaatatgctctccttcttatctgggatactctaaaccatatttgagggttgaaccaaaaattagaacatttgtttgatgtggttctatgcatctgctggaaaaatacttaagataattataaatgggggaaggtaaagggaagtgatgtttttacattcactagaagtggtaaaatggtgacatcagtagactgtgatagttatgaatatattatatagcatctagagaaattactaaggaaggttacgcaaagacataaactaaaacactatagatatccaaaataggaatagtaccattttataaaattttagtacaacatgacaaccaagatactgtaattgatgtaatcatgatataggatatttctatccacacaaagatctctcatgttgtccttttaaagccatactcacttttctcctgccctcccctccttaattttcagcatgcactaatttgttctgcaattctatagtattgccatttcaagaacatcatgtaaatgtgtactaaaatacacaggatccctctgtattctttcttacaactacatgactttaattatctcaaaataaaatgtttaattaaaataaaagaataaagctaccagcaacaatagcaacccaaaaaggacctttaatgagatggacaaacacacatgtcacattaattaaaatggtccataccaattttttaaactgtaagaagtgatggcaagttgataagaatttacaaggtttttcttaactttgtattttccatattttaaaaggtgacattcgtaactagaaaaattgtaccctaatgcattgaataggcccagccttgtaaggcagtggaattatttagtggaattatttagcgtagctaagctaatgatacacaaagaatctggtcaaccatggcatgcgtttgggtccattgctaacaaaaggagagtcagttcccttactgtttgtaaagcacctgccagaggaagggcttatgggtgtcagtgctgccatttgtatatttctgctttattacagcactagttcattaatgaggccctgcaatgtcctgaatggacacctcacagaaggggagctgctttttattttatcttcctcattagtcgctggcgaatgtggaatacatggccatacagaaataaaaacacattttaatggtcttaccttgctcttaatgaagacttaggcttgatgccagttcgcccttcatagcaggtatcctttgcccacgatgggatatagcagcgcagtcattccacacaaatggactttaggaagagcttccacaatacaggtctggagtatgttagaactcagtgaagaaagattcaaatttgcttgaagttctttttcataatggagtgggctccttggagaatgaggaatgggattcgagttttattggtttaagcctttaagaaactttgcattgaacccctctccagctttccatgcccacctgcaactttctttgtcagcaattaacctgcacgtgtgctttaaagtgaagtaatttcaaactccatcagttccttggttctcatctcagtctattccgaatctggggtgtctctgtgactgctacacatactggagttttggggtttgcaaagcccttccagatctctcgtttcccatgtactcaacacccttctgaacccatctgaaaaactagtctatcagggaagcttgaccaggaacagacttcaattggacaaagttcaattgaaattgccacttttgcaggttaagaataatccaatgttggaattttaggtagctctacccagcggttctcaaccaggggcgattttgttctccctggggacatctggccattctagagccatttggggttgttacagtgaggggttgtggggatggcactggcagttgatgggttgaggccagggatgctgctgaatatcctacagtgcacgagacagccctagacaacaaggattcatccatcctcaaatgtcactggtgccaaggtggacaaaccacagttctgccaaatgtagcataggatttaagaacatgcagttgaagtacagtgcctgaactcaatggttttaccacttaatttctgtgtgtgcttgggtatgttagctacaatggttataatgataatttcggactcaggattgtagggaaaattaagtaagtaaatacatatcatgccctttgaatactgtggaggctattgatgttggctgttattatctatagaattcttttagatattaaaaattgcaagatccattctgtgaagagggagatttgaaaagaaaaaaaaattaaagtcttttaaaaattgtaagatccagaattcacagaaaacttacaggaaatatctagattgctggagttattttaacattctgatttctgtcattgtttgggggccccaatagatttcattccctttttatgaacatatatgcatattccaaaagtaaacagttttcagcaagaagttcacaacaggtagaacacacttttacgagttttatagagaaaacactagctcacacagtaaaacaatagctttccgtggtggtgtttactcaagccccagagaaaaggccgccataccattgaaactcacaaaggctgcactccaccaaaagtgatacagccacaacgaaagtagcacattttgtacatagagaaggcgctcactggcacagtgctcgaaatgtcacataaattatgctcacacttctaagaatggatcttgaacacagtgtgtaaatatttgctggtctcccattccatgtgtctcccagcgagtctgtgtgactcctccaacctgattccttgttgtctgccaaagataagccactcgaggggctttctgctcaatttcaacatggaagaagtgaaaaagattttgcagcaattgcttggattagaaacaaagaagacagctggtgaataaacaggtcaatttttctcattaagttgtggggaaaacagtctcctgcatcctgaaagccctcctcacctttggcggggaaggcagaacaatcttatcaggtaaggtcattccagatggcaggtctgccattcctgccttgctcttcattaatccacagaggcaggtgggaggaaacccatgactgttcatcacccagacatcagcagcatcaaggcaggctgtcagcagccacgggagcctccatttcaaatccacaattcagaacacaaaaaccaggattatgctttttctttcttgtttccttcttgtttgtgttgtcatggttcctccagtcactggtgtttcgagttcatctttttcgtgctttaaagctttgttgtatctgagaaaattgcaaaggtacgttatcattgctgcatcttcctattgcttagagagctgctttatagcacaatcacaagctcatcaagtctgttggactggattctgggtgagcctagcgcctgggctctcaatcgtacttaaataaatagcaattttgatggcgagaaaatattaatataaagaaactgtttacagtcatgtgctggggtctgtttgcactgtggggtctgaacaacctaaacgggggataaattgcaagcagtctgttctgcagatggtctgcaaagccctacagtctgtttcagtcatgacaagcttcaaggacaggtgactagggtgacttaaatgaaccccttcccacaatggagttccattttcattttgtttctggccccattcagagcctttccctctacaaaaaggagctctctcccattacagaaaatgaaaagctcaagcacattctgtgtttctttctactcttgacttcccatcatacaatcttcttggagccggaggagttatttagtccaggggtggatgcactgcattgtgctggccaaatctggccacacacattcatttgcatgcctgtctgtggctgcttttcttctacaatggcagagttgagtagatgcaacagagatgctgtggcctaaaaagctgaacccatttattatctggccctttgcagaaaatattttgctgaccccttgtttcagagttaagaaaccacagacccaatggggtaagataatttgtcaaaaccatgcaggcagatagggatggagccagaagccttggtttttttgtttgttttttgtttttgttttttgtttttttatggctttgtgatggatccatgacctgctgcctgggtatctacagaaagtcagcacacatcacacagctgcacattctctaatgcaaactaacctgtaagaaacacacctgtcctatgataggccagcaagaaaggagatacataggattgccggctttgggctggggctgtttcctcccaaacagcgtttcacaccaccaattcatccacatggtgcccatctgcattaagaatagaaagccaacaaattattcagaacctgaccgacagatatgcaatgctgggctgcctggtgaatttgaagagaagacccatctgaaagcaaatatctctcattacgtttcaaatgatgaggaaaagatgatgacaccctatcatctcatgacagaagtcatcatgagatggaaaatttccctgacagaagaagaagtcaacctctcccccttctaatccaactcagtcatatagaaaagttaaatcattccaaataagttgtagcttcactctctgaaactcttcctctgagttctatgcaaactcctcagtcaggaatgtaaaatctgcccccattcaagttcattcctatctgccttatttcccactgctctctgacacacataccaggctcagagccctggggaattgcacagtcacaggaaatgcacagagagatgaccccatggaaagaaacgtgccacctagaagtcttgttctgctccagaaacccatttaatagatctacttcaacacctgcacgtccatggccttctgacaagcttcctttctttgcacgctggaattatctcctttttatgcatttcatttttgaagactaccccaaacaccactgcccttaggaagtcttgtgcaactactggactgcttttggttatattcctctttaatccatcacccaatatagaactttgtgaatatctcttttggagcatgtccgcaactcaaattagtagtcatttgcctctcacccattagaccattttaaaggcaagaacagttttcctcatcttcctaaccctcaccttgccttccacataatagattctcagaattgggttgtaagagttaagaaaactcaatagttacttgttggcttatgtttattgacatcacagatggatctgatattgttcttctttggcattaaactctccggatcatgaaatgtgtacataaatgacttaatacacagaattactcaaggccagggattggcagacttttctgcaaagacccaggtattttaggcctttctggtctctgttgcaaacgttcaactctgccgttgtagcattaagggagccacagacaatctgtaaatgaatggctgtagctgtgtgtcaataaaactttatttataaaaccaggtggtataggttggattcagccctcaggctgtagttttctagtccctccaaaccctcaacaaaaagatcctgcaccattctggtgatgcagaaccaagtgaaatgtggatggaaactaccttgacatttgttttctattcaggaattaaaaccacagatgttatttttttccctcagtaaaatctttttaaaaaacgtttggggcaatgccttgtatcctaatcacagtgcacatcactcctcttgcattcatttgcttttgtctcctcatttattagcacaatttgcttgtgaatcacttgttttatgtagcagttaaatctagggaaattaactgaattcagaaatgtgggcttgggctggaaattcttttttttcctatattacaatgaaataaatttttcctcagttttccaaaataattatgttaatcaattcctgagtcttcagcagacgtgaaagctaagggcacctttggtttaaggggctacaagcagagtcagcagctcatctataaactcatattaacagattgagacacagaacagagaaaatcattctccatcacctcaacactataaccatattcatctttcaactctgaggtccccatctacctaactttttgaatagattgcaccagtttaaaaattatgttgatatttccagccattcccagaaaaacaaatttcagtatggattatctgactttcagagaaatacagacaaggaaaaaaaaaaaaaaagaaggtcaggcacagtggctcatgcctgtattcccagcgctttgggaggccgaggtgggtagatcacttgagccaaggagttcaagaccagcctgagcaataaagtgagaccccatctctacagcagaaaattaaaacaaacaaacaaacaacaacaacaaaaaacccaggacattaaggttgtagtgagctaagatcaagccactgcactccagctggggtgacagagtgggactctgtctcaaaaaaaacaaaaagacaaaaaaagacaagtctgttgatctgattagaagggcaatagttgaagctttttccacaagttcacaagctttctttttcatctggatagctttatttagtacagtagttaagtcatctcaggatatatttgaaaatcacatcttaaagtttttctcagacattagttgagacaaatgtaacctggaaaatttagatggaaaagttcacggtgtttggagatgagtggaaagttgggaatttctcaggaacatgctccatgttggttgtgctgtcttggcttttcaagttactctaactctgaggatgaaacttcaaaatctttttggtctacaatgaaaaagagccatgctatcaggggactctgcttcttttccacattttctcttgctttgtgatacaggtttcagtgaaatccactgcttcacactccatctttttgggtactgaaatttagggttgcccttaaagtttcaccaaattcaagataatttctaacatttagttgaggcttggtgggcccagaagatcctggagctgcgtttcccacattgtactttgcagatcactagagtccgtcagggtcatgaggtggtcctttaaaaggagtttcctttttcaaatagtttgggatgtgattgcacagcaaaccagacaatactcagtggagagttgctgggtccaggtcgggtatgagacagaactcaacaccagaggcaaagcttggtcatgggaccaagttgaggagtagctaaaacagggccaaggcagaagcaggtttccatcagacatgcccaccattgtgccatgtcagttaccattgtcacggcaacacccaggagtttccacccctttccatggcaatgacccgatgacccaaaagttactaccccttccctagaaatttctgcacaaactgccccttaatctgcaggaaattaaaagtgggtatatgccaggcactgtggctcacacgtgtaatcccagcactttgggaggctgaggtgggcagatcacctgaggtcaggaatttgagaccagcctggccaacatggtgaaaccctgtctctactaaaaatacaaaaattagccggatgtggtggtgggcacctgtaatcccatctactcagcaggctgaggcaggagaatcacttgaacccaggaggaagagttggcagtgagctgagactgccgctgcactccaacctaggccacagtgggagactccatctcagaaacaacagcaaaaaaagtgggcataaatgtgacactctctgcctacagtgttatcccgttctgcaggaaaagtcacagagctgtaacacagctggagctgtaacattgcttcttcaataaagctgttttcttctacctccagcttgcccttcaattatttcctagacacagccaagaaccctcagggattaaaccccactttgtggcttgcctgacctgcatcatgggaacttctcaaagatgcagagagatcctgaaatatatgactatgttttaactttcttccaaccaacattttctaaaccacttggacaatacaagccatttgtctcagggtgggcaatagtacctcagcaacataacgtttcctaaaacacaatgatggaaaggctacacaacctctccagtgctcctgaagctttgttgcctatgtcaacctcagggatcttatgaaaaggtaggtctcagttacgaggtcaagggtggggttggagagtctctgtttctgacaagctcccaggtagggttgctgtggctggttcatggacacacagttagcaaagtgctaagaatccagccattgcaattgatctttccatctttccaagctcccttgtgcttcactgaaccacaccaaataaacactcagtgttattcagcctttgcgactattgtttgaaatcctaccagatctggggttttaagtcaagcccagctgcacattagcatcatttgggaggctttttaaaaagatgaatgcctgttctccaaactatgatatcagaatctcttgagggtgctgtctggacattttaaaatattgagacaaaatgtacataacattcaattaactgttttagagtgtacaattcaatggcttctagtactttcacagtgttgtgcaactatcacttttttctttaccccaaaaggaaacccagtgcctgttagcagtcattcctcattccctgctcccatcctcagaccccagcaatcactaatttactttccgtgtctatggcttttcttattctgaatatttcatataaatagagtgatacaatatgtggtcttttgtgtctagcttatttcacttagtctaattttttaatctatattgtagtatacactagtagtttatttctctttatggctgaatactattcaactgtatagatataccacatttgtttatccattaatctgttgatatacattttgtttgtttccaagtgtgattattgttaagagccctgctattaacattcatttacatgtctttggatacctgtttttaatcttttggggcatggatggatagatagatatagatagatagatagatacacacatatacacacacatacacacacacacacacacacacatatatgtatataaaatatgcctaggagtgtaattgctggttcatatggtaccatagactgaatgtctctgtcctcccaaaagtcatacatacgttgagatctcaacccccaagatggagctataagaggtgacttagatctttgggacatgatctaggtgatgagggtggaggtgatgagcggtgatgagggtggagcccttatgaatggaattagtgtccttatgaaaaaggccccagagagctccctcacctcttccaccatgtgccttctccaccacacagcgagaaggccccgtctatgaaccaggaagcgggttctcaccaggcactggatctgctggtgccttgatctttgagcctccagaactgtgagatggaaatgtctactgtttataagccacccagcctatggcattttgttatggcagccagaaaggactaagacatatggtaactccgttttcaccttactgaggaaatgacaaaccctttctcacggtggctgtgccactttacattctcactggagaacgtcactggacatttatacctttttaaaggttccccattgagtgcgatcaccagcaagtgtggacagcactatcctgcaaccaaggacggccttattcacacacttaatacacatgtatttaattcaatggggtgcctgaacccatagcatcaacattacctaggaacttattagaaacacagtttctaggtccagcatggtggctcatgcctgtaaaccaagcaccttgggaggccaaggtgagcaaatcacttgagggcaggagtttgagaccagtcttgtcaacatggcaaaacccgatctccactaaaaatacaaaaattagccaggcatgcagtgggagcctgtagtcccagctacttgggaggctgagacaggagaattgcttgaacccgggatgcagagtttgcagtgagccaagattgcgccactacactccggcctgggtgacagagcaagagtccatcacaaaaaacaaacaaacaaacaaagccacagtttcttggtccccacactggactgactgaatcagaaactctggaggcagatggtggtcactacctattttatcaagccctccaggggattctaaagtttgagaactgatgctccacatataattttataatttgcaatagtttcacttcaccctatatcatacgcactttcccacatcctgtactattatttgaaaacacagtttaacatctacttgtaatcttttaatataaaacaagcccactatgcacttaatcattatatctggggccatttgatttttcccattttttatgaaatacaaataatactccatgaatactcttgacaataaatatttccacacatctcggaatatttccttgagttaaattcagaatcataattaccaaattacagcgtttagacatttttatctttatgctgtgttggccacttcattggatctgagctctttctgtggagggaaaaccaatactttcattcatcacaaacaaggaagacaatatgggttattggctatttttattctattgcaaatattgctggatcaccaattctgggttaatttttctctcaatccaggagaaatagatgctatatatttccagtctcactgcttccttgctatttatgatgctttgcccagctttttaatttatcagtcctcagtttctgtacctacaccttaagggtaaaaataccctacctacttagtggtatagataataatgatagaacttgtgcagaaagccctttgtaactgccgagcacaatacaacatgtgagatatttttataactaggctcagtgctttgaaaagttcactcccagaggactcccccaatagaaatatcctcatttgctttgagccgtggctttcatcagcctgacctaagctgtattatttgctctgaattctttagggatctgcagaagctttactattcacatatgcatattttgcaactgtatgaatgcactccttaaatttctgggagttggttcaccttaggcagaatttgtaaatagtatatttctggcttattttctatttcctttttattttaagccatgtgccgattccattgcatccatctttacagagcttgcctcaaatcctttttggggaagaggcaatagagaaacagaaaaacaagtcaacaagcaagcagatagatacagtagcacactgtaggatctatttgatacttcctcttcctttctgaacctttatagcaaggtctatacttacatggaaactttaaatagaaactatgacacctacccggaaacaggtaaggctatccattttcaccagttgactgtaaaaagcctcggttttctgtctgaattaggaaaatttgtagactttgagaggtgcaaatgagcaatagtctactatagtgctgctttaatagcttcgaaagatacctgtccccccgccacgaacccaggctacaagtactcttttttccagtaaagatgcattttgaaaagactattccgaggcagataagagaagctgttggcatgttttaatgagggaaaatgagaagggggctgtggaaacagctcgacagactgctcatcagagcagaaggaagcttctatgcctttttatagacacgctggcccccttacgtccctgaaatattctctctccaaagtttcaaaggtaggacttgctaagcgggcagtcccgaaagggaagtcttggaaacaccctctatctggaacaggacctacccacactctggtaaagaatagggtatctatacatccccaacgaagaaactgagctgaaaaaccaggatgacgaggcatgcaaatctatttgcaaccttgggccaagctcccaaggccagccaccctgagcattgctgctttgccctctttgatttccagggaattaacactcctcaagttcccctgcatgtcacctgcagcctgggagaaacatggtgacttggggctccctgcaagacacgggatgtgtgattcagccccttttgatgcagtacttgaggaaatgtcagggagcagagagtgaataatcatttgcatccagagtgccgcaggcagctctccaagagggagcccgcagaagttgaggcttccgaggaggccggggacccctgtttagttttgaactcagcatggggggagaaagagagatagagagagaaagaccatttcccacagagccgacaaatgcagggttaaataaaaacagtggtacccgtggaagaacggggagagcgtgccagctggagcctttatttcatgttaatcattcttgtagttgctgtagcctgagaaagacacatttgttatgcagacagtgttcgttgtcaaagactgatcaagaatgcaggagtgcggccacaaaatgaattagctctctggataccaaatgggaaagccaattcgaaccagagcatggcacaagggctccagcaggattgaaatatactaggtgcgcataagagcgagcattgtgaccactgctaattatttgctatttttagcacaggcaatgagaaagcaaagagcagggggaggggaatgcggcaatccaacaacagggttcattcagaacgccgccgggggttcacagacctccgtccatgtccacttcccatgctccagaatggcctttatttttaaactcaataatttttcattcatcctccttgtgaatgttaggaatgtctgcagttctgagcatgccacaaaagaagacctgtgctgtgccgagggtatgaaagcaaagcagtgtgaaagcaaagctttgctgtgccccagagagaaacagaacagaaggtcccaataaagacagagggtcttttctaagtgggcacccactgagcctgtcgaccaggagagatggtcattttctgtgcttgcgttgactcacttctacattcttggacttccaaccctaatctaaagctcagattccaagcgtttcaactgcccttggaccaggcttactgacaggtagattacattaggtttccccacttgacataacggcattgcagcttaaggcatgaccatggagctactctattgtcaagaaaaaggtagggtgcagtggctcatgcctttaatcccagcactttgggaggaccaagcgggtggatctcttgagcccaggagttcaagaccagcctgtgcaacatagtgagatccagcctttaccaaaaaaaataaaattagctgggtgtggtggcatgcatatagtcccagcttcttgggaggctgaggcagaagttcacttgagcccaggagtctgaggctgcagtgagctatgttcacgccactgcactctagcctgggcaacacagagagaccctatctcaaaaaattcaaaaatgaaaataaagtcaagggaaagaaaactctccctcttgaagttctatagcatgttcttgtacttgtatcaaaaatgccattaaaaagaaacaaatatagatagacacattcttctctttaaaacctcaaaaatattaggcatattcagaaaagcaaaggaaaaaatcctttgtttgtgtatatatgtatatatacatattgtatatatacacacatatatacacatacacacacatatacacatacacacattcttgatcagcgtcacatatgtatctatgaatatgtgtgtgtgtatgtgtatatacatatatacacacacaaaagactgtataatctatattatatatataattcttctgaattatccatttgaacttttaagatcccatcaaaccacaccatgtctacactacttaagacatgatttaggctcacagacttaaactacagagtgtttaagtgtatacacatatatttagatatagatataaacattttagtcagtcaagacactgtatcactgaaaatagctccatggattctcaccaaataaagaaggcagggataggctggtccaatacaggcttcatggtttgcatggaaaagacaaatgatcatccctcagaacagccaaaaagttgatttgcaattgagatgctttgcacctgagtgagtcctcatcctaggctttaaggcgtgtagcagcaggaactcattagatgcatgatggcgaatgaattccccaattatctcatctcaggatgagaggctggctggataaacatgtacacacacacacacaccccaccaccgccaccaccaccaaaaacaggccgggtgcagtgcctcacgcctacaatcccagcactttgggaggctgaggcaagcagatcacttgaggccaggagttcgagaccagcctcgccaacatggtgaaacctcgcctctactaaaaatacaaaaattagccaggtgtggtggcacacacctgtaatcccagctactcaggaggctgaggcaggataatcgcttgagcctaggaggtggcaccactgcactccagcctgggtgacagagcgagactctgtctccaaagaaagaaaaacaaaaacaacaaaaatgcaagtaagagggaggacagcattataatattacctattaggatgaaatactactcattggccaagctacacacacacacatgcacacacacacaacaacaataacaacagcaacagcaatcacatatcacaccagcaatcacatatcacaccatggcatgacttggtggtaaaagatattcattcatcaaacttttatgggtctgatattctaatatgtccaggtaatacaaacttgattcattctcaagggatacgcatctaaaaggccatgggtcacccattacggcactctttttttatgatcattctgacatgatcaatctgtgtcacatgatgacttcttgggataaagttacatgcaacttctccaaaacactttttccctcccaattttggacccagagatgaaagtaattcatggacaaacaaggaacaggtaggttcctgcctctcagaatcctctgaaggatcaaaggtatgtttttgagctgcctacacctgaaatcctgatttggcttttgattctgttttcagaacagaaagtgcatgtcatggactccatagaagtctctttctggggagtgctttaatgagcctaagtaaatcctttgcctcctttgtaaagttccaggagaaataattccactagggaagtagttctcagagaggggatccttagcaatgcctggcaatactttaggactttcagagttgttagattattggaggatggattcagggatgctactaaatatcttacaatgcacacaacagagaattatgcagcctaatgtattactaatgccaaggctgagaaactctgttcttttggtggttatgtacctgagcaggttgggtcatacctgacacagtgttgcctggatttggcaaacctggtgaagagaaacgcttatcagagtccttttctcaagaggatttttttttctgaattatccatatgaacgtttaagagcctataaaaccacatcgtgtctacactgcctaagacataatttaggctcatgggcttaaatcggagagtgctagaaatgtggacataactcctggaaacacggatagtattgggtgctcctgggttcatgccaggccgggaaattccggtgccctagtagttgattctcccttttcctttctaaatacaaaccccgcctgtgaacagtacagctccatccctggatacattttaaaacacatctaattgccgggcacagtggctcacgtctgtaatcccagcactttgggaggccaaggtgggttgatcacctgaggtcaggaatttgagaccagcctggccaacatagtgaaaccccatctctactaaaaatataaaaattagctgggcgtggtggcaggtgcctgtaatcccagctactcaggaggctgaggcaggagaatcacttgaagccaggaggtggaggttgcagcaagcagaaatcgcaccactgcactccaggctgggctacagagcaagactccatctcaaaataaaataataaaataaaataaaataaccacatctacgatttctgacaatactctgggcacatggagcaatggcctccaccatacgattggtctcccctgatgtccaatcttccaaaacccaacagcctgtctagaagatgtcagtcacttagacatctttaaaaatgtctgaaaagtaacacttgtaggaactttaattaatatattttctctgctttgtgtgcaatgaagtgagccagcattttcaaaggaagagattcagttggttcaccaggaagtctgagtttgccttatgagaatgagatcatttctccgtgatttctctcctgctgcaaagaacatgggcatcttttacaaacagattggcctaaggtcttgcacatattatcatactcccaccctcacgcagcaaaccggagcggctccatcttgagtgagggctaggaaaatgaggctggaacttgctgggctgcattcccagaaagttaggtgttcctagcctctagatgtttacagttaagggaacagatggataatgtttagtaaacagacccggaattgggagtgtccaatatccctatatcttgagaacagaagcactcctaattttgctttaaagataataatattgattcttgcagaatgtagtaataaagaaaattaatcctttatcacaaacccttgtagcagagcacttttccccatgatcttttttttattttatgtataaacaagttttgtacctaccggtggatgcgttcctcctctagctttcgggaacgccctgctctgtctatggagtagctgtactttcaccactttactctgttaataaacttgcttttgctttgcactgtggactcgccccgaattctttcttgtgtgacattcaacaagcctctcttggggtctggatcgagacttctttcctgtaatggaaggatttagtgaacactggatttcgtgagtcccgggaaggagtacacactaatcaccagtcaataattaggcaatgaacacgagtggtgatgttttcaatttgtgaaaaattaagtcatgaatggacttttaatttgtggaatattggagataactgtgcttttcccgttaggactcagaagtgaattgtattaatcagggttctccagagaaaacagctatttataaagagagagatatataagaagagatttattacagaatttggctcatgcagttgtagaggccaagaagtctcaaaattcgccatctgcaagctgaagaagcagaaaagccaatagtatgattcagcccaagttcgaaggcctgagaatgaagcgtgccagtgtccctgggcaagagaaaatgggtgtctcagctcaagaagtgtgagcagatttattcttcttcagcttttctattccacacgggccctcaatagattggatgatgcccatctacataagtgaggatggatcttctttcttcattctcctgatttaaatgctaatctcttctggaagcgcagacacaccccaaaatacatttcacagctgtctgggcatctcttagcccagtcaagttaacacataaaactaaccaccatgcaaattgtctctgttttttagtttagatgccctccagcagaagttttacaaatacattcacatcaacatcttctggtcactggatcatgtacacatcattcgagtctaattgaggcttgctgttcatttcttatatttgcaagcagggtgcaaatgttgtttgtgctttatgctgcttggttgtgtgcattggattatacaaacagacattatgggacacatattcattctcagcaacatagatcctggatgtcagggctggcatccctccagaattaggtcttactcctagaacatgtcaggaaactgatttactagatctgagagggtggagagtctaccgaagggaaaccagctttgaagcattggcaccatcagcaatctttacccaaggtgcaggaattacctgttcatcttcgttgtcctataaattctgtctcactcagcatctgaggggtatagccacttctttagtctctttgacttgagaaagctatttcttagtcaacaataatacagacttgcttcctgacgggttgtcaaaatcctccttaacatgttatctatccaaacattgtcctagttaccctgactccttggaacactgtttttgtcagatcaatgattaatcttcgcaagctgcagagtgaaaatgaatgtgcaacctgtgtagacaagcctttcattttcaacaggatcataaatacctaagaaggtctttgtagggtagcaattgcatacaccataatgcacatgcaaggatgggcaaggaacatgaagacaaattcagggaaagaattaaaggcaaaactcaaaacccccatccccacataacccagtgcaatcgctacacagcatcttcagcaagccctaaccagaaccctgaatctttccacgacgttatcttttacatgatttccatgaataactaaatttaattcccctctcagagacgcacgtgatcacattgactgtcatcctttgaacacatcaatgagtaattcattatttctgattcgatttgattctggtaattccctaaaatgtgttgtggcttatagtcaccaccagctagttttggaagtagttctttctatacagctgcctacttaaatttactgaatcaaactacattgcattatctgtgattttattttgtttttaagattcttctattctgcaaatgctttccatacaggtaagaaaatccattagctaatttccttactacccagggattcgtttccaagagatttcacatttcaatgtttgaacattcttcttcaaattatatttcttttttaatggttttcattttcatagaaattgacatttcttgcaccttaattgtgttatctccccggatggcattccaatcttacacatactttgcgcgttttctatttcttcccattaaaacataatcattaggtaagtttactataagaaaaaaaaaaacactttaattcccttttatataaactggtgctttaacttaatttttcctaaatatgttccaacaagcagtgagcagtatggcaaacatattatataatatgtcactctcatatcttctctatccctatcaccactaccaaaaaaatcccagcaactttataaggaagccatttgacatgtaaagacaaattgggcagcatttgttataaacagatatgggtttgatggcaaggcattggtagggccctggattcttgcccaatgtatgcttttctttttcaagttaatgagaggctttctcttccacttgcattgaggtcctgtatgatggaacctgaacataccatgctcattcttgtctgagaaatgactcaggtcatttctctctaaatttcaactattatgtaaggtctccaccaagcccaaccacctccagtaatactcaatgtgctgttctctctccttctaaaacctcatagcattgactctataggtcacttgtggactcatttatagtcaactcagtgccatttcactcttcattcacttcttcaataactatgaatcatccactaggtgcccaacagaatgcctggcaccaggaacacagaagtgggatagacatactcagtcctgggtcttggatttacaaaccctgaagcagaatcagaccttagcaaagaaacccacagggtatctgtttttttagtatcatgagtcccacatgaagaatagtagtatctcagttcaagagacctgtcttacacagattacagccctctgagtgaaattttcagcagtttctcaaaaaaataaaaataaaacaagaagaaaagaagaaaaagaaaccctctgaatgaatgttgtctgttattttgtatggaatccctcttctctgcaatagcatccactctttcggggcattgtgttggtaacacgtcttagctcagatgtcaggtattgcaaacattctatgctaccttgagtctttgtattttcaaactttcaaaagtttaggagtgcacatttcactcttctgagcatcagattaaactatccaatctgcttgaaaatttgggcatctctttttcacccatccatatgaactttcctgcctctttttgcttatagctggcattgaattacatccatcatacccctggtatttgttccacagtaccttataaaatattccatcaccacattctacatctttaaaagtcaatggaaactttttctatttctttcaaaacccatgtttatttgtttgtttgttttttcaatattttcctctttactgctctgggaggcatttccagagatccttcgatccttcatgttcagtcttgaacttctctttctcctctctctgtcactctctgtctctccccccaccccccgacctttgtctctgtctccggttgatttattaatacattggaagatttgaacaatggctcaccagcatgtcactggttaaatttcccatggttcatgaagtctgtgatttcatctcagtagacagagctccgaaatgatttgagggccactcaaaaatccattaaaaattaaccaaggaatagtcagaatcttgaatagcctaaaaaaaaccccacaatatcaattatgacaagagaacataaaattccttgcttctattaccctcaaaacatgtaccctttagaccttgggctagctgctaagtagaagctgaaacatctgtgtctctgctattggtagctgtgtgcattggtacagatcacctagcaaaatgcattgcatgccaatctctatttaggcagacacccagcgaagagggtcgttgctatgccattgctgaagacaattttcacatttctctgtctcttgtcatattgtgttttgcttttgtgctttctgtgctgtagaatattatttttaaaaaattcggtggcattactgctgaatccaatccaattgatacaatccttaatgcaactgtaggtaattatctttccctggcacatttttcacaatttcctgatgttttatagcacaattacttgggaccaaaatttggaacataatttcttatctgttgaggatgagacactgtggtcattaattactttcttttaaatactaattgacttttatacttgaacttattatatacatatgggtaaattgtttgcttttattttaagctttgaactcaaggattatctttgtagtcactgccaaaagcttagaaaaatatacattcatgactgctaaagcagacccatataatttctgacattttggctgtaattttgttcccaaagcctctgcttagtaaagaaaaatactaattaatatataacctcaaattttatgttcttctatttcataacaaaagatttccactgataattgttcaaagtgtcggggggagaagacaatggaaatgatagagaaagtctctctcttaggagacccccaaattactatggtttgacttaacaattgttcagtgttactgtggtgcaaaagcgagatgcattcagtagaagccataccttgagcacccacgcgaccagtctgtttttcactttcaggacagtattcaataagttacataaaatagtcaacactttattataaaataagctttgtgctagatgattatgtacaactgtaggcaaatgtaagtcttctgagcaagtttaaggtcagctaggctgagcaatgtttggtaggttagatggatccaatgcagtctcgactcatgatattttccactgatgatgacaggatataaccccatcataagttgagaaggggctggctgtagtggcttacacctacaatcccagtacttccagaggccgaggtgggcagatcccttgagcctaggagttccagaccagcctgggcaacatggcaagatcccatctctacaaaaaatacaaaaaaagtagccaggcatggtggcatgcacctgtagccccagctacttgggaggctgaggctggaggattacttgagcccgggaggcagaggttgcagtgagccgagatcgtgccactgcactgcagcctgggcaacagagccaggccctgtctcaaaaaataaaataaaaataagtcgaggagcatctgtacattgaagcagaagaagacaaaaaacaagtaaataggtatatttttaaaagttagttctatcactttgctatttctcttgaaggggaaaataaatccacaaaacgaaataaagggtcacagtgagtaaggagataaatgtggagggtatagtctcgacaaacgctcagggaaagtttctttgagagatgatacctaaaccatctgaatagtggaagagccatgcagatgcagagaaggtggatttgtcagttaattaaacagaagagaccgggcgcggtggctcacgcctgtaatcccagcacattgggaagctgaggcaggcggatcacttgaggtcaggagtttgagaccagtctggccaacatggcaaaaccccgtctctactaaaaatacaaaaattagcagggtgtggtggcaggcacctgtaatcccagctactagggaggctgaggcaggagaatcgcttgaacccaggaggtagaggttgcagtgagccgacattgcacgactgcactccagcctgggcaacagagcaagactctgtctctaaataaataaataaataaataaataaataaataaatagaagaagcaacagtgcagtccaaggctagtgagcaagaagagtagaaacagatgaggttcaagccataggcagggaatgtgggtcactcgggaccttggggtcttgagaaggaatttgcattgtgtcccaagtttaatgggaagctgttggagggttttttaaaaagcaggtgtttcttattgccaaaagtgactgagtctgcagtgtgaacaaataaagaagggaggatgagtggaagcagtgagagacaggccaggaataagagctcatggcccccaagctggagcgctgatggttagctagggagaaaataggtagggcagcacaacctgagcatcgattggatataggatgtgaagggaaggaaagaaggaggaaaaatcaaagaggtggggtagaagttttgtttatttaagatacctaggtaggcagatagataggtaggtagatagagagatagatagatagataagtagatagatatagatagagaagatagatcatagagatagatagattatagagaaaaaagacgattgatagatgatagatatatatcagcaaatagagacagaagatatatagacagatgatagatgatagatagagaagatagaacatagatagaaagagatagataaatagatcatagagatagatagagtagatagatcatagagataggtagagaaaaaaggtagatgattgatagatacaagatagatatatatcagcaaatagagacagaagatatatagacagatgatagatagatcatagagaaagacgatagatgatagatatatacagatgtagataggtagatagagaaggaagacagatgacagataatagacagataatgacatacaaacatacatagatggatagaatgatggatatgatatatagatggagaaggaaataaaaatatttcacctcaaaatacactcagaggaatttgtacaaaaatgtttacactgactttataagtataataatcctaaattgcaaacagtccaggtatccatcaattggagaatgatcaaataaaatgtgtgtcaatcctagaccagaatattatgcaaaaaataaaaatcaaaaactactggtatgcataacaatatgagttaatctcaatcatcttatgctcagacaaagagccttacacataggatggccagatttagtaaataaaaattcagagcacctgagtaatttggattttagacaggtaatacatacatttcaacatatgttctaaatatttcctggatcagacttatactaaaaatatgcattgattatctgaaatccacatttaactacacatagtgtattttatctgacactccttcaaataaagtgtataactccacttatgtgctaactcatggtggaaaatagttaaacaatattcacataacaggtggggcacaatgattgactaagagacggcatgacggacctttctagggtgcttttcatggtctacatctccatagggacctgagttacacacatgtgagcatttgtttagcagatgtagacttgagatttctgcattacattgtacgtaaatttacacacaaaaagacctgtaaacaaatgtaaaattctagttaaatataagcttggtggaaattttggggggagatttacaggtacttgcaatttatcttaaaatatgttaatgatggtcaatagataaagttgtggaggattgacacaagaatatatttgttggccagatgtggtggcacatgcctttaattccagcactttgggaggccaaagtggaaagattgcttgtttccaggagttcaagaacagcctgggcaacatggtgagaccctgtatctacaaaaaacaaaaaattgactgggcatgatggcacacatttgtagtcccagctacttgggaggctgggatgggaagcgtgcttgagccagggaggttgagtctaggtaacagagagagactctgtctcaaaaaaaaaaaaaagaagaaggaaaagaaaagaaaaataatatatatgtgaaaaagtataatgtgttaggcagaataatggtcccttaaagatgcccaagtctgaatccacagacctgcgaatctgcaaagagtaaccaaggttatgaaagaaatggaaattgctagtcatctgaccttgagatgaaaagattatcttggattatccaatgtaatcacatggtcactaaagtagaagagggagacgggagaggaattgagggtgggactctatcaacttttctgctttgtgggctttaaagtggaggaaggagcagtaagtcaaggaatgcgggatacttgtagaagctagaaaagcaaggaaatagattcttccttgagtctccaaaaaggaacacacagccctgctagagctgtatcagaattcagacttccaggactgtaagttaataaatgtgtgttgtttagccccaaagtttgtggtaacccaagacagcagcaatgagaaactaacacatttagtgaaacgctaacagtagaattcaggagacaggcacatagctgtttagtggacaattttttcaacttttctggatatttgaaaatttttataataaaatgttgagaaaaacatttgagtgggagtgggactcaagtcatcaaataaataatggagagaatgtcatgctgtggtacgtaggtggccagtgttgtgcacagaggtctcctactgcattggatgaatgagaagagtcagcaggctgatttcaagcctatgtgaagtcagcaaattcagagaaaggtatacgtgggtctaagaccttttggtgacatagaacaaaataacaaggagggggaaaataatgtgtacgttcttaagaccaatagagtgaggttggccaagcacatggttggagttacagcaagggaacagaggatcccactgaagctgaaacgtatgtaccccctacccaagttcccaggcagcagaatgccctcaccatccatgctaattttattttataatgagacagggttcaggacacacttcccccaaatatggaaacttggcacttgggaaaacagcagaagccggccatagatactagaaaaaacttcacccacccctcctcaaaagttgcctgaagtgggccataaaacctagttgaccttcctctgaaaagaggtcatgactcattccaaaggggtcctccctatacccagagtaaagaaatgtcctgtctgaagacacagggaggacaagatgaatgtcaacaaacaggctttcctacatttcctcctggtttactcctattagatcccaccgcctttgtccaattatacttctatacaactgttgctgcttaccaaacctaagcattaaaatggacagtttttcctgtttctttggggctttgtttctgaaggttcccatgtcatgtaaaacttacattaaacagatctgtctgattttttcttgctaatctgatttttgttataagtgcctcagccatgaaccttgcaatgggtgaaaagtcttttctctcttatacacacggatgtgaaaataggacttagaattacacgtggttaacttagcattgccagtggtaacagcctggggagaaagttgaggggcataggcccatttgacaggaatgtaactgtctcagtctgttcgtgcagctatagcactcactctggactgggtaatttataaagagtagaaatttattgctcacaattttggaggctggaagaccaagattaagcagccggcagacttggtgtctggtgagggctgctctctgctccctaaatggtgccctgtagctgtgtcctccagaggagacagactattaggttggtgcaaaattaattgcggtttctgtcattgaaagtagtgacaaaaatcgcaattgcttttgcaccaacctaatatgtcctcacatcgcagatgggacaggatgggagaaaagggataagcttgctctctcaagcctcataataagggttctaatccccgccatgaggatggagctcacatgacctaatcacctcctaaaggcccccatctcttaatactattgcttaatagtgtcactaattgggaattaactgaacgttaattgggaattaagttccaacattaatcttggaaagacacaaaaattcgaaccatagcaggagtcatgatggaatgcatttaaagtacacataaaaggattaaagagtctcaatgacatgatgcttctttcaatcaaccctggtcaagcaaagctgagcaatacagaatgtagtttcatgtccttgtcactttgcctgcatccctgcttggaaggaccaccatctacagtagaggcagcttgctgcttggatgcccactcccaaagctcttaaccccagccatggctaatgcctgttcagactgaggcaagaaaagacggtaaagattgctatgaggaatagaaaacaagttgataggaaaggataggctgggggcagtcttaaaccctggaaacctcagaagtatttaagaaaagacttgaaattggctggacgttaaatatatcatttgatgtaatgggaccccactgtgtatgtacttcctctccttctcctgatttcctactacctattatcctccttactcccatctctctccctccaccagtgaacttggggctatcaatggaaaagactatggaatactggagttattagctacaaccagcaaaaacctagctgttagaggaaatgtttctttctctacagaagctggcttaaaaagcatatgtatattcatataggattcataatacagtcatgtgttgcttaacgatggggacacactctgagaaaggcgtcattaggatgcaaacctggatgtgataacctacaacacaccgaggttgtgtgcgattagtctatttctcctaggctacaagcctctacaatacgttactgtactgaacactgcaggcaattgtaacacaatagtatttatgtatctaaacatatctaaacatagaaaaggtacagtaaacatatggtaagaaagataaaaacggttcccctatatagggcatttgccatgaatggagctcgcaggactggaagttattctgggtgagtcagtgagtaatgagtcaatgtgaaggcctaggacactactgtgaactactacagactttataaacactgtacactcaggttacatttaatttacttaaaaaacacttttctttctttaattttttttttttttttggagatggagtctcactctgacgcccaggccggagtgcagtggtgcaatctcgggtcactgcaacctctgcctcccgggctcaagcctcagcctcccgagtagctggaattacaggcacccaccatcatatccacctaatttttgtgtttttagtagagaaggagtttcgccatgttggtcaggctggtctcaaactgctgacctcaggtgatctgccaccttggcctcccaaagtgctgggattacaggtgtgagccaccacacccgacctctttctttaataataaaataaccttacttttctgcaatttttttactttataaactttttaggttttttttttttttagcttttgactgttttataaaaacatagcttgaaacacaatcacatcattcacatgtgtgaaaatcttttttatatctttattctataagctttttccatctttaatttttttttactttttaaactttaaaaaaaaaccctaaaacacaaacacataactttgtctaggcctacaaagggttgggattgtcactaggcgacaggaatttttcggctctattataatcttaggggatctgcatcgtatatgtggtctgtcactgacagaatgtcgtgacgtggctcatgactgtaattgtatttcattttgctctttagttgggatcctttgtaaagtactgtgaaggatctgaaatttcatcctagtttcaggctaacaagttagcctgctagagcttcattgatgttggcagaagacacaaatcctctgggtcagagacaaaagacagtttctacacacagtaatagcagtaggcagagcagccgtgtttgtgctgctttccttaactgcagttcctcccacccaccatcatgggggctgtgtaaagggctggatgatgcctgcctacagtggattgcattacaggagatgaaccctgtgcttagggacctgacctgaatacttatcatgaccagtaagcctacatggcctcttctctagggggagatattcattgaactggtaaataaggaaacctaccatttggcttaaaggacgacaccatttctatcttccaaggcttttacataaacacacatgcttgaaaaggatgtgcacaatacaggctgtcagcacctctggttgcaatacaggcagaaacgcaagagatacaggaaaaactgcttccttatatctactctattggactctttgaataaatgagaaaatgacttagaggtataaccaaccaagcccataccatgtcaaaagctgtgatataatgattctcagtccttccagagaacggggtgagaaacccctcatgggtgactcttcttccttgaaattaggcctgtagctatgcacatcagcagatttcactgcgagtttagagctttccagagcaatcccaaaagaaaattgatctccggacaactagcagctttccattatgaattgtcttggccatgtgaattgtgaacttaactccgaccataacctccctgaaaacaagtgaagcgcagtgattcaaaaccattagcaaccccaaacccatgtcttattcactgcactagtgtctgttttctggaccataagaaggccccaagtggacagccatgattgactatgcctatcaaatgtgacaccttgcatatcactagcgatgcatgaaggatggaaactgataatagtttgctttaattgggttctgtgcatgtgagtacaagtctttatgagcaagtgtttgtcggcaagcccctttattatgactgattatttggggctgaagttattgcttaaaggaaatcaaattacggctgaggaagcatgcataaaaggaaagatcaaagtttcccggccagtaaggtaaagcacaaacatcctaaagtgtttcctccgttgaatacttccacaaaactattatctcaacatccctactgatggcatatataatttggtaaagaattcactttgaaacaaattatattttttagtttatatctgctagaatcaccggatagtccaattctttctagattatatactcatgtgtgtgtatatttgtatatgtttgtaatctaaaatacaataagagagagaaagagaaagaaagagaaagagtgagaaacagagagagaaggctaagagagagacgtgtatgttaataaaaaacaggacaagaagccatatcacttgatcattttttaacattatttacctcatctgagttttaagaacaaaatacagcacttataaatggatgagatggggcctgaaaataaaaagtatgtatccagattgccggaaatgttcatcattgtagtctctgttgagtacatgccagatggtataatttctgatgcgtctgacagaaacaatttgaagtctactggtttagagaaataattttcaacctaagtgaggaattaacaatagaagagaaaaaaataaattgttaaatttaaaaaagaactatgttggaaaaaaagaaactgataaattaagaggctgctgttagggtacctgtgtaactgtgatcaccgtagaacattgaattgctcatgttggcagtggtatcaaattatggaagaaaatcattaggccatatggaattgaaaatttgaatacaaatgatctgtctttgtctctagcacaagaactgagagcatcagcttttaatcattatcatagctgcctctaaaatgccccccaacagtccctgacccttgctatgcatgtcctcatacagtcctctcctacattgcatcagggttggtttattggatcaataaaatattattatttgcatagtaatggtgcatgactcccgcagctaggtcataaaagagattatggtttctgtcttgctctctctcttgggtcattcatcctgaagaaagatggcagccatcttgtaaggacacttaagcagctctatggagaaggctgcatggtgaggaactgaggtcttcttccaatagacagtgaaaaactgagatctccagctaacagctacataagtgatccatcttacaagtggttcctcctgccctggtcaagccttcaaatgacatcagctccagatgacatcttcactgcaatctcatgagatgcctgagccagaaataccaagctcagccactccaggattgctgagtcacagaaaatgtgagaaaagaaatgtatgttgttgtaagccattacattttgagttgctgtgttccacagcattagataactaatataatccccaatgccatctttcacattgggaacaagatgaaattatgatgatgatagctgaggtgaaaaatttcaacatggtttaacattgatatcaatgaaattggtatcaataatgttgacctgactactttaataactaaactactttaatgattatgtataggaaacccaacagttggcacaatcccattcttccaaaatattatagccaatgtgttatgtgttcatctgttctcattgctgctaataaacacataccaaagactgggtaatttataaaggaaagagatttaatggactcacagttccacatggctggggaggcctcactgtcatgatggaaggcaaaggagaagcaaaggcacatcttacatggtgacaagaaacagagcttgtgcaggaaaactcctgtttgtaaaaccatcagatctcatgagacttatttactactatgagaatagtatgggggaaactgcccccatgatacaatcatatccacctggccgcacccttgacacatggggattattacaattcaaggtgagatttgggtggggacacagccaaaccatatcatgttacaatgcataatctcttccaaatgaaagtagtgcagtataaaatagttttgttttttcatcattctcagatgcccatgttcacatttggaaaaaagggtaaaagaaaggtaattaagggggaaaatgatgccccacagatattaaagtatattttaaagctattctaattaaaatagtttggttctgtctcatggagtataagaatatctgatatataactctttataataaagcagaaaaaattagaaataacttgtgtccactagtagaataatggttaagtaaattatgctttcaatcaaatatcttgcaagcatttaaaataataaatcatctcagcataattgtggagcagtctccaaatgatattttttttaaagacagggtctcactctgttgcccaggctggaatgcagtagcatgatcatagctcactgcagcctaaaacccctgggctcaagcagtcctcccacctcagcctccccagtagctgtaactgtaggttcacaccaccatgaccagctaatattttatttttttgtagagacaaggtcttgctatgctcccaggctggcctggaactcccagtctcaagtaatcctcccacctcagccccccaaagctctaggattacaggcatgagccaccatgcttagcccatgtaatctcttcatgtgactaaaataagatgcaaaatggatgagatatgatatgtggttaactgctaaactttaaccttcatcctttaaaacgagttcttaagttcacaatgatgtagtagaattttttctttactatggcatttgattctaatttacctgaaggatttagaggaagtgtggacccatgactcacttatgtagctgttagctggaagcctctgtttttcactgaaaaacttaagtattttagaaagaatttaaaatactcttggctaaacctgcaaaataagtacataaagaaaggtattttaagattaaatctcaatatttaaaacacagtttggagggctttaaaaaattctttatttctatatattcaaacatattaccaaactgaaagataaacagcatttttagctatcaatccaggcctgggaaaagcagagcaagactatttattttttgaaaaccttaatgggaagagagaaataaaagttgaatatacattagtaaaaaacaaaaccttatcactactctatcaaagttcgagaccagccagaccaacatggagaaacccagtctctactaaaaatacaaaattagccagacgtggtggtgcatgcctgtaatcccagctaccaggaggctgaggcaggagaatcacttgaaccccggaggcagaggttgcggtgagccgagaccacgccattgcactccagcctggacaacaagagcgaaactctgtctcaaaaaaaataataaaaaaaaaataacattgggctttaacactgtgatccacaaattgcatctagaccttcctgttactatgactttggtaactaacccagtataaaactcttttttcttcttgttagtttctcaggaaagatgaaattagtatctattttagcgagtactataacggaagactaggttttcttcactgaagtctccaaaatcctaacagacccgagctacttaactaaaatgttgcatcagtgataaattcgaatacaataggaagaattgtattttacacacatcacagatgcaaaaactggtctggcaattgacatcgccagataatggattacattttcctctttcagattccagtccacattgagactttgatatagtcctcctcagtcccgcctttcaaaatattaaataaggaatttcaaattctaatattcttatctccctcatgcaaccaaactgccataaatctgcatcccctgctatctttatctaatagaagaaatctctccattttcattagatgagaaaatgaaagaaaatgatacccaccaccaacagttcttaatattagttcctacagacgacagttattgcacttaaaaaggggctattggctctagatagaaatctaaagtgtttgttcctctgattggcccctgcaaactcttttaaaatccacttcttttgttctctgcaatgtttcggttctcaccagcactcccacttccaaccacttaaacttgattttccactgttaggtgaaggatgctcggacaacatcgcattaatttcagtggacactacattttatctaattcagcaagcaggcctctgttaattaggcctcccagcacgagtgatggcgaacatctcctctcactgtcactgatcgatattcacaactcaagccattctcgtggtcaatttcttgggcttctgagtaaaatagagggtcccattcttgttaacaacctagacttgcctaaaatcgcaatttgctcccgacttgcccgctgagtccaccagctgcatacaaatagcatctctcaatcccttcctctccatcttcgctgactacaagaactgccagaggggaaaaggattctccctgccaccacctcaaatgccactgctgccttccagctttgagtctgatggatggaggactcagcctgctgacagagcccgcgaagacttgctgtttgatcccagggatgcaagccttgtttggtgaagccccaggagaattaagtaccggagcctaatttaatgtaatactgctctgcagctacttaaaaagaaaaagaaaaagaaaaggatattgaaagcccacataattttgtttccttccagttggccacaaagagtgatccatccaataactttggggccaaatactacctgtgccaagggtttaaaaacccacacccctgggttatgtggcagaccccagtttctcctggaagatgggtaagtcgtcagagctgacatttctgtatagaaaacaatgcaaagaaacaccctcctaaactacgtgaaatacagtgttgctctgtcacttacagaaccaatgaccgccaactgagcaaaggagtagggttcggaaaaaatggagaaggtgaggggagaaaaggccaatgctggcagggtagaacgtgtcattgttcatttaaattgcttttattttcaaaacacaatataaccagtcagaggtcagtccccctcgccacacacacaccttccatgtgcctaagtgcattacaataggtgattttctttttaaggtctagcttgtattcctgtggccaccagcgttctgaatcttgccaaagggactcttttctaaaaagaagaaaccccagttagaataattccccattgctgcttaacatgtgtctctttgtaattaattttaaatatgcaaaggcccttttctgtgcactcctagctaaggtacgccctgttagtaggtgacagtgtgtgcctccggtggtaaattcggcttcaaagagagcgatgagcgaagatgtgttggctgcctgtcagacagcatgacataaaaggaaacaaatacaggaataaatggaaagttttatggtgagtgaaggcaacactgagtgttaccaacgcagtattttttttcccttttcctgagttcctatgatgagcaaaagaccagaaatgagttcttccaccaggatggttcttatgggtgtatatttactccaatagtaacatttattgctgtaacaataggaattagcctgtggttcataggcttaattttacaaagctcgattgcttctactatctgacttgagccttagggcgatcttatatagaaggtaaattatcccattcccattttacaggaggaaaaactgaggctcgaagaggatgggtgaatagacacacactcctaagatcatgaagagggagggaggaatgagccccaacctgagatcagacctttgaacctcattctgcttcaatttcctcctctgtaacatgagcatcgtaatgccggccaatgggaaagatgatcatcctcattttacagataggaaaactgagctatggagcatctaagaaaattgctccagactgcataagtgatgcagtacacgtaatttggctctagcctctaagctgctaacatctatcgtagagtcaatggaagtagatcctaggagagagaatagatgagggggtaaagtctgtgggaaaatggtaacataactagagctggagggctgggtgcggtggctcacatctgtaaacccagcactctgggaggccaaggtggggaggtctcctgaggtcaggagttcaagaccagcctgggccacatggtgaaaccccgtctctgctaaaaatacaaaaaattagccaggcctggtggcaggtacctgtaatcccagctaatccagaggctgaggtggcagaatcacttgaacctgggaggcggaagttgcagtgagccaagatggtgccactgcactccagactgggcaacaagagcgagactttttgtctcaaaaataacataacataacataacataacataacataacataaaataataaaataaaataaaataaaataaaataaaataaaataaaaatataaaataaaataaaataaaataaaataaaataaaataaaataaaatataaaataaaatataaaataaaatataaaataaaatataaaataaaataaaataaaataaaataaaataaaataaaataaaataaaataaaataaaacaaaataaaataaaataactagagctggagagccccaggcaggagccatgacagcatcagaggccacgacgagacccttgcattttgttcttcagccgatggaaacccatgcaacattcttgatgctaatcagaatctccctttgtaaccataagtatcacacggcaacaataatcaggcaatcaatgaggaaagctacattggaagaggagacaggttgatgagacatttacatccaattgcagtggaagtgcttaagaaatccttcaaaaaaaacaagtgaaaaatagggactaagacaaaactgagatgaaatacatttttcagcatttagctaataaatgtgtcacccctccaaccccatcaccacttctaaaacatgccctttgcatgtaagctagttttagcatgaaaagaaagatactttagtgactgcagaagaaaaaagtgtccaaaaaaaggactgccttacagggattcaaccttatctcaaattttgtctcttatgaatgtggtaattcctaaaattttgataagtgatgtacatatctccgagttcgacgcatttcctcagtagtgaagaaaatggcacaatcctattttacaccactgaggaatttacaacactgaaagataagaaaaatgggccagggtgtgtgaaactcacggattaacagtctgcatcgatcaattctccagatcattgcacaacccctcatgtcactttgtacagggatagctccaaggtaaagaatattgatgccttttcttttgtgctattttaattatagttgcaagaattttattcctaggccaacatatggtaatttaattcggggtgggggggatgtttctattagtttaatattaaagttcatattttttcattgatttttcatttgatgttatatgcaggacatatagacatttagaaaagcatggtattgtttgagatgatgagatctcaaaggctccaaaattaatggcacagcagagaaaagagcatgaagcaattctgtgagcagagagaaatgcacacacgcagacaccaggcacatgcatgtatctccacccacgctggaaattaactgaaaaatcctggtcatccaatgctgcctgcagaaccataacccctttgattcccgtttccactgtggttgatgccctctcatagctggaaggactttgggagcttctagtagagggagcacaaacctgaaacttgtagatacagttctactctgtgttttgctttgaggtctttgaaaattacttaacttcacagtagctgaatttccttacctatgacgtatcaatcatcctttctgactctccaaatttatagtgtctattgaatggtgaaaaaaaatgtgctttggaaagggaagaatctcactgacagtctaacaaaagtactggagatcctcaaggtcttgattctgcattctttatggtgccgtgtagaggggattgttttgagtgtcttaatttgcaggaagcccggagatgtggagtctgtgcaggtctacgcttcctcctggattcccagagagatcctcttctttaaaggatgcttggcctctgcatggttgttgatctctcccagccacagcctccttcactcattgaactcagaatttctcctgtgcatgcagtactgttagaggctgagtagacagagccaaactgaaccaattttgtttctgtcctcccagttcagagaggagaagggcatcaaactaaagaattgcagaggtttttattcatggcaaattagtataaggtctgtggacctaagtataggataccatggggaaaaattgagaggggtctcatggccggtgaaaaaacttttccaaggaaggctgggcacgggggctcatgcctgtaattccagcacttcaggaggttgaggcaggaggattgcttgaggccaggagctccagaccagcctgggcaacatggcgagacctcatctctacaaaaaatatcaaaaaaattagccaggtgtggtggcatgcacctgtagttccagctactctggaggctgaggcaggaggatggcttgagcctgggaggtcgaggctgcagtgagctgtgattatgccactgcactccagcctgagtgacacagcaagaccctgtctcttaaaaaaataaaaataaaaaatacaaagagctcctgaggaaatgatagtagtttactgaagggtaagtagaagttcctaaagaagaagaggtgaggggttaggtctagccagaagacagtccgcttgagggtcctaagggcagagagacccacatgtcacacaatgaaaaagcatcaaagtgcctgaggcccagagtacaaagaggggaagggcataagatgaagctggaaaggacgttgggaccaaaaccaaaaagtttttttttcttttggagacagagtctcagtctgtcattcaggctggagtggcgtgatcatggctcactgcagcctcgaccttccaggcacaagtaatcctctcacctcagcctcccaagtagctgggaccataagtgtgcacaactacacggggctaattttttttttttttagagatggggtcttgctatgttgcccaggctggtctcaaactcctgggctcaggcaatcctcccaccttggcctcccaaagtactggaattacaggcctgagtcactgtgcccagtctgggagaggagttttgcacagcaagataaatcatgttgtgaattttgtatttcatttcaagtgccacggtggaccaagggtgaagtttgagcagaggaatttcatgacaaacaggcacatttaaatgatcatttggaatgccaattaacacgcagattgtgaagggaaaataatggaagcagaaagccccaataggaaggtttctctagtaaaagtggtgagacaaattggcactttgcagtacagcacaagcagtgggaatggatggagataggacagagagacgtctactaccctctggcaagtgtggccatctcttcccaaaggtgtgatttgcttttttaacacttccaggtacttgcttctcatgaacttacaattgacattgtgtcatttatttggtgatcattttaatatttttttaccttttctaagcatcttccagcaacatcttcaatccaaaactggggggccttttgagagtagactcggtgaaatttattatttttatttattaatgtatttattgagacaatgtcttctctgtcacctaggctggagtgcagtggcattatcatagcacaccatagtcttgaactccctggctcaactgatccttccacctcagcccaagcagctgggactacaggtgcacatcaacacatctggctaatttttattttttattttttgtagagacagagtctcaccatgttgcccaggctggtctccaactcctgaactcaagcaatgtgcctgcctcagccttccaaagtgctgggattacaggcgtgtgccaccatgcatggcctaggtgagatttttatgatggcttttaggttggaaggggagcagttagagagaaaagggtatgaagactgacttccaggaagcatgagtgctagatccatgaccctgtatttcctgagagagaacatgcagaaggctcatgttggagcaatgcatcctgagaggagagaagcccaggaattatggttggcaatagttaagactgaaattccactaaggcatcaaaatagctgtgctagtgaggcaataaaatgtagaaatctggaattctcaagagagatatgaatatagaattccattagcacacagagggtatgaaggtcacagaatgcaaccaggaaacacagaggcaggtggaggaaactccactacctactggacaggtggaggaagaagagcaggaaatgagccctctgaaaggttgcctattggaagtttgtatttttctccttcatcaatctagagaacctttatacagccatgtttacaaaatgtgttcacttaagagccattaaagaaggttgttgttattttttgactgtttgtttgcttttgggttgctttcattccttttgctgcctttgtcattcctcacggaggtcactccatgaacgtttaacagtgcacaggtggagtaatccgatatccagggacctgcacagatgtcttaccctgtgttggctctttgtaattcctttctcaggcattaggtagctccaacataatagaactattgccaacattttactctctttccctgataaccaaagtaccgacctaaattaaattgctgaccgcattatttgtgagtccaaatttagcttcccctctcgtaccattaatggtctgttgcagagtttctctacttccatttgcgagtgtaactatgtccctgcctatccaggtgtcgcaatggaagcagaagtttggacatcagtgagtttttagcgtgtgtgatattggtagagaaggcacggtgtgcaaggacctggcttgccgtcggagggtggcgatgaagacagcacatgatgtctcttttcaggacagctgaagcaagtcagccccatcctggaggaagcccagctgccggcccaaagatcaaaggtgtctcccaaggccggctgtcactagactgtgctcaacgtttgccctcatctctatgtatgaggacagatattcagaatgatactccagttggctgaaatctccctttgccataagcagatagatggaaatatatgcatctctattatagataccaggaagcatttgtcaacgaggatagacaagtgaaagtggctaaatttgactgtagaaaatatgttcatggagtgaatagccaaaatgagggtaccagttccatttaggaaaaggaagtctgaaaaaatatctaaagacaaaagaagggcagcatctaaatgaggagcagaacctagcagagaaaatgattttagagttaggcaaacctagcttccaacatagccattgtttattagtagcatgaccacatctctgggtcccagccttcttgtattaaaaaaaaaatgatgagcattacatagagtgatacatatctaagttcctaatggcatgcatggcatatgattcatgtccagaatactttagtctttccttggaaaacatttcaacaacttgtatttttgctctcacatcttaagaatatccacgttcccatccattctctataaaatatttttcacaccttggcaaaactttaggcttcatctctattagaaaacctataaaaaattcataaatatgaaattagagcctgcaggaatgtaaattttattctgtggttatgatgtgtgcctccaggaaatgaccctttatatgcataaagctgtatcacatttatggtctgattttgatgcctggataggaaggataaagccaccctttgcttgacagaattccctttccatttcccttctccttgaattaccatggtcagaataagggagaataataatgactacagtggctcccaagcaggtttacgttcattattttagttaagtatgacaatggttctcctggcttatcaaaattagtgaagttatctgcacacagtgaaagaaagatcttaaaatatagatgtaacctgacccacccttgggataaacacagaatttaaatagtgagcccacagcatgtttgaagtgccttgtatttttcagtactcatgtccaaggacaaaaagatgaacaagaaatagtccctattctcaaagaggaaacggttgccttgcagggatatacctggaagcaaatcagtgaaaagaactaaccttctcagaggcagtggcatgaaaacaagtccttgtatgttgagtagaaaatctgctcacgggctggacacgtgtgtttggggataaggatgtgaagagaattgaaggcatcagatttgcacatgatcccatagcatgtggccaagcccaatcaaatgctggctgactgctccttccctactctcaagctgaattcttttatttatttatgtatttttgttagccaggaccttggcatgtcttcaagttgccacagaaaaatgtcccttcttagtggagaagagagaccacaggggcatcacctcacatttatttaattcatacatcccatgggttctcaacatggtcatcatcaatatgctttttaaaaattttaagatatggggtcttgctctggtgaccacactggagtacagtggcgcgatcatagctcactacagcctcaaactcctatgctcaagggagcataggagtttgctccccagtagctgggactacaggcacacatcacacccgactaatttattgatttttttttgtagcaatagggtctcccttcgttgcccagggctggttttgaactcctgaactcaagcaatcctcctccctcagcctcccaaagtgttgggattacaggtgtgagccacagcaccaagccctatatgcctttttaaaatataccaaatgtaatgccttctttatatcttgaaataaaattaatgtatcatagaacctaccacagtcataatttgaaaatgagtcaagataatatgcaaaccacgatataaatgacaaaaaccaaggaaggtagttcttataaaataacatgtattccaatatgcaagtgatcaggcacagttgcaaaagaagacatcatgagacacacatccctatacctccttaggatgcataagcctgggtttaagaggacatcagagcctgagcaacatagcgagacccagtctctacaaaaaataaaaaaataattagccaggcatgagtttgctggcatgcacctgtggtcccagctacttgggatgctaaggtgggaagatcactggagcccaggagttccaggctacagtgagtcgtggtggtgccactgcactccaacctgaagaacagagaccctgtctcaaaaacgaaaaccaaaaaaaaaaaatatgaggagatcagaaaatgttcctaagagaaaatgcaggacatgaaaaatcaggatgcaaatggcactagaataacaactagtattaagatgaggaccaacaaacaagatttcgttgatagtagtaaaagaaaaaagaaaggaagtgattgcaaataaagtagggataacatgccaagacaaattgcagactgtccaaggaaagaaagcacgagatctccgcacatgagcttgggttgcttattaagtgtagtgtcagaggtacttcccgggctatgacatgaaacaggttgtaacaaacgatcacagaaaacatagccctatttggaaactccaccatgtgttacgatgcctccaatatggtgagtggagtgcatttcactgacacaattttccaaagcagggctcaacatttggaaaaattctagacaaaacaaagtacagtcttacctcactttttgcaattctcagactccgtatgaaaaaaatggccctatgaattcccaaaatgctccatagagggcaacaccatctacattcagaattattagaagtcctggaagtcaatgataagattagctcctgattgaactgagaaattactgccctctgaggggatgagcaatcagcgagtatgtagaaggaaggcagaaagaaggaaaatgaaatacaacagctaccaggtgaagctcaagaattagatattgagcccaaactcagacagctattgaactactattgctgtccccaactctgcccactacagccccaggttctttccaccacccacatggagagtgggtttttagataacgttagtcattcctcactcatcacatgattgctttttggcaacaggctgtatgtaatttatgccttgctagggaggtggaccaagccaaacatggagaaaagagtcatgcaactcaaagacattcctttgtcctgaagcatagcccagcaacactaagaaccccttgctgctcttactcatagtcaaaaagtcaggcttcgattctcaaaaataggagtgtatacaggtttaacctataaatggttcagatagcattgatacacttgcactgacgaagttcttatttctttccatgtctttaacatttggggaggactgactgatcttgtgaacagagatggagcattaagcaaacaggtatgttctcccaccagtgccattctctgtgggcattattttttattattaatattattttgagacagagtatcactctgtcacccacgctggagtgcaatggtgtgacctcggctcactgcaacctccactttccaggttcaagcgattctcatgcctcagcctccccagtagctgggactacaggtgcatgccaccatgcccagctaatttttgtatttttaccagagatggggtttcaccatattgtccaggctggtctcaaactcctgacctcaattgatctgcctgcctaggcctcccaaagtgctgggattacaggtgtgacaggtgtgagccatcacgcctggccttttttttttttaattatttttttcttattttttaaaaactagcttcagggtctcactgtattgccctagctggtctcaaactcctgagctcaagtgatcctcctggcttggcctcccaaagtgctgtgattacaggagtaagccatgatacctggcctgttatttttatctgttaatgcttgcagctcattcttgtgagagggaggaagctctaacccagagagtccatctccattttaagtgcaaatatatgctgggccccgaaggggctgccataacatgcaattcagatgtagaaagaaagaagggactggcccccaggaaaagaggtcattcagagggaaagagaaaatagaaggtaccaggggatgtgagaaagaatggtgactaaggcagcatgagacatcaacattgagataattcaacatggttggaacaaagtcaggagcaaaacagcacggtagccctgcaatctcaccatagcatcttctcaagagaaggatttgcatctccaggtgagtatcgagactgtaaattacagtgagaaaggtgtgcacagacagtctctcatccaccatcttcagactcaaagcacaaggagggtgagatgtctcaacaaacactgcaaagagctggggagtgatgccagacaggtaactctgcaaaactcatcttgcaaggatgatgaataggagttttgacaattctgtcaaacccttcaaatcttaagtgacttgaaagttccagtaatttttttctttaaaacaagtggaattgcacttttccattgttatgcaaattaccttccccaagacatctatttacctgttactatggttctcaggtagtttctccatgccttgggcagtggaggtgggtaaggatataaagtttaaaaatgatgtcttcaataagaaagtttgaagagacattactcaaagaaacgattttaatgtgatattttatgtatgagagacctaagcttttccttacatgtgggaaatagaaaagtatgatagggtttcaagttctgccatcaagttttgataacaatcaacaaaacaacaccctgtgtttttccctaccccaagacacagcaacttcaaatttgaaagatagctcaataaacaaaaatggagtatctttgctttttaaagaactgatctcagctttaagaaataaataaagactgcatgtgatgacttatgcctgtaatcccagcactttgggagaccaaagtgtgaggatcacttgagctcaggaattcgagacctgcctgggcaacatagcaagacccagtctctacaaaaaaataaaaaattagctgggtatggtgacacatgcctgtgatcccagcacttcaggaggctcaagtgggaggttcgcttgagcccagaaggtcaaggttgcagtgagctataatcacactaacatactccagcctgggaaacagatagagacactgtcttgaaagcaagaaagagagagaaagagagagaaaagaagaagaaggagaaggagaagaaaagaaagagaaagaagaaagaagaacaaagaaagagaaaaaaaagaagagaaaataaaagaaaagaaggagggagggaggggacttggtccttacaatctgctgagaggcttaaacataaatacaaataaacataaacacaaacaatacacgggaatagctaagagaaaaagattcaactatggctttttttaaaaaatgctgaagagctttgtaactcttccaaagacttcatgataaacagctcagggccctcttggttaatgcttggaagaaaaacagtttttctttcaaacatcttctttggaacagagacttccttccaaagaattctctcctgcaacccacccagtagccagtctaataaaatgtgtaagaggagaaaaatggtcttactctctcctttccccccgtagggcgtagcaaaaaattggaaaacagaaaaatggaatctggtgacacttgagactaatgcccgaatctcctgcttctgatttttccagcagccagtccgcatcctctcagcacccctattcagctatcactctcgttttgctgtagtaggtcacagatcagatgatggggggtgggtgtttggtttgggtgtaacttttgttgtgttttcagcagattcagcccagcacaacttgtcaggagattcatgacttagcaattgtcagggattggtcaagtcatattgaaaatgagattaactgaaagattcaagtggccagccctatgctagactttgtagtgcttccaagggggttcacgtgaaggagtcacatctgggcttcaggctcatcaaaggcaggagtgaaacgcattggctcacccttggctgccattgcgggagaaacatgggaggtgagacagcaccacggacagctccaagacacacgtttcccctaacacggttccctctcctcttgatcctgggttctcattctggttggtccagacacctaggacttaacaacctgaaaacatcagcccacattgtccctttaagccacgtggcaccaggtttcttttttactgaatgtcccaatgacttcctcatttgtgaactatcctggcacccagttcaacattttatctgaaaccctacaaatctttttcttctatctcttacaatgaaatgcgagccatcttttcatgcaagactcatttttctagttgttctgaaaaaaaactctcagtttttcagaagattctttcaactattacccatccccatctcccaaatcgccacgaatgccaccaaatattatcagatattgagatgaggtacagtgagttaggaggggtgggggttctgtttattttcatgattgttttaaatttgttttaatattaataataaaacgtccacctccaaactaaccaatgggcaaatatacccctctaaatttcagaggaaacaataaaaagtttgatggcctgtgggaaagcaattaaataaaaaatgagaaagctgggataagaaaatgtgttttttttgctataagcctttttaaaatgagatctgacgtttaattctgacgtgagtaatttttcagataaaattaaacacaacatcctgcttcctaatcttttgagaaccaaagctaatgggagcttttgaaatgtgattatgttactcctctttttaaaaattttcagcacaaccaaaaatgcccttaaaataaagatgctccactagagcttaatgggtgtttccatttctcctcatctcttctttctctcctgaagtcaggattagggacctctttgcctgttttcatagcagtttggacttcttctatcatgtcagaatgtttctgtgtctcctttaaactccaggttccctggatatagacactttttcttgttgctattcatgattgtttcagtgacaacacgacggcttcatgtttattaagtgaatggacagacatttcttctctcattttcctgaccaatgcttgggggaaaaatcagattgtcagaaagggtacctaaatgataacttattgaaaatgaaaaaaaaaaaaaagaaagaaacccagcctgtccatttggcaaagtgatgaaaataacatgccccaaatatgccacattcttctctggaaaagaaattctgattccaactcttctcccagtccactttgctgtaaacaagggaaaaaaagcatacataataaagaaaaagtaaaggtatgtctatgaagaaaaaactggaaacaacagacaccaactacatccgttatagtcattcaaactgaaaacctcaaattaaaaggttatttagactgttgccagtccagagaatttcaaatatcagtcctttaatttgatttatcaaagagagataaagaatttgtcaaaaaaacatcaaaaaagcaattcagggcctcttggctaccttgccaaatcagaatctctgagggtgaggcctagaactgggcaatctctaaaatttccccacagaactctgatgcgtgtccaggcgtgagaacctagactatagcccagcctccataaaacatgtggatagacttgtggcatttctgagagatggccatttggtctctgcttgaaatcctctaattaaaaactcattgcctttcacagaactttattctattttcagaaacctcaaatcattgaaatatacttactgttttaaatcaactataccaaatcctcccataacttttactcattgtcacttatttgctcttggagaatcaacagagcaaatctaaaccttcctcgccatttaaacccatatatatggggctttatatatatgtatatatacacactatattatatatagtatatacattatacatgtaatgtatatactatatatttttgagacagtatatagctattatatatagtatatacatacatatatactacatatacactatgcatatatacttacaatctgctgagaggcttaaacataaacatgaataaacataaacacaaacaatacaaaggaatagctaagagaaaaagaaagtctataaagatgatcttacatttagaattagctatacatacatatacatatatacactatatgcatagtatagtatatgcagtgtatatatattacatgtatagtatatatgtatatatactatatgcatagtacatatattaatacatatatgtactatgtgacacgtatgtatttttatatatacatatagtacatatactatatactatagatagtatatgtatagtatatgtactatactacactatactaatgtactgtactataccatatatactatatatagtacctacatactatactatatggtatactatatactatatttatacatctatactatactatagtatatacacacatatactatgtgtatatagtatgcatattatatacatatatagtataatatacgtacactatacacaatacatactatatgtatgtatactatacatgtacatatactagacatactatatttgtatagtttatatacactatatataccatatagcatataaacactatatatactatatagtatatacaatatatatacacacatagtatatacgatatagtatatacaatatatatacacatacagtatatactatatagtatatacaatatatatacacatacagtatatactatatagtatatacaatatatacacacatacagtatatactatatagtatatacaatatatatacacatacagtatatactatatagtatatataatatatatacacatatagtatatactatatgtatatacaatatatatacacatatagtatatactatatagtatatataatatatatacacatatagtatatactatatagtatatacaatatatatacactatatagtatatactatgtgtgtgtatatatatatattttgagatagtatctcactgtgtctcccaggccggagtgcagtgttgtgatcatagctcactgcagtttctacctcctagactcaagccatcctcttgcctcagccttctgagtagctgggaatacaggttcatgccaccatgcccagataattttattttttcagagatacgggatcactgtgttacccaggctagtctcaaactcctggcctcaagtgatccttttgtcttggcctcccaaagtgctgggattacaggcaccagccaccatgccccgccttaagcctttcaagtatttgaaaagagctaccttgttgtattaattatctgtcactatctaaccaattatcaaactatctccaagtttgtgacccaaaacaaaaagcattccttgaggtttctgcaaattgagggtctggatgtggtcacctgggttctccatttcaagaagaagatctcttataggctacaaatattctagtcaatgggaaagattcactaagtcctgcccacacacaagtgcaaacggatcctcaagagcaccaatttcagcaggcagggatgattggatacatttttgaaggccgcctaccacatatgtggctctgttttcttttctccgggtccacactttccttaatcatctctccagcaggaagcccaggtctgcatttcttcatactctgcactagtccttacttggacttagacatttagccatggctcttctcatatctcattcaaaaataaaaccaaaagggatgcctttctgtctcttcatttcccccaagtccctgtttttttgttttaatttagaaaatgttatttgaatcttccccaaaatttaggatattttccacataagtccacaagcagcaacttagataagcaggctgcctgtgtaagtgtgtgtcgctatttccaccctccaactactttcttttcttgtttatgctggatgtctcaaaacccatattctatatgaagtctcattgctcaagctgggaaagctttgttctccaaaatccttgatgtttagacacacacagaaagtcacagtaccacacacacaccctgagtagtatcctttaggttattttgagctcttccttcaaatcccagcagtttgaagtgcacatgctgagcaactctcagcagagctgaggaaagtctataaagatgatcttacatttagaattgactaaagggttttatttttagttttattggtctgttttctgtcacagaggggctgccattgtaatagtcctgccaaacatcgcattcaagatttaatacatggatacacctgtcagccatagcttcccaacttaaagtaaatgaatttgtaaagatgcatatttatgactgtgcaaattctaaagctaataggacaaataaactctctaaatttccaattttctacatttaatatttcatgtattcaaaatgtacaccaagtcagtcaatcctccttctttcctcagaatggaaatacaaaccactgtcattgacatctttattgtgaagtccatactggacttaccttgggtgtctatatagtgaatgcatcttgggaataagctcagaacacagccagcatttacgatcaagtaaatccaggctggcttgcttcctttgacttctatcacctgccacaggtaaaatataatatccctgtagctgggtgaaaacatcatgtgttttggatttatacagatttgagtatacacctgaatttaattaaaccacttcagaaatgtgtataaatcattgattcttcgtaagcctgctttcccatgatttaacaaattttaatactaggaatattaaagatgatgatagttcaaaatgttgaagaaacaaagaacaaacggtatataaaagttgttcattctcttccttcttgctgtttctagagctcactagaaaatttcttccagaaagatatccttcttactggaaaaacttggtaaaatgtacggagacccccagaattttaatactcaagtgacaccacttaaatgtggataaagaatgaaaatcccagcaatatattaaagactggggtgggatttgggcatctttatggcataagccaacaacacaaagactgggtcttctgttcaagagaagagagttctgaaaattgctttccatgaaagctttcttcttacaattatttgtcccctcaccctgagccttagtaatattttacacatgcacacaaacagaagcccacatacactcactccctctatcctgaattttagatgtactattcattcaagaagatatggtacaattccacacttgctaattcatggattcaatactcatttcttctctgcaacacaaaatggtccttggagatatgacataggctcctttggagcaccatacattgccaagatttgagtgctactaaacgaaatttgaaagttcccccttttatctccatagaatggaggaggcgatggaagaacggattcactcaaaatcatatttgaaacacgtcttcatggatccatggtatgttttttaaagtaggttttcacttgtaatactttgtctccattcataatcgtagggatctgacaggggactttgcagtcttttcatttttgtaaaagaattttccttttgccactgatattgagctgcagatgaggtgtagtttgaggtgagctgcagatgaggtgcagtttgccccatggtgtctttaccagctgcataatattttgagagcggaagagagaacacacaggggataattttataattgtattttgtatttttattagaaaatacgtcaggtgtgcagaaatgtacagataataacataacagatatccacaaatctaccatccagacataaaatatatatatttttttcgccataaatttttcttttttttttttgactgggaagaaaaacaggtttaattggacttagagttccacatggctggggaggcctcagaatcatggcaggaggcaaaaggcacttcttgcatggtggcggcaagagaaaatgagacgtaagcaaaagtagaaacccctgataaacccaatagatctcatgagacttattcactatcacgagaatagcacgggaaaaagactggcccccatgattcaattacctccctatgggtccctcccacaatacatgggaattctgggagatacaattcaagctgagatttgggtggggacacagccaaaccctatcatcctgcccctgactcctccaaatctcacgtcttcacatttcgaaacgaatcatgccttcccaacagttccccaaaagtcttaattcatttcagcattaacccaaaagtccacagtccaaagtctcatctgagacaaggcaagtcctttctgcctatgagcctgtaaaatcaaaagcaaactagttacttcctagataccatggcggtacaggtattgggtaaatacagctgttccaaatgggagaaattggccaaagcaaaggggttatagggcccatgcaagtccaaaatccagcagggcagtcaaattttaaagctccaaaatgatctcctttgactccaggtctcacatccaagtcacactgatataagaggtgggttcctatggtcttgggcagcttcacccctgtggctttgctgggtacagcctccctctcggctgatttcatgggctggcattgagtgtctgcggcttttccaggcgcatgatgcgagctgtcagtggatgtaccattctggggtctagaggacggtggcccacttctcacagctccactaggcagtgccccagtagggactctgtgtgggggctcctaccccacatttgccttctgcactgccctagcagaggctctccatgagggccctgcccctgcagcaaacttttgcctgggtatccaggcatttccattcatcttctgaaatctaggtggaggttcccaaacctcgattcctgacttttgtgtacctgcaagttccaaccctgccaagggttggaacttccacccaggggataattttaaagcactgagactgggcggccatgggagagagattcaccctacaaagcagcaagacaccttgatgtaagtcacatagaactggctccacacgaggtgtaagtctgcatcctcacaaagggcgggactctataagtgaagacaggaacaggagagacacccacagcctgtgcgtggggctcaaggcacaggtccaattatctgatgaaggtagggtaaggagaaaaggggtgagactgccctgttccaaagaggatcaagaatagagactgcttggaaagcgtgtgagttttggggctcagggtggcatatcctgaaccccagcactcacttattggcatttgggaaaacaggcagagcaggaaacccacgttcaccttcccctcatccttctcctccaaagcaggccatgaaacctaggaaggattttctgaccttccccaaagcaggccctaatgatacaggagctagaaagaaattatttaggcagatagttagggtaaaaggagtcctcggtaaggcttcccttttaataaaaagcagccccacataatttcttttctcacaaagagcagcctgaaaaatcgagctgcagacacagataagcaagctgcaagtttgcatgggtgaatgccggcagccatgccaatacagcagggctacctggaagccaggggtgttcagcatggagcctccgtcttcccttttcttttcaccacgtgtacagtaagggccaggcaacatggcgctgaccaggtagagaacccatctgcataataaaaggttaaggtggggcagtcagcttctttgtgtactgtgtaaacggcacacctagtccaaccaattttttgtgctctatgtaaatcagactttacctcctcaagctcatctataaaactgcctgcatttcaccacggaactggcaacccattttctccaggaccccactctctgcagcagaaagagcttttctctttcttttgcctattaaacttccactcttaacctcactctggtgtgaccgcgtcctagttttccatggccacgggacaacaaacctcaggttttaccccagacaacaatgccacttcactaaggccttcattcaagaggggccgtcctcatacctgggtaaaggtatatctttatctccgaagatgaagaatctgaagacaggtcttgttaaagttcccccaagtttgtttccatgaggtcacagcctctcgtcctccaatcatacttctccatgcctgcccccctcttcatcaaacctaaacaagcgtgaaaacttgcaggtttccctgtttgtttttttgagacggagtctcgctctatcgtccaggctggagtgcagtggcgcgatttcggctcactgcaagctccgcctcccgggttcaagctattcttctgcctcagcctcccgagtagctgggattacaggcacgtgctaccatgcctggctaatttttgtatttttagtagagacggggtttcgccatattggctaggatggtctccatctcctgacctcgtgatccacccgcctcggcctcccaaagtgtttttttttttttttttaacttttattttaggttttggggtacacgtgatggtttgttacataggcaaatctgtgtcatgggggttttctgtacagattatttcatcacgccggtattaagcccagtacccaacagttatcttttctgctcctctgcttcctctcaccctccactctcaggtagaccccagttccctgttttttaagttttcatttcctcatgaaagctcctgtgtgatataaaaactaacattaaagaaatgtgtttgctttacccaagttaatctgtcttttcttttaaggggcctcaggcatgagtataggatgggaagaaaaggtatttcttttctcctacatgtgcaattacttttagacattaaaaagcaaaaacaaaaacaaaaactgtagcccagggaggtgaggttgcagtgagccatgatcttgccattgcacttcagcccgggtgacaaagtaagaccttgtcttaaaataaataaataaataaaactgtctatgtagtgggtgaaggaaaaaaaaatcctttacctcgatagatatatctttgacatattttgaaatggctgtcacaggttcagcaaacagatgtacccttgcaaggctgtctattgtggggggatatttgcatctacagagaatcaccatgaatgtatgcaggccttttccatgcctttccaggatctaggagagcttgagactctgacacctttacatttaagtctgaaaagaaatatttaccatctcttctctctgagaatggtgacctattaggcttcacctacacaacaaagtctgctttactagccagtcctctttctttcttgctcccattgttactggaaaggggtcctgatccagacaccaagagagggttcttgtatctcacacaagaaagaattcagggcaagcccatagagtaaagcgaaagcaagtttattaagaaagtaaagtaataaagaatggaaactccataggcagaggccccaagggctgctgcttgcccatttttatgcttatttcctgatgatatgctaaataaggggtggattattcataagtcttccaggaaaggggtgggcaattcctggaatggagggttcctcccctttttagaccatatagggtaacttccggacattgccgtggcacctgtaaactgtcatggcactgatgggagtgcgttttagcatgctaatgcattataattagcatataatcagccatgaggaggaccggaggtcactctcattgccatcttggttttggtgggttttggccggcttctttatctgttttatcagcaaggactttacgacctgtgatatagtttggctgtgtctccacataaatctcatcttgaatagtagtttctataatcctcacatgttgtgggagggacccatttggaggtaattgaatcatgggggcagtcaccacccctatgctgctgttcttgtgatagtgagtgggttctcacaacatcggaggattgcataaggggctttccccccttttgctcgacacttctccttgctgccactatgtgaagaaggatgtttttgcttccttttccaccatgattgtaagtttcctgaggcctccccagtcatgcttaactgtgagtcaatgaaacctctttcctttataaattacccagtttcgggtatgtctgtattagcagcatgagaacagactaatacaacctgtatcttgtgctgacctcctatctcatcctgtgacttagaatgtctaacctcctgagaatgcagtctcataggtctcagtcttattttactcagcccatactcaagatggagtcactctggttcaaaggcccctgacaccataacctgtctggacactaaacctggttgaccaacgtaacctgtttttggctatgctccagtctgcattctttccataacctgaagctggtatatcagcttctgtaccttattgtcgggttgggtcttccttctaaatgctcccatgtatatatgttaaatacatttgtatgccatttctcctattaatcaatctgcctcatgtcagttgcttttcagtgaacttccagggagccaaaggcaatggcccccacttgggcatatataatgaaaaatcaaatttaaaatgttgcctttttaaaattcactaaataaaaataaacatgttcaggaaagcaactctcctataacttcaaagagcacccaggtggaagacggtttgttgtttactgcaattaagggagaggtgatcttggacttgatcttggacttcaagccaaaacttaaatttacgttgtttaaaagccaccaagtctatgggattctgttgttgttgttgtcatggcagcctgaaagtattaagacatttattgaaggagccatggagcaagggattcagccacgagaaatgggatcctacaagagcacgcagagggactaaatattgttactgcacataacgttttaggatcatatagggtgaaaaaaatatatccctgggcaacttgtcccacaagatggttcagagcagcactaggaaacacacatcagaccttgccaatgacagagaaatgaaaatcacacatcaccctgcagcaaaacagcttccaaatgaacgaggagaattggggcagaaagaaacagcttagcaccgggtcattccctgcccacccgcgtggtctgatcacactgagctctctgctccgggcccttgcaaaaagaaaatgtgctagatgtagtgaaaaggaaaggaggtcccctggcagatggtataatatcaaaaaccatgtattctgctccttgggagcttggtaaaaggtgatggacatggtgtttctggcacctcctggaatatgacttagggggccttgactcccacctctaagtctccagcttggaatggagagaggagagccacaggaagctgagtgtggggtttctagcagcattcaaacaagaggaattgaggataccagccagtctgtgagcagagtacaggagctatggagcttcccagagaattcccttcttgtctctcccatcctgaatgcaagctgagccccaccccagcttgctgtgcaagagaacagatctatccctcaaggttccttctccagcagacccacatgtcagaaacaggggttatttcttataggttggtttatacctaagacccactccaaagaagcaggcggcaacaaggctggggtatgcacataaccaaaatcgactcactgatttggtcttacttaggaaaacaaagttaaactaatactaagaaattttttttaacaaaaacccatagggacaattctcattgtctttgcaaaattgtctctgatctcatataaattctaagtcaaaacacatagtaccacttttgcaaatacttttaagataatcagaagtagtatgctagattttttaagtccccttcccccatactcctctcatttctcaaatctgagctggagctttaagaaattttctaagtatttttaaatggaaagtctatttttttaattctaatataccataaaataatacctacatgcaacttgcataactgtaacaaatgtacaatttatataaaatagcaagtgccacatttattttttaacttataagcttaattaagtccttacagagggattcaatgtctcattatttaagaaggtccttatcttagtcattctccaaagtctctaccctttgatcagaacaccaggtagggacaattgaaagacaaggaggtacagggaatgctcttatttaatagtagctgaaaacttacatacatagacatagtagtataaacatatatgaaaatatatagtagcacaaactcacatggatgtccacactaaacttatatagatatagtagcataaatttatgtggatgtacaacgtagcaaaaaaagaagaagaaaatgtcaagaacctttgatattcatgctaattcagcaacaagttataggtcctaggttttaatatctaagaaaatatataaagtcttaccactaattcagaaatgcaggtacatcactcattcttgattttccttttgttagacaagatcctctctaaggtatcctctgtcttcttgtaaatttccatgtaaaaggaaaaccacagattgaccataaactcctggagaaactagggtgaagtccccttaactgtctgtgggctctgggagggcaggaatctcacccctctgagactgttcagcagcaaggatttaagacagaggccagcacactgtagatgtcatggaagcagtgattgttagggattgtcatggacacagctctccagacagctggatgctcagctctttttcagggatgcctaagtggcgactctaccttctactctcaaacaagaatgtggctgggctgaggttgcgtttggatcccacattgcccaattacttccttacataaacctcagtgttgttagtgtaaatccttctggattggtgacccaagctcattattatgaaaaggaaggtgttaccggtggagggtgtccaggttcttggtgtcttgaacaaagaattggacaaaatgcaaaaacaaagcaaggaaggaatgaagggatttattgaaaatgaaagtacactccacagtgtgggagcgggcccgagcataggggctcaagagctgtgtcacacaattttgggagtttaaataccctctagaggattctattggttatttggtgtatgccgtatgtaaatggagaggatgaataaagttacaaagtcatttactcggagtttgccctatagagaggttatttcctgtcatagctgaagtgtgaattgcccttatgttccctggctccagaccctattttcctgccttaaaagtgcacagcaaaaattctacctctttctcaactagagcaaatccacatttgtgcagaattttgtcaacaaatgtgctttccaagcaagggatgggagcaaagaaaagtcccattgagaagcactgccatccactctacaatctgaagccaccctattctgtcaacgtctgcatccttgttgagtagcttaaacacagaagagcctgtatattgtcacttgcaggttcatctacaatctgatgcacagctcaaaggaagatacacacttcgagtagtttatctacaattcatactggatatttgcaggactaaatgaagttctctttcattattactgtgagtaacacatgtattttatactgtatcggcatggggatcaggcaccattttaagtcagggaggagaatgtttcaactttcagctctgtgctttaaaaatgtatgcactaacagggttttctaacaataggcatatacacatgcattagtttcctgctgctgccacaggaaagatgctacaggcatctttggggaactagtattttacagctcataaatacatattcgtgtatatctgtgatgagtcctttttgcaacaccgtttcatagccaacacccagtttacaatatatactggaacaaagatgtcagcgaaaataagtgagatccatgcacattgcatacttgtttgtctactgattcagaattcacatggaacagaaaatggataacttaacctccccctacacacacaaacttatgacactgttgctatatatgtgtgtgtgtgtgtgtgtgtgtaaacatactttagaaaacttttagattcacagtaaaattcagatgaaagtacagagaattctcacctacccccagcacccacacatgcacagcctcctctactatcaacatcctccagcacagtagtgaatttgttgtaatcaatgaccttccatggacacatcattactacccagactccatagtttacatgagggttcacttttaatgatgtacattctataggtttgggcaaatgtatcatgacattggatccaccactggagtataatgcagagtagattcactgccctaaacatcctctgttctctgcatattcatccctccccctaactacagctctttttactctctccatagttttgccctgtccaaagtgtcatacagctgggctcatacactacgtaagcttttccaattggctcattcacttagtcatatgtatttaagtttgctccatgttttttcatggcttgatagcttattttttttttagtgttgaacaatatttcatttttggttgtatcacagttcatttacgtattcacctactgatatggactgaatgttagtgtccctctaaaaattcctgtgtcaaaatcgaacccccaagggatgatgttaggaggttggagttttggggaggtgatgaggtcatgagggtggaacctcatgaaagagattcgtgcacttagatgcagcaagaaggagccatctatgaaccaggaagtgccctcaccagatgcagaatgtgccatgacttgatcttggacttccagcctccaggactgtgagcaataaatttatgttgtttaaatgccagcaaatctatgagttttgtcattggtatatcaggttgaatggattaagacacttatagaaagacatcttggttgcttctacttcttagaattatgaataaatctgccacaaacatccatgtgtggatttttgtgtggatataaatttcaactcctttgaataaataccatggaaattgagattgctggatcgtaggataagagtatatttatttttaaaagagtatgtttcgttttataagaaattgtattccaaagtggctgttccattttgcattcccaccatcaatgaatgaaagttcctgttgctccacatcctcactagcatttggtactgttggtgttctgcattttgcccattctagcaagtgtggtatgtagtggtttcctgttgttttaatttgcactttcctgacaacctgttatatagagtctcttttcataggcttatttgccatctacatatcttctttggtgaggtgtctgttatgaccttgagcccattttaaagtcaggatattgttgctttttaagacagaatattgatcctttccacctcccacccctagctcctctacattcagagatggcaactctcaggtaagccactgggtaagaggtacaaggaggcttttggtagctcagaaggtcctaggaggtgagttcaggatctcggctgctggctgggttgagggaggcagtactccagcgttcacgcaactggtgagctgagggattcaccacattaatccagaacattaattgaaaaataatctagtaatgggataagaagagctttcacagaaaactgcagccctgcatgagggaatgcctgtcagtaccagaaaatacacccctgagaatgaatctaaaaaacctccactccaacaagcagaaagaagagctaagacaaagacacatacccggtctcttggcacagatcaggcctagataagtctctctttattcaaatgataaagaaaaaagtgaaaaagcaacacggatctaggaaaagaagacagtaaaaacaagggaatacaacatcaacctggaggctgagaaggactctctcacaccaagatgtaattggcatttttcgttttctgaagtaaaatgataaagggaaaaaaaaatccttcaagcattcaggcaggaaaaaaaagtgagaagaagaaaaacaggttacctgcaagaagtcagaattatgtggtactcatatatgtcatacagaatcctgaatttgaaatgtcttttttcttttaaagtagaaaagttagtgacaaaagaattttatgcccaaccgggaagtctatcataagtagaagcaagaggaaaaccattatcgaatatctaaggattcattttttataaccaaatagacttctcaaaaataaaatctgtctcaattcatcaagaggagaaacacaaagaaaaatttaagaatgcaaaagttaagagatacgaagcctaggggttactactgtagccaaattagcacagtgttttgcacaaaaaagaattttaagtgtagttatcaaaataaagtagatgccaaaaattgttgaaaaagagtgtaaatattgtaacttaactaaataaaatatactttaagtttaaaatcccatattgcaaccacccaatgggttctccttgcccgctgcctagacaagagccaatttatcaagacagggcaattgcaatagagcaagagtttaattcacacagagccggctgtacaggagactggagttttattattactcaaatcagtctccctaaaaagttgggaatcaaggcttttatgggtaatttggtgggtagggggttggaaagtgggaagtgctaattggtcaggtctgaggtgaaatcatagtgaatcgaagctgtcttcttgtgctgagtcagttcctgggtgggggccacaagatcaaatgagccagtttattgatctgggtggttgcagccgatctatcaagtgcagggtctgcaaaatatctcaagcactgatcttaggtctgacaatagtgatgttattcccagaagcaatttggggaggttcagaatcttgcagcttccagctgtatgactcctaaaccataatttctaatcttgtggctaatttgttagccttgaaaaggcagtctagtccccaggtaagaaaggggtttgtcttaggcaaaagctgtgactgactttgtttcaaagttaaactacaaactaagttcctcccaaagttagtttggcttatgtgcaggaatgaacgaggacagcttggaggtcagaagcaagatggactcagttaggtcagatccctttcactgtcataattttctcagttataatttttgcaaagacagtttcagtattctatttggaaaaatacaagttaatgagacaaattatcctcactgcatatagtgagaattaaaagataccatgtcattcatcatattgaacaatttagatgttaagaagaatgaaaataatcaatatgtattgaacagttactaggtgccagtcattttcagcattttacctgtagatttgcaatatgggttcaataaccttcttgaaatagtaaaagagaacaagtacattttacaaagcagaatctgctttctaatctttggaaaagacccaaacaagcaagacataatcatatggcaaaagacagaaaacaaaggaactagcaaggcagctttaaaatcactcattaggcaaggagacagaagtgaagccaatcatatattttattctgttggaaaaggtaaaggttaaactcccacctaaacagacaaagactctcaaaatgtgctaaaaagaaaaccaacaaaaacaaatacaaatatttggaggaaaataacaggccaaaaactgctctttatcccctctgcccctacttaacaaaacctatagaaactggaaaaaaagaataccaaagaaaagagaaaagagggaataaaaacaattgccatcctcagactggcaaatggcaccaagaaatgcaaccaacataacaccaaagaagttctgtttagagcatattggcccaaattaaagaggtcacccagaagcagctcaacaactcctccttttgaaagatgggtgtaattttggagaaagcaaatggaagataatctggaaaactcaaatagcatcctctactttggacctacaaaggacaaggttggggacagttcacaagaagtgggaaagcctccctatgagtgggacgccaaggcaatgtggtaaacaaaaaacaaaaagttggccactaccactacttgcaatttttctctaaactggcatgttaacggcaatctcagagtcttccatttggggtaaaggagaaggatgggatggctgggaattcctgaatcttgaagcacaagagctaactgtgaaagagataggatggatatatttgaagctattttcagagctgtaggattatagcagaaggacaacccaatagagaagctaagcccttccggggagtaactgccccagaagccaggatacactccctacttagctaggcatggaacccatagggttctgccttggggcaaaatgcttgtccttctgcccctcagctgcctagaattgtactactcagctgctgcccaaattctgaatatgctgtggaggcccttctgcacattcctaatggttaattctagcacaaaccggagctgaatcaagatctgccttagaataaataatttactgtcatctcagactgcctgctcatgtcactctctctctctctctgacatacacacacacacacacacacttcacccagttaactaaacatgatcaaggcttagcttagtatttagataacaagctattaaaaatggccactcacaagcatgttaaaaaatgttataaatagtaagttagggtaaaaagaaatgcaagactacattttcactgtaccaattttatttaaaaagtttctttctaatgaacacatatacttatgaagtttatatctaatgtacacatttatttacaattataatgtaggtaggtagatggatggatgaagaaaggatgaatggatggatgggatggatggatgggatggacggatggacaaatgcatgaataagtaggtggatagatgggaagatcggtgggtaaatagatgtttgagtgaataaatggatggatgggtggataaatggatggatggataaatagatggacgaatgaatggaagatagatggatagatcatagatggatgaatgaaggcacaaatgaatgaatgaataggtggatagatagctaaatggctggctggatggatggacaaagtaatagatgaataggtagacgtgaggctgagtgggtgaatggatgaatggttggatggacggatgtatggatgaatggatggatagagaaaagtttatagaaatagatacatggatagtctgactgacagctatttggataagttggtctttgaactcactcatcaaaaagaatctaacatttacagctctgtgatctgggacagatgacataacttctctgagctttagttcctcatctgtacagcaggaataataacatatattcagtctacttcttgcaaagatcaaatagctattattttccatgagcctgacccataagagttgttaaaaaattgatggtttccttccaatttaaaattacattacctcataaagacattctttaaaaataagcagcactaaatgttgtactatttgggggcaaatgaaaatcaaatcccaaactgaaaatatgtgtgtcctataattgtacattacattttaagaaaaactaggatgaccaagagtattatataactgtactccttaaaggaataaaaacagatacacagagagttagaccgtgaacagatctacatgatctttttgtctataaggtaagggcaggaaaggaaacaaacaggaaaagcgagagtttaatttttaatctatcaaaatgacccaatatgagtgaaataatatgtgctctcttctgaatggagatgcaattaccatactgcatgaaatgtctcaagcattaccttatttagtgctgactttattgctttcttcatgttctctaatcattcagatcattttaatgtgcaccttctctgccttgtctgtggacagccctgaggacctggttcctaagtcaccaggcaggatttaggtgacagttaaattttgcctagcctctggtttggctcatcgggtctccatactttatttcataatattaatatcattacattgttatataatgtaattgtggtccccaagaaattccatgcctgaattcccagatctgtgaaatatgtcaccttacatggccagaaggactttgcagctatcattaaagttactaattcattgaccttcagataggaaagtgtttttgtgcattttgtgctcccataacagaatacaacagactaggtaatttataataacagaaatcaattgactcaaggtcctgaaggctggaagtccaaaatcaatgagctagcatctgccgagggccttcttgttacatcatcccatggtgaaagggcaaagagagggtgagagagtgcaagagatcaaacttgcagccccaggcccatttgtaatcaacattaatccactcatgagggtgcagcctccaggacccaaacacctccaattaggccccacctcccaacaaggtcacattgggaattaagtttccgacacatgcttttcgggggacgcattcaaaccatagcaaaaggtggttctggatggtttgggtgggctccatgtaataccgtgagcccttagaagaagaagcagaagacaaagtagagagaggttgtttgagggaagaccagagaaatctgaagcaggagaagaattctgcccatctttgccaactttgaagatgaagaaaggcagccagaactgaagaaattggggagcctctagaagctgagaacaactccagatgatagccagcatagaaacagtgaccccactctgatgattaccaggagccgatttctgatgataactcaaatgagcttgaaagtggatgctgtcccagagcctctggattagagctcagcctggtggacaccttgattttagcccgacgataccccaagcaaaggacacagcaacgtcatagccaacttctgacctgcagaactgtgaaataatcactttgcattgttttaagctcccatatatatgggaatttgttaatgtcacaacagaaatctaaaacagtaatggaatgtattataatatagcatgtctataagcaagaatgcatagggaaatctagttaaaatataataaacaacaatgaaaagattatttcctgagaaatctgactctttcccaagagaataaaagatcatcatttactctcccagggagaaagaaagattcccttgtctctcccaattttgtaggagagactgttaatttcaccacttatacattgctacgttgttttttggttttttaagacagagtctggctctgttgcccaggctgaagtacagtggtgcgatctcagctcactgcaaacttcacctcccgagttcatgtgattctcctgcctcagcctctcgagtagctgggattacaggtgtgcactgccactggcttttttttttttatttttacttttagtagaaacaagggtttcaccatgttggcctggctggtctagaactcctgatcttaagtgatccacctgcctcggcctcccgaagtgctgggattacaggtgtgagccactacacccggccgtcaccacttatgcatttagtaataatactataatattattttaattatattatattacctgcactataataagttgtatgttctaataatactattttaaaatttgtattttatgcataagttcttttgtgttttttatatttaatatgcacatgcatatttatgtcagaaaacctgtaaatactattacagattcgtaatttccttttgaacttcccctccatctcaccccagttcactgccttaattttctatccctgttgtaatgaattaccaaaacctcagtcacttaaaataataccaatttatcatgtcatagttctgtaagtccgaatcctgacatgggtctcactggtttaaaatgaaggtgttgtcagggttgtgtttcttctagaggctggaggaaggcatttgttttctgacttttccatcttctagaggttccttgcattcgttgcctcatggtttggtaagatgctgagcagagaacacaacaatgttgtgtaagatttctgacttacagaactgcaaggaataaattctgccaatcttcaaagtcagcaatattgtatctttcagaccattcttctatagtcacatctccctctcaccacagctgggaaaggctttccaattttaaaaactcatgtgattagtttggacatacttggctaatctcttatagcctccacacatcaagactcttaatttaatcacaattacaaagttccttttgtcgtgtaagaaaacattcataagttctggggagtagaatataaacagcttccctacagtctacactgggcagaaagcaggcacttagtgacttgcttataaattcaactgtgattggtctctactggaggctcagagaagacatgaaagcccaaattcctattttctgtccatgccatttgtgataaaaactgaggaaaagcaggaaaaggagatagtggggtagtatgcattggtcaagtcaatattcaaacagaactgctacatgtgcatttgggcaccaatgagcgcatttaaattgtgcaatccatgtcacaaatgtagtttcagtgtccttgtttcaacaggaacatgcataagggaatatggaattgagtcaagtcagtagtctatgaaacacagaaagtgaatttaaggcttcctaaaaggttgccgtgacgatcctccctgtctttgagtacatcattcacctccaggcaagaacaaataatacatctcatggattgaggaggagaaaatatttccttggacacctgaaaggatctgctatcacatcagacagtgtgcacaatgagaaggcagatttctccacataatcgccagcacaaagctacgatggaaggggcagaatagccctgccataatggcatgatggagctttctctcctgatgtcaggtgacttttgtcgcacttgggaaatctcagagaatggcctaccgttagcaaattgtgctcatcagcatgtgcatacgcacacacacaaacacaagcacacacatcctggaagggagttagaattccagcaacctcaccctggctccaatgtctaccttctagccttggtatttcttccccctggccccgcattccacgtgtttaggtgggaacttactgccatggtcagaaggcctttttcatttccagctctggaatctggaattctagaaacacacacatgttgaacaagtatgtacactgatgcgcaacccatctgtagttctcattggaaaatgccccagccctttctgtggctagaaattggccttcatgactctttggttaacatctccccatcaagggaatcagccatcctaggacacataaaacaacagatgggatatatacctatttctaccaaaaaaaaaaaaataagtaaataactcaaggagtgccataacttgtaattatctcaacacaatagaaatatcaatgtataatcagaatgtaaatgatgtgctaggttctcattaaatcatgcttttctagaaaaataaagacaaaataattttcatccactaccctgttgccagagatccatgtgaatcagagaaggtaaggatggacatgacctgttctgtctgctttcttatccccctcgccagtgaggatgtgttagctacatacaatattctttccagaaccttttaattatttggaaagaaagtgctatatggtcaaggagaaaatcctcagataatttgtattctttctctttagaatatgattttaaaatctagacgagttaactcatttgcctctgcaaatcgagcttgaatgaatgcccaaagtaaggcaggtggatggaggtgtccactcactgccatctgtctcttagaattaaaattgtcacgcagatagctcagagcaaaaatttctgagagacttaggctagagtcaaggtagcaagaactttgcattgatgacatttcaagttgcccatggcagatgggtgtgggtatgatacatatttttgaataattttctacgtgcttctaaaaccttcaactcccccatccaaactctttgggcttaattacagaaccgcagcattcaaaatactcaacaacttattgccactcattggcaattaactcagattatcacaaaattgatacaggaggtccagctggatgaataacatgagctggctagagaagggggaaaattttgtcatggaaggagcattaaaatgggaagttggctatctggggattgtctgtcttttgttgtttgttattttgtctgcaagatgtccttatcaaaacttctaccttctctggacttcagtatttctttgctagtagaataaagacattgaacttgaaagtgactgtgctccatcaagtcatgcatgtctaaagggcttcagctgggctcttggggtccacaagagaagtttcttccttaaacattcttgaaatagcacagactccctttctgtcagccatagccatgctatctatgtcaagtctttctgacaaattggttcagagaataaacacaaccatgtttttatcttctgcatcataggtaactacacacaggtaacagcttcctaaggaatagcacattgatgatctcatccagtctgattaaaccctaagtcaatgcagctttcagtgtttattgcacatttttttcattgccttcttttgaggcaataagtagtagggagtgcggcaaactgattaacagagttatttcctctgggcctaggactctgtaatatctcccgtttctgtttcttcagggatcacaaatctgatctggtttctaggattaggtccctcatgtctgattttcctttttcctatatttttggactttctagatcatctgtaggcactgcccaaaagctgtctttgccaaaagaggagcagtcgttagaaatttggggtgtggaaggaaataattgtcccaaaaatgtccctgagcaccaccactcccccgaccatgataaatttcttgccttggaccattctttgtgagtcaatgaaagttgttttgctcacataccctaaaccaacgggtttttcacattagggttaaaattatttaccattcaaatgaaaacttatgtgatgcttcacataatatgtcatgagaggaatgtaacttaaaacaacgagagaccaccacacacctattagaatggccaaaatccgaaaactgacaacatcaaatgctggtgaggatgtggagcaacaggaatgcttattcattggtggaaggaatgcaaaatagtacagccactttggaagacggtttggcagtttcttacaaaactatccatactcttactatactatccagcaattgcactctttggtatttacccaaaggagttaaaaatgtatgcccccccctcccccatacacacaaaaaaactgcacctagattttttagtgcatttatttataattgccaaatcttggaagcaaccgagatatcctttagtaggtgatatggtttggctgtgtccccacccaaatctcatcttgaattgtagctcccataattcccatgtgttgtgggagggacctggtgggagataattgaatcatggaggtggttcctccatactgttctcatggtagtgaataagtctcatgagatctgatggttttacatgaggttttccccttttgctttgctctcattctgtcttgcctgctgccatgtaagacgtgactttcgccttctgccatgattgtgaggcctccccagccacgtggaactgtgagtccattaaacctctttctctttataaattacccagtctctggtatgtctttatcagcagcatgagaatggactaatacagtaggtaaatggataaataaacagtggtatatccagcaatggaatattattcagcactaaaaagaaatgagctatcaagcatgaaaagacatgaaggaaacttaaatacatattactaaatgaaataaaccagtctgagaaggctacatactatatgatttcaactacaggacattctgggagaggcaaaactatagcaacagtaaaaatatattggtgtattccaggagttagtggggagaaaaggatgcatatgtgaagcacagaggacttttagggcagggaaattactctgtatgatcctataatggtggatccatgttattatccatctgccaaacccatagaacgtacaacatcaggagtgaaccctgatgtaaactttggactctgggtgacaatgatgtgtcctcataggttcatcaattgtaaaaaatgtactgctcaggtgggggatgttggtaatggggatgggggggttgtgcatatgtggggataggaagtatatggaaactctctgtaccttcctctcaattttgctgtgaacataacaaatttctaaaaaatagtcttttaaaaaaaaggtaatctgactctaaaaatctgactctaaaaaaacatttaaaaaatgcattttaggttgggcgcggaggctcacgcctgtaatcccagcactttgggaggccgaggtgggtggatcacaaggtcaggagttcgagaccagcccggccaatattgtgaaaccctgtctctactaaaaatacaaaaattagctggacatggcggcgcactcctgtaatcctagctgcttgggaggctgaggaaggagaattgcttgaacccaggaggcagaggttgcagtgagccgagattgcgccactgcactccagcctgggtgacacagcaaactctgcctcaaaaaaaaaaaaatgcatttgaataaaatattttggccaggtgtgctggctcatgcttataatcccagcactttgagagggtgaggcgggtggatgagttgagcccaggagttcaagaccagcctggacaacacagcaaaactctatctctacaaaaaaatacaaaaattagccaggtgtggtggtgcatgcctgtagtcccatagtcccagctactctggaggctgaggtggaaggattgcttgagcccaggaggtcaagtctacagtgagccatgttcatgccactgcactccagcttgggtgagagtgagatcctctccctctctctcaaaaaaaatgcattttatttatagaaattaacacataatatttatttaatgtaagttcaatgaaccagatcaatagagttattgagatgtgcataaatgcttgaaatccacagttaaagatgacttgcagtcttatcaacttccgggtcaaatttctttctttgtttttttctttttagagatgggatctcactgtgttgcccagaatcaactttctttctttatcttgttctgtctgcagtattgagaaaaccctgattaactaaaagaaatagtcacacatgccaattctgtgtgtgtgtggggggggttatgtgtgtgtatgttttatgtattatgtgttgtgtgtgctatgtggggagttcatgtgtgtgctgttgcatgtgtgtgctgcgcatgttgaactgtgtatatgctgtgtacgttcaatttgcaagcttcttcaatgaaagaatcttggaagagacacgataggacatttgtttcaatgtgaatagctcataatatctctcaaaatctcatattcctcttgctaagaccaatttggagaaagctgataaatgagattttcagccagtttaattttcatttttgagacatactttccaaatatatgttactattatgaaaaacgtaacatatacacttacatatgtatttatatgtatacttgaatataaaatgcctccttgtcagtctcaggcattcattcaatctcttttaaaaccctcacatttatttatattgttgtgtaggaaaaatccactgtggctttactgctgacactctatctgcaatggtaaacctaatattgacactgggtattaccaaattgtacctatttagattattaaaaacaagacccaaggcacaaagagtggttctgtgtcttagcagtatttaatagaatttctataactgcaaaagaaaaaaactaaaataatgcaaatgttaaatgtatgtatattgacaattacacagtcctatctgtggcattgcctcctaacgatggacttaggtaggaaaaagtaaattcaaaacttgtatttgaactattacatatattgtgaaaatatatccaccaagatatctgtacatcagtacaactgaaatagaacaaaagtaccaaacactggcatttcttaatagctagtgtttaactaagcaatataaaatgacttcactatctgctggttacagctttatgagcacccctcttccaacagtttttagtctcattggcttcggaccatcaattaaaggtcatgtcatttttgccaacttatccagagagtgttacaatgggtctaagctctttaaaatgtcctctgcttttattcccgtgtcaaatgatttaaaacctcatgggagaccttgaatcacaatcaccctattgagctgctccagaattttctgaccctacagaaatggaaagacaaaaagtgtgtgagttttttggggaggtcattctaaaccactgagttttgagataatgtattatgcagtgaaagataactaatacagccatcttctttcacctgtggtgtccagaagctccaatggaccaaaggcaaagctcaaagtgactaagaacaggctaaacaggggcaccctggctctaatgaatggactttatcctcctggagcccttgggaatgtaagacataattctgcgtctcctgagcccttgaaatggcagtgtttccgtgaattaaacaccactttgggctccagtcaccctgataactgaaaactcagtctgagaactgtcagaaaacccttcagctggtccagtggccccagtggagggtgttaatgagaaacaagacacaaatatcctataaaaaaagaaagggagtattgtgaatgctaccctaggtcctattgctcaattaatagggtagtaataagaggaactaagccacacacacatacacaaaaataagcactgttctgtctatattaaaaaatgtcatgggagtgttgagaaaaaggtgaatcaacagcatgtcgatgagcgatggaaggtgcagtcccaaaagatcagcatgccactctgacgtggaaatctccaccctatgggaaccatgcccctccagattcaatatggtcctgaaatcaaactccaatcctgtccatgaagaaaattctgcatcatagttttgctaactaaccatcagtgcagtcttcctgctctcctctgagtgaaacttgaatttacctgtccaaacaaatatttaggaagcattgaatatttatgacactgtgttggttgccaattgcagctgtaacaaatgaccacaaaaactacataaaattttaaccttacagttccaaaggttttaagtccagagaggatcttactggattataattcaggtatcagtagggctaaattcctttctggaagtcctaggggagaatccattgattgtattttccagatcctagaggctgcctgctttccttggctcagggatcccttctatcttcaatgccagaaatggctgattgagtgtttctcaccttgaacctatttggttctctctgatgaatccacctttcccatatataaggacccttgtgattacactgggtccatctggatactccagaatcatcttctcattttaagttcagcaattgattaacaactttaattccatctgcagccttaattcctccttgctatgcaacatataacatattcacaggttttggcaatttggtcatggacatctttgggcaaccattatgctgccagctacagatagcttacttttttccagagatacaacagtaaataaaatatttgccctgccatcttgggtctccaattctaacggggaaaatggtgtgcaaccaaatatttcaaccatacggcccaataagaacatagaagacatgagtcggagacatcagctggataagtctcctcaaggaggtagcatttgagctaaatcttaaagaacaagtattctgatgccaaattgtattaggattctccagataaacagaaccaataggatatataggtatagatataaacacagatatagatatggagatatacaagatgggatttattatgcaaattggctcatacaattatgaagacaagaagtcccacaatgatgccatattcaagctggagaaccaggaaagccagcagtataattaagcacaagttcgaaaggctaagaaccaggggaatggatgggtaactcccagtatgaggccaaattcctcagatcagggaggaccactagtcccagagtctgaaagcctgagaacgagaagctgggatgtctaagggaagaagatgaatgtcccagctcaagaagagaaagcaaattcacccttcttctgccttttcgttttatttgggctcccaatggatttgagaatgcctgcccacattggtgagggtggatcctctttacttagtctactgattcaaatgctcatctcttccagaaacactctcacagatacaccgaaatcaatgttttaccaactctctgggcctcttttagcctagtcaagtcgacacttacaatgaaccattacacaaatgaatgctgatggtaagatattgagctccaggtaaaggtatatggaatataagacctacaaggaaagttacttggagtccttatgtaaaaataaataggggtattgagaagcgtgaagctggggcaggacatgattagacctgcatgtgaaaacaatctctctgaccaaaaaacgaagaagctgggggcaagaagaccagttacctgtgccttaattccaataacaagctctttttttgttgttttcttgtatgacaatcaacctcgcagtccattccaaaaatggcaacttttccatccctaattgcatgctttaatttgcagaccaatgtttcaagtccttataagggctggaataacatccttcaatcccagtctcttagtacctggtaaaaccatcccagtccaagtccttggatttgcctgaatttccttttagagcattcccagcatgaaggattgtgttcccttaactcagctatgtcttcctctcttttctttacactcactgatatcttgaaaggacagattgaatattttcaaaagtagaagaaacaatcctgtgaaatagcaaatagtccttccctagaaatattcagccccttaatgatgatatgaaaactacgagaaatactatagaagggagggttgcattgtgaggaagtcttgctggggtgccttttaggatgttgctacctaaagtggagtctgtggatggctgctattcccaagtcattaccaatctgcaacgagttaagtaaagaaatggagagtaagcattttaaaatatgtacagcacttcaatagagtaattgtatagctcttgaatctaatagtaaaaataagagcttgtatttgtaggtctctatttcttccttctcaaaacttgtttttatttataaaactgtactgtaaacattgtaaacattggttttggaaacattggaaattttttttgaaaagtgtcagttttctctgggaggccgaggcgggcgggcggatcacgaggtcaggagatcgagaccatcctggctaacacggtgaaaccccgtctctacttaaactacaaaaaaattagccgggcgtggtggcgagcgcctatagtcccagctactcgggaggctgagccaggaaaatggcgcggcgtgaacccgagaggcggagcttgcagtgagcggagatcgtgccacggcactccagcctgggtgacagtgctagactccctctcaaaaaaaaaaaaaaaaaagaaaagtgtcagttttggatgtttttccatctctccagtgtggtaactcaggtagacacaggggcatggctgtgagactccctctcctacctgctctcacttggcctccctgggatctctactgccccaccctttgcatttaaatctccaccaaaccctactggaccttccattgctcttgtcatcagttttgaccttagctttggtatcttaaactatgcacttcagattcaaaaaaggcatgtcctcaaaattctaacttgtattaagaaaaaatgagtattactgatgagctactttgttctaacaactactgagtattttatatattaatatattgtcttttacccttacaatagccatgagggaggtgaaacaccttatagacaaggaaagggagtctatagacagtatgcctgagctggtttgggaccagtgcatgttccttctgtgctctgtcataatttatatgcagggatcatgcctagtttcaccaaataattataatttaatattttcctagttcagggtcataatccatctaaagtccagctatgctgacctaaaactataaaaagtgctctacaggaagctctgtggtcacttttcataaaaccctttaaagatctgaattctaagtagctaattgcaaaggttctttgctaaacagtaaaatgaatgattttaaaggcattatttaaataggatataaattttgatgaaaactctgtggctcttgcagaatcatgaaaatgtcacttatataccttccctttctcgaaggcaggttgtcaggaattgacatttgattatgcaaatctattttctaagactaaattacagtagaaagatccaaaacagaaatgattttagagttgtgtactgccagtacccacccccaaaaaaaggaatttaaagaaaaaaaaaattgcctaaactcaaactcttttagaattaccataaaatctaaaatttcaatacagtttggacaaagagaaaataagaattcttgtctcccattaaaaatctgtttaatcacaatcttactttatttttctcccttgtctgagccaacacaatcttacttttaagtgacacaaaaagatcccaaccttcatatattatcaaccttaaaatcatatctgccacttggctattttgtgtgtcccagacaatgacaaaactctttatgatcaggatctcattgacttctcacaatatccagtattacacaaatgaagaaaataagtgtattggttagctattgctgtataacaaatggttccaagacttagtggcttaaaacaacagccatttattattcctcacatatctctgtgaatcagctggcatcagaatcagaagcatttctgatctagaatgagcttattggtcttgggtggccttgatcctgcattcagactagcctgggcttgttctcatagtagtgattgggtcaaagaaaggaagtagaagggaaaaagtgctttgtgaaacctctgcatatgtgatattggccaaagcaagttacaagactaagtccaggatcaggaataagagaaactgcaacatagctgagtcctgggctggtttaggagtcgggtctgaatcccgtgcatgtgctttctaccttgcctcatgaaatttacaccaagggatcctgtgtacatcttcactaaacaattacaattaatccttacctagtttagagtcaagaaagtggctgttgtcctgctgatcaaatttataaacatgcaccacaggaagcagacagagaagcacttttcacaaagccctttgaagatctgaactgtaggcagccagttgcaaagggtgtggatatagggtggccgttcaacagggcagtttgtgcaatcagtcaattacatcaaggctgaaataatttaacaagttatccaccatcaggcaactagtaatttgaaaataggtctgtgggactccaaagtctgcagtcgagaggccgttttacctctgttatatgggactaatattacggattttatctggcttatttgttgaaaattttgtagacattacagatggagagaatgtgaacactgaagctgtgactgtggcaacaccagaatgtaacagatgctgcaaacaaaaatgaggtgagacaatgatgtgatttggatgtttctcccctctaaatctcatgttgaaatgtgcttcccagtgtcccggaggtggggcttggtgagaggtgattgaatcatgggggtggatccgtcttgaatgacttagccatccctttggtgataaggaagttctcaattagttcacgcgagatctggttgtttaaaagagtctgggacttccccccactctcttactcccactctcatcatttgatatgccagcttcctgaggcctcatcagaagcagatgctggagccatgcttgtagagcctacagaaccatgagccaattaaaccagctttctttgtaaattacacagcctcaggtattcctttagagcaatgcaaaaatggcctaacacagttgggaatgcggaatttaaaaaggaagtattccctaactctcagatcccttcgccagatcaaggacgtgaaaatggatcaaaccgtggaaggcacgttcctttggggaagttacaaagagtgtgattcccatttccctggagctgggaagtatgtggggtggtagacccgcacgtcagtgtgaagaatgtgacctctattggaagccctctgagagcgtgatgccgctccttgaaggtgagatgtaccgaagactacatcaggcgcctagctcagacctgagaagggaaagtgggtcatgcgagcaagtgtctcagggttcccccaacgttcaccacccaataatttgtaccttgacttgaatgatcttaacatgtgagcatcatttaatgaatatgagttttttcaatccagcttggtgcatcttaggaaagcctcaagttgtgcaaatctggtgtgagagtagaaagacctctacgtggacactctggattctttatgcttgagtggtaggacctgggcaagagactcaagctctctgtttcctttttggtatcctagatcatattgacctggccaaacttacaagttggttggaggcttaaatagagtaatggatgagcatatcttaaaaagagtaaaatgttatacatatgcatttaatcatctcttgcataaatacagagccctgcccccatgtgccccaaaaagccaattctaattttcttagattccaggcactctcttctaactgatccaggtaaaatctactatgaacctaccatagaaaggaggaagcggatggatgtgctgatgagtaaatataaagaatgagatttctgtaagttcactgcatataggacaaactctaaaatgctaagtagttatgtccacagcacagtaaaaaaaaccaatccagtttcctgactgtgagcttacatcattctttacagtactacacattcccaaactgcctccattccaaacatagcattctatttctagcattgtaaatcaaagcaggaaagtgttggaggttttagaaggcttttgcttcacctttcttaaaatgtacatgagtttctctaaattcctgatcaagacaacatttatcttcttcaggcacactcctgtggttctagaaggggcaagacataaattaaaaaaaaaaaaggagattggaattctaaaagaataagcatttgaaaaccaccaacttcctcaaaatttacatgactgtgcaggtttccacaaacactttcactacatgctgcggtcatcacgctccactctgagtccctggacagaaaaataaagtgcacgtcagttgttcaggaatttaatatccaatgggcaaggaagctttgctgcagctacatttattttaaaaaataggattgataagatgcaaggttggagacacgggtggtggttgttccagacaacgtcctaggataaagaattactgtttttaaactgaaaactgaaaatctagccaacaccaatttgtcatagatcctaaagaaatccacagaatcagagtatttaattaatctaaatgataaattgcctatgaatctcaactgcgcaggcagcacctatgagcagaaaattcacacaagaaagaaaaataaatgggaatactggtggtgttagaaatttaccttataaacaacattattctaaattttgcagcctaatactttggagtcttataatatatttgctcataatccccgaaggagtgaaaaattagcagtattctttagggcttctccaaagatgtatagccatgcacatttgctgttgccaaatacacacatttaaatgaaaatagctgacacctggtagagtcaccctctggagacatatacagaaacattaatctgaggttaacccaacaacccaatgtagacatgatgtactatataggaaaataaaatacacagtcatatgattattcatctgacagtaatagtgtagcctccttagggaaaaagataaagggaaaaatccattgaatattttgaaaagttcatttttaatcacatctcccaggcatctaacttatttgtaggctttgcaatcatacagatatataaatatatatttgaaatctcttcccctggaaaattaccattctttaagagaagacacctcctagaatctatcaaagaaaaatcacgtttatatgaaaagatcattatttcctttcttgaattctgaagcatctttgaagagggaggagaatttgcaaaatcaggaaagggctgctctcagaaaatccaatcacttttcaagcaatgatacaatgccagatgttaaaatttgtctgaagatttctagagaagtgaaagcaattagacgttatccttcatttcttctgttcagaatctcattaccaaagattgcagacgtgtcggttatgatgtacatcttgcaggtggcactttgtcattgttaaaataaagtggggtagaacagaatcttattataatttttccttggtggggtgggatgaaagagaggaagatggagagaaagggagagagagagagagaagggagcgaggaattagatgctatgcatatacaataaaccttattaattgcattattttgaaatgttatttcctagttacgataattacagggcattttaaaccattttagcatgtaacacacaatgataaactctatcatacgtatcttctgtgatgtggccacaaaagaaggctaccataagaatgtcacaccacagctatcccatgggcactgaaaaccagaaagcaatatgggtatcaccttaacacaggcaccaccaactgtggaatcagggacacagagtccaactcttgctccactcccaatagcaaaaaaccttggccaagtcaccagtccctttgtccatgcaatgatggagtgataccacatcatccccagaaaccttttccaagtctacggtgccttaatactaactaattttgactgtttccaacagctccaagggtgtttctgaagaatgaatttggaacatgtggtaaggcagatgacaatgtcttcatttctatatgtcaaataaagcctctggtctttttctactgacagctgaggaattcatgcagaagaaagtaacaacctgtacagatgcatttgaccagcaggcttgcataattccaggagcacctactctgtgcatggctacaggagaaacagcagaaataagagagacacagcatggtctccacccacaagtccagctctccctgcaagacattggaagggcatactggtgtcaggcagaattcactcagtacacccccaaaattagaatgtaatgtgttcctgtcagggtaagatcaactttgcaaggccaatcgggctgatgcatactcagcatccctttgctgggtcccagcagccagagctgctgatggtatttgcaggctggcaggggtgttgtctgctctgcagccaacctacagcacttgggtgtagggctcaccaggaaaaggacaaagccatccagctccatgatcctcatgctccttagggtctgtttatagcttaaaaaagtgcttaagttttgtaaaacagccaacttcactaaatgattgcaaattcattctcaaacaataattgtgaaaaccattcattaagctcacgtcattttattcagaaagagagaaaacaagaggtgatttttaaaatagactaatatctttaatatttgtaaacactatttttaatattttttaataaagagactaatatatttaatgtatcatccatgtgttacagtctcatcaatgtaccacaatgtagcagtctctcattgtgaggtatcacccggagttctttgtctcacaaccaagagaattgaggagcatggatacaaaggatgaggttggaacaaaagtttaataagtgaaagaagaaagctctctgctgcagagaggggatctggaaaagggttaccacttttacagttgaatgcaacggcttttataggaaactgatgagggccaggcatctcttttgcataaggcacacatttctggtagctccaccacttcctactaatgcacatgcaagcccttagactccacattgctttgctcctcttattgctcatgtgtcaggggacagaattttccattgtaggcacgtctgggcaagtcacctgtgtagactttgttatctatgcagctgtcggcatgtcttaggcaagcccccctgtgcaagttcccttatctatgtctacaggctgttcttttgtttgaaagaactcaacagaagacccaccttaactgcctgcctgcctgatggggtttttttctttctcctctctcacatggaacatagtcattatggcaacttggtgggaattccgggctcatgttaaaaatttcctcccatagctcccaagtccaaagtcactggtatccatgaacagtaagtggtcttgtcaattctgaaaatattccccccttttgtgtgtgtttttttttttaattgggattaagctcacataacatgaaattaacaatttaaagtgtgcaattaattccatggcatttagtgcattcactgttatgcaaccatcaccactatctacttccagaacatttttgtcacctgtaaaggaaaactcataccactaaatggtcaatccccattctcccagtccctcactcccgaggaccaccaatctcctttccatctctgtagatttgtcaattatagatatttcatataaatgaaatcatacaatatgtggtcttttgtgtctggcttcttttacagagcatgtttttaaatttttttttaaggcaatgtttctgtcttgtttcccaggctggagtgcaatggcgcagtcttggctcattgcaacctccccttcctgggctcaagtgattctcctgcctcagcctcccaagtggctgggactacagccatgcaccaccacacccagctaatttttgtatttttagtagagatggggttttgtcatgttgcccaagctggtcttgaattcctggcctcaagtgatctgcccatctcagcctactaacgtgctgggattataggtatgaggaaccacacctggtcttacagagcatgtttttgaggtccctccatgttgtatcacatatcagtacttccttcctttttataactgaacaatattccatctcctttagtttttaatcttctataatgtgtatatcaaataaagaccactctactttcacatgcagtttttcttttttaacactctgactcatagactactttttatcccagagcaattgtgatgcatacactctttaaagaaattaggattccaactttcaaaacattcagaatcagaaaaaaagaaaaaaaatctgctagaaatgtggagctacttactaccagtcatctcaggttacaaagattggtctgtgtaattttgtcgaatttcaaaattgaaatccactttttcaatccagtgctaagccctttctaaatagagctgacccttgaacattgcagaggttaggagcaccaactccccgtttagtcaaaaattcaaatataacttttggctccccaaaaacttaactactaacagcttactgttgaccagaagccttactgatactataaatggccaattaacatatattttatgtattatatactgtattattgcaatgaaataatctagggaaaataaaatgttattaagaacgttataagaaagagaaactatatttactattcatttgatggaagtggatcatcataaaggtcttcatcctccttgttctcacgttgaagaggctgaagaggaggaggaagaaaaggggttagtcttgctgtcagaggggtgcagaggtggaaggaagttcactgataagtggatcctcaaactccttgttcaataaggttaaaggttaaagaaagttaaagaagataaatgtgcattatctatttcaagttcaactctctagtttgcaaaagtaaaattgacaccttggtataatttcatgagacttagttttttaaatgagttacagtagactcttgaacaatgagtttaagctgtgaggatccaagtatcagtggacttccttccacctctgcacccctgtgacagcaagactaacccctcctcttcctcctcctcttcagcctcctcaaagtgagaataaggaggatgaacacctttatgatgatccacttccacttaatgaatagtaaatgtattttctcttctttatgactttcttaataacattttcttttctctagcttactcattgcaataatgcggtatatagtacacataatttataaatcccatattttaattgaccatttatcttatcagtaaggcttctggtcagcagtgggctgttaatagtttaagtttttaaggagccaaaagttatacttgaatttttgactacacaggtgttgatgtccctaacctctgcaatttgctgggcttccctcgatgccctcatagagctggtagccttcccttccctgtcttagatgtttatccatgctatgtcctacaagcccccaatccccattagatactgagtctttagtttgaatcctccgtctatattcaattcaaacatcactttgagtggccacaacacttttgaccagcattttaaaaaatgtagtcgggggaacaattgttttgaaagacactgacagatgctaggattggggatagtggaggaagaatggtgatgcaatgagtctaaaaattctgaattaaaacaagcttcaaccagtgtcttaccgccaaggtttcctgatttgcatatcttgagtatactagtgttctatgataggggtagacattagaacatttcttggttttatttagtctcaggaaccttgcttcaacaaccctctccctgggctaaggttcctcagtgcaggccgtggaaatgattctctcagttcttgccagatatttataccttagaatgaaaaatatatctaggagcaaatgtggctagcagttggggggtgagctaaggggaactgagctcagaaggggacttgcagacattaaccaggcttctgggaagccctgtggctttgagatcggaggaactgaagataaacttgtctactttctaatattgctcttacgtgcatgtgaactctgcaggcattaccaatgttggagaggtgcaataggaaaagaaagctgctctgttcaaagaagggatggaggtaactggaccctcaggaaagcaaagatcacatggtgaccaccaagcaggtgaccatccaaagacaaaaactccttatcagagggatttagaagtaattagactcacctattatctgcagtgagcacctgtttccaggcttcttttcaacttacaatttataggtgactagaatttctatacatttctggaatgcatgcatgccgaaattcattgtgcaacccttgctcacattagggcaccaaaatgcctacaaatgcaatcatttatcatgcaaattacctctcagttcccgctttaagttccataactgctaaggaaaatgcacctcggcacacagtcctctcttgccaaggcacccagctgcatgcttttgctgagttttctttctaataaaattttcctttttcaaacctacactgtcgcaaaacactttctgatgctggggttctgacaccttgcatgtcaggcacctctccacctgtgatgactcattttatgcgtcaacttgacgggcccacagggtgccctaacaattgattaaatattattttgtgagggtgtttcaggatgggattaacatttgaattgggaggctgaggaaagcagatcgccctccccagtgtgggtatccttcatccagtccattgatttcctacctgatttctgccactttgacttaagtaagccaattaagaagacagatgttttagcatccatacgtatattcaaattaaattgaaatttgtatataccttgtattaaactgttttaaagtaaccatggctagttagatggttctgatctggctgctgttatgaattacagatatactaaacgaaagaatgtccatgttccataccgatgtgtttagaacaaaaccaagaggttaaaatctgaggaaatttagtgaacattgatttatttgttcaaaaaaagcaaacaaaacaacaacactctaccaagagcatttaccctggagcatgggaaatactttcaggcagagagaatgaagaataaaagtgttctcccaaaggaacgtgaaccacagaataatcagaatataatgtggcaaactgggggaaccccacggaagccaatatttggaggagcacacaaggggttgataaagctgcactcatagaatttcttctgagtagagagagaaaaccgtggaaattgagacatttaaatgcacctgttaaatatgtttcaaattatgggaattttttaaaattattatgatgattttgagacagtttcattctgtcacccaggctggagtgcagtgacaccatcagaactcattgcagcctcaacctcctaggctcaagcaatcctcccacctcagcctcccatgtagctcagactacaggcacatgccaccatacctgtataatatttttattttttgtagagacaggttcttgctacgttgtccaggctgctcttgaactcctggcctcaagcagtcctcccacctaggcctcctaaagtgctgggattacacctgtgagccaccctctgtgccagcaaatggtggggatttaaaaatgagatgtaaatatgtctcttggtcttctatgccctcctacagaaccttggctgccatatgttgaacactcaccctgtgccagcctttattacaggttattaactcatgtgagacagtaaataatttgcctggtctttgtcctgggttcccagcacagaacttctgaaacctttggaatttcctgagagaattgtgtcttccttatggtaatgaggtgactcagggtgcactgaagttaatagcgtcaggatgggggctggtcacaagaaagaccaactatgtgattggagggttggggggattttcatctgcctgacctctggcgatgggagacagcaggagatgaaagtcaagaacatggctaatacttaattgatcatgcttaccaaacaaaacatggataagaactctggacactgaaactcagtagagcttcctggctggtgaacatcttgatatgctgggagaaggatgtaccctgattccatggggagagggtacggaagctctgaattcccaattccctcccggatcttgccctatgtgcatccttttttttttctttcttttttttttttcttttttttttttgatacagggtctcactctgtcatccaggctggagtgcagtggcacaatgatggctcaccacagcctcgaatctctgggctcaagccatcctcccacctcagcctctcgagtagctgggaccacagcacacacaccatgccccactaactttttaaaaattttttgtagagatggagtcccattatgttgtgaaggctggtctcaaactcctggcctctcaccttggctttccaaagtgctaggattacagatgtgagccccaggacccagcctatgtgtatcctttgtaataaaactataactgttaagtatagtacttcctgatttagtaagttctagtgaattacagaacttgagggattcacaggaacccctgaatttatagtaagttggtacaaagtgcaggtggcctggataccaacagtgtggctggtgcccatggcatgggaagtcttcttgaggattaaatcctttaacttgtggggtctgagctaactttggatgattagcacgaaagctgaatggcagtacactcagttggggttgcaacagaataatacctgatatgacttggctgtgttcctacccatatctcatcatgaattgtagctcacataattcccacatgccagtgggaggttattgaatcatggtggcaggtctttcttgtgttgttctcatgacagtgaatacgtctcaggagatctgatggttttataaaggagagttcccctgcacacactctcttgcctgctgccatgtaagacatgccttttctccttcctcaccttctgccatgattgtgaggcctcctcagccatgcagaactgtgagtcaattaaacctttctcctttataaattacccagccttgggtatgtctttattagcagcatgagaacagactaatacaacaccccagttacacatactcccattaccattggaggtgaaaccacctttgcaaaattataacagtgggagaaacctgacatagttgactccatcttgcttctgacctccaagttgctttggtcattcctggacataagtcaagctaactttaggggaaatttaggttgtagtttgacattaaagcaagaatgattataggtcttccccaaaactaaaccagttttgaaaggccacaagaataggattatgggaagggcttgtactgtgctaagatttaggcatagattttataattccttactgctcaggggtcatgtggccagaggtcacaagaactgtgacctttgcaattgctcccataaataacatcactattgtagaaccttaaattgtttttttctgagttgtttttcagactgaccacagcaggactcatgactcatgacttagctgctcctatggccccacccagaggtggactcaatgtatgaggaccattttccacacccctgctgattggctgtgtgattttacccacagacaatcagcagcacccattccctaatcccctgcccaccaaattgtccataaaaatactatcctccaagggacactgacatgaatgataactctgtttctcctttatgggttggcctcacatcaattaaactctctctctactgcaatgccgtatctcagtgaattgattttgtctgtgcagtgggcaggaagaactcatcaaacaattatagaggtagatattgttataaaccctattttgcagatgcagaaactgaggcacagaataaataatcagctcaaggtcagagagtggttgagccaggctttggacccatgtagctcagtttcaagcccatgttctttaattattattacaattatagatacagagtcttgctatgttgcccaggctgatctcaaactcctgagctcaagcaatcctccctcatcggcctcccaaaatcttgggataacaggtgtgagccattgtgcttgacccctattttttctctttattatttttattttaattttttttaagatacagggtgtcactatgtttcccagggtcatctaaaacttctgggctcatgtgatcctcctgtcttggcctcccaaattgctaagattacaagcgtgagccactgtgcctccaagcccatgtttttctgtgtgtggttttttgttttttgttttttgttttttgagacagagtctcactctgttggccaggctggagtgcagtggcatgatctcggctcactgcaacctcctgcctcccaggctcaagcaattctcttgcctcagcctcccgagtaggtgggattacaggcgtgtgccaccacacccggctaatttttgtatttttagtagagacggggtttcagcatgtgggccaagatggtcttgaactcctgacctcaggtaatccgccctcctcggcctcccaaagtgctgggattacaggcgtgagccactgcgcccagccagcccatgttcttaacactctcatgttctgcctcctaatgaaaagctaatgtgttatccaaactcaaggaagatatattaatgacatatcatgattttaatcataatagaagggttaaaaatgttcaacccttggaagagaaataagtaaacaaaaacgtacatgacactataataaaagaaataatcacaaccacaggtatatctctattgctgtaaatctaagtaatttatctggtattttatagaggaagaaatatagctgtgatgatcccaggagtcatatttgcatatgcagacattttccaacatgataaaagctttggaaatcccatctatattgactttagaaggatctgatgaaagtttcatcaagtaataccctctacttctcttccagctcctgcataatttacatctctgtggaggagccagtcttttgatctgcccccaggaggtttaggcattgaagtccccaaggctatccgtgggctcaatgactagagtctctgatatactcccattccataaaaagcaagatgcatgctccaaagtttgaaacactgcaagatgaggaggctttctaatacatatattaaagggaggtttttaactgtgtatgggactcatggtttctccccatcacctttcccctaatgctttctaaagaaattccatcacatgacactgcaatgcttaatatgtcataattccatgtgtcgttaatgttatgcaatattaaaaatgaaattgtgatattcaaagtgcgcacatagcacaatttgagaaaatgtgacagttttgaaattctgccaagatcagcttgaaaatcttgacgtagattgttcttacagatatattagtctgaattctcccacgagtcaaccccgagacaaggaggtgagtgtagtggccttatttatgcagtggcttatgcaagagcttatccaagaagctcactgggcaagtggggagtgagagagaagaagtaaagagaatgtgttaataagtaggggcttagtcactctcacccctgggaaggaaggtatggtcttggaaacacacccccaccccagggaaggaggcatttgacctccgactcccttttccagtgtctgagggctatcttaggggttttgacccacgtgccgctgagtaagtttcctagggacagagtcagccctgagctgagaagaaggaagccagacatgcttagtgagaggctgtcagcttgctgtgaaccctctagtgcacctgctagcgaactgagaacggtcaagggaatgagggtggagcatccaggcaccttccacagatggagcttaagtgactgtgctgaaagtaatccttgatatatttatttagaggtctcccttttaaggattcagaatgccaaacaaaattctgtcctttttaagggccctccttagcaccatccagactggaaagaccaccggtctatggccccaagcttcccctactaaaaataagaaggctgtaagggacagacatcaggtcttctgttctggcaatatgtctcataccaagaaagcactcaatccttttgttaaatgaaggcatgagttgatgaataccaccatctcctacacattcagttcagacgaatagcagatcatttgctgaaattcctaaagatgttcattttacattcagaagtctgaaagaagaaacaaatgctttttttccaacaacttttttttcatgtcattttaaagcacataaaatgagtcattaaagtgaaaattttaaaaagaaccactaaaagggacggggtttttcccacggtgtctttatatcttcttaattccatttgaataactcactctaagttctctataggaagacaaccatgtaacagaatttcccaaaggttaacttggagagtatataggcatgaagcacagccattactatattttagacaccatggtatgatttccagaaggtcctttccatgattacatctatagtttgaaattttaaaactctatggccaacattgccaatgttggctgattattaatttgcaaaggatggtggatggggtgatggtcgctcacaatattaattaaagactagcaccatccaatagaaacataacacgagccacaaacaggagccatgcacatgattttaaattttcccgtaacctcattttaaaaagtaaaaagaacaggcgaagctaaattcaataacgtacttttatataagccaatatacccaaaatatgatcacttcattatgtaaataattttattattattttagagaaggagtctgctatgttgccctggccagagtgcagtggcattcacaggcatgatcatagcatactacagtctcaaactcctggcctcaaatgattatcctgcctcaacctcccaagtagctaggactacaggcatgtgcaacagtgcctggctatatgtctgtcaataatgttttataaattactgagatattttacattctctttcttctactaaatcattgaaatctggtgtgtattttgcacatagaacacatctcaatttggactattgtccaaaagaagacgaggatggctaaatagtagaaaagagagctttactggagatatcagattgtaaattggggaggatagtctccggtgtggaccaaaagtgctctgtcttcaaagatggaagaggcaggttaggctttatgcctcacaggttctgtattacacagtggagttacacatattcagcaggtttggggggaaagctatacatatttataatcggggtgactgcatgtgcaatgggtaaacatacatgtaacttatgtctcatattcactttggggcatggttttcccattaaaatgagttagaatttggctcttcacatggaaaggtgaactataagacccaaatccaatttgtgtatagcttctataggcgagctgaaattggcatacggtctacggttgcttttcagaaaagaatgtttgtaagggtggtcctctgtccaatcagttacactagtctgggttgtaaaccagaattgggagaggtctgataactcctcttgttaaggacttcagcaagggtatggttctgacagctgcagggatttaggaagttgtcattccagcctagccctgaacccttgaccagtaggtcctactaacttttgtctccttaaccttggggtccatcttagttgatagagtggggtctgttttggtctctcagatcccaggactcacaatgttctaagagcccatagccacatgtagtgagtggccaccatattgggtcattcaagaccagcttatcttgtgggggatcttggtggagggtagagttgaaatcggtgaataggattcaagatagagaagagaatatcttccatagatgtttcatccactggagattccttttgttaatgtgctacatctctcctactcgtaatgtaataacagagttctctgttggtgtccatgtttgtggctgactgtcatgtggcagaaaaactatggtttggaacattctgaaaaagtgaaattagatgaagttaaaaggataagaaaggaagctttgagtgtagaaggtacttcaattgttgggagaataaagagttggtctaggtccagccccactttttggaaccacacaatataacacttgccaaggaatgtccctatttcccactcactgtatctttggtctttgttcccctaatcaaagtagggggccatactggtttcctttgcctacctgcaatacattatcacaaattgagtgccacatttctcatcccacagttctgaaggacagaagtcctaagtgaatctcactgggctaaaacctgtgtcagtaaagacgttcattctggaggctctggggggaatgtatttcctgggtttttccagtttctagagtcagactgatattccttgcctcctggcctccttccatctttgaagccagcaaatgttggccaagtatttctcaaatcacatcatttgattcttctatttcccttttccccatttaaagaatccctgcaattccactgagtccacccagataatccagttaatctccccagtttaaggtcaactgattagcaaccttaatttcatctccacatgaattacctttgtcatgtaaagtaacatattcaaaggtcctcgtaattaagatgtagatgtttggggatagaggtgtcattattttgtcaatctcagtcgcattccattgtaattctttttcattgtcgatgctgttgtgtttgctgaagccctatgttctgaaatgaaatgcccaactaaagtagtgtttgcctctagagtatatgtatattttaatttattgacaactattcttactatttatttttcactcttattatagtttaggggttaggatcagggttattatagttagggctagggttagggttaatccagctctttcctggactaaagtgattattgtgtcttaaatattttttagttttaaaataagtagctgattttctgtaaaggcaactatctacataaaatcatctcaacctccccatcaaaaataccttctaacatatctttctaaattctctctcattcagagacttgcaactgttgcatcagagcacagaaagatttttcccataagacatatggaagaagtgaagccaagaaatattataacacttttagtcacttggtaaatgtgtcaattttgggaactgaaccacaaactcaacagtagatgttcttaccattagcaacatctctagagcttccacattcagaagagcacattccttcttaaaattatgtgaacaagtcattgaattttaaatgagggtaactttttttagacaaaagaaaataactaattgccatttgatggagcattccctcagatgcctatatcatggcagatatgcaaaaaaagtggaacaaatttacacaaacctcataagtcaaaatatagacacatctaagcatgctgagctgattaagctaaaaaaaaaacagattttatttttcttgagggtttagaaataaatttatagctcacagtaaaataggacatcatatctgctttcaaaacaagtacgcacagcaatggaaatgtaagtttgtttttctattttttaagttaaaaaaaatttaagagacagtttctctctgttgcccaggccggagtacagtggcacaggcgtagttcactgcagcctcaaactcacagtctcaagcaatcctcccattttagcttcctgagtagctgtgattacaggcacgtgccaccatgcaggactattttttctttttatttttgtagagataatgtcttgctatgttgcctaagctggtcttgaactcctggcctcaagtgatccccttgtctcagcttcccaaagtcctgggattacaggcatgagccaccatacccagctgaaagtttttttttttttaatttaaaatttatggtttttttttttgtattacttacattataccacagaatgcaagatagtatacggttgttaaatttttaaaaattcataaatagaaaagtaaattcaaatattcccaaaacttgttttttaattcaatgtttgctacaaggagtgcacccttgccacaggagcaaaagtgtgtttttaaatatcaaataaagagaattcatttcacccattggtatttatttagctccagggctgtctcagggaactggggaagctgcgccctgtaacaagtgagcgcatgttggcctgccagggtgagagagaggggcatcaatttgagatttgccttaggaagatggtgcctccttgtgactcctaagggctgcactgctggtgctgcctctacctgcagatcaagtttgcaggcacaaagatgaagaccagggaagatccagtcctaggggaagggcatgtcacagattcagtcaattcttttgacgactgtgtgtgagaacattcactgtagtggtcatcactttgagaactggggtacagcagttaacaagatagatgagattcccagctctatgggactcacattatggtggagaaaaataaaatgtcacggaaacttacagacagcgggacatcacccaacttgctctgggaatgaaaacttcagctggaactggggtgagaaaagaagtccatcaggccccagagggtaggcgtagggtcaggttgagaggatgggcatggatttcaatcatgatttcaatcagaggaaggctccatactcataatgtgttcagattcttttcattgctctccagaaggcactagtagtattccaagatacctgcctatactgaatgcttccaccaagttttccattttccaattgctgagagccctaagaagccttctgtaaataagatctaggtcatctaagtcactctaccaaatcttcccctgagaacacattgccccctacctttcaaagttattgtcaaagctgctgtatccttgttgttttatgttcaacaacaaatgctttttattaaatgtcttctttgagctgggtagtgctccaggcatggcagattcagcactaagcaaggaatacagcaccctcactttcatgggggtcacagtgaagccagcatgatggtggtggtagtggtggtggtggtgatggtaatgatgatggcagtgatagtagtgataatagtggtgatggtggtggtggtagtgatgatggtggtgatgttggtgatggtttggtgttggtgatggtgatgacgttgatgatggttggtgataatggtggatggtgatgatggtagtggtagtggtgacggtgttgttggtgatggtgatgttgatggcaatggtggtgttgatggatactgatgatgtggtgataatagtggtcataatggtggtggtggtggtgccgaaagtggaggtggtagtgtttatggtagtgacaatggtggtcttagtccattttgtgttgctattacagaataccacagactgggtaatttacaacaaacagaaatgcatttggcttatggttctggagactagaaattccaacagcatgacaccagtatctggtgaggaacttcgtgcagtataattccatgatggagggcagaagggcaagaaagggtgagagcaagaggatgaagcttgctttataacaaagccactctcaggatacctaacccaatctcatttataaggacaacatgacctaatcacctcttcttaggccctaccttccagcactggttgcattgggatttcagtttccaacacatgacctttggggaacacattcaaaccatagcaacagtggtgtcagtgaggttggtagtgttggtggtagaggtgacagtgcaggtggcagtggggttgtggagttgggcaacaaacaagcacattagtgtactagaaaaataacagctatatacactaaagacaaagtggaaaatataaaacgtaatgaagtggacctgggctgctacttcaaatgaatggccaagaaagacctctcagacacagtgacatttaagccaagatctcaaagctgagtggcctgaccctgtgctccatattcatgattaagattgtattgaacaggtctaaaggttcaagaatattagcaatagagaataagctcctataaagcttatggtcaaaatatgaatgagctggttctcctataatctcattttctctataaacatttgagaatttttcataacaatattttccatcacatcacataaactctacacaggggaaaagattcaaattagcatttaacatttattctaaagtccactttgtgtctctctatacaaatgtcttttcttaagcttctagaaagtctttctgttcctataaacttgctgtaagtagaaagcctactttatttattctggcatctttatattcttgagaacatctctgcaaaattttatgtcatctgcagaaaatagactttttctggcaatttcctaactattgatttagctgttcttgtgtgtctttaaattaggagccaccagcctggtgttaggccgtgaaatggaaaaattatggggtgagcatctcagtcactcttccctgtcagtctttgtcttaatcctcatttacttttctaatctactttcaacttgacagtgctaatttcctggcaaagtattaattccaaacccagagaagaagaattactaaaggttctctgtagcaatgactgttggtgctctgttcaggttcatgctggcattttatcccccaggatacccattggccagttgagaagaatactgcctgctagcagctcagagctgcaccacctgctctcagccaaatgaaaatatctggagtttacattcctccccagaaggtcccaaagcccatgactgacagtgctccagtgatctactgctgcataccaaaccaccccagacctagtggaataaaacaactatcgttttctttgctcataaattagatggtttgggaatttggactgggcacattgggcagtttgtcctgctccatgatgtctacggcctcaatgaggaagactccaatgaatgggagtgacctgaaaaactggaaactggaattacctggagatttctcccctcactttcttgcgcctgggctggcaaaactaaaaatctgggctcagatggggctgttgagagcaactgcagattgcttttttgtgtagcttgaactcccttacagcatggcagcttctggttacttgggcttatactgtggtgaattgaaattccagcagtgactgtgtcagcaaacaagggagagctcctttggccttttacaatccagccttaaaagtcacatggtatccagtgagcacatgcaaagatcctcaatatcactaatcactagggaaatgcaaatcaaaaccacaaagagatatactacacacccattagcatgactactattaaaaaaaaaattacccagaaggtaacaaaagctgctgagaaagtggaaaaattgaaacccttgtactatttggggagtgtaaaatggtgcggctcttatgaaaaacaatattgaaattcctctaaaaattaaaaataggattatgatatgctctagcaattctacttttggatatatactccaaagaactgaaatcagggtatcaaaaacatatttgtacactcatgttcatagcagcactacttacaatggccaaaatgaggaagcaaccgaagcgttcatcaatggataaatgaataaacaaaatttggtctacccatacagtagaatattgttcaggcttaaaaaaaaaaaggaaattctgacacatgttacaacctggatgaaccaggaggacatcatgcttagcgaaataagctagtcacgaaagacaagttattatttaatggatacagagtcttagttttacaaggtgcagagagttctggagatgggaggtggtggtcattgtaaaacaacataaacttaacagtactgaactgttcatatggttttgctgtgtccccacccaaatctcatcttgaatttccacatgttgtgtgagggaactggtggaaggtaactgaatcatgggggcaggtctttcccatgctgttcttgtgatagtgaataagtctcatgagatatgatgattttataagggggagttccccagtacaagctctcttctctttgcttgctgccatccatgtaagatgtgacttgctcctccttgccttctgtcatgattgtgaggcctcaccagccacatggaactgtaagtcgattaaatctttcttttgtaaatttcccagactcaggtatgtctttatcagcagtgtgaaaatggactaatacaattgaacacttaaaaatggtgacgatggtaaattttatgttatgtgtattttacaacaattaaaaattattttaaaatgtcacatcatgtcactttcaccatattctattgttggaagcaatcagtcttctgccaatattcaagggcaggggatgcaaaccctgtctcttgatgggaagtgtcataaatttgctgctattttcaggtggaggttttttttatagagaccgaatctttctgtttcccaggctggagtgcactggtgcaatcatagctgtctgcagcctcaaattcctgggctcaagcgatcttcttgcctcaggctcccaggtagctgggattacaggcaggcaccaccacgtctagctaatttttaaatttttatagagacctggtcttgctatgttgcccaagctggtctcaaacttctggtctcgtcctccaatctcagcctcccaaagaaattgctgtgttttaaagccaccgcagtggactagagaccagtccctttaccacaaggcagggcaaatctgtagcactatttctgctccacaactcctcatggaatcaagctgaggcttcatctgtaatcagatctctgactgccttctctctccacccactcctgcttccctcatttcctgaggggtttctcctctgagccctccatcaataaatcactggcccatgagtcctcatctcagactgcttctagagaatctgacctaaaacagactgtgaggctgggaatctattaaaaaatcaaaagggcagtggaattttagattttttcagggctgtggggaatatattttgaaacaggaagccttttcatcactccttttgaaggatgtcagctattcacaagacctatcctaatcacttaaccatatttccttcaaagataatgactgtcattcttcctgttgacctgttgttcttaagaaccaaggtaccaactcagggagacagtgtggtcaacacccaaaggccaaagggaacattattgaatgtccaggtgccagccagggtgaccagttgcccttgtttgctccagaatgagaggcttccttggatatgagattttcagtgtcaaaaccaggagattcccacacaaaccaggataaatttgatcacctgtgggaagtttgcatttgtctctgggattttgtcaccctcatgttaaaatcactctccaggcatgtgttagattcttagggctgccacaacaaaaaaccatgaactgatagctttttaaaaaaaccttacatttatttatcatagttatgggagctgaaagtccaaaattaaggcaccagcagattcagcagctggtgaggacctgcttcctggttcatagacagtgccttctggctgtgtcctcacatggtggaaggggaaagggagctttctggggtctctttcataagggcacagatcccattcatgaggctccatctttatgacctcatcacttccccaaggcccatctcttaacatcatcaccttgggggttaggtttcagtatctgaatttgcagggggtggacacaaacattcagtccatacctgcagagttggttccttctaagggctgtgaggcctctctccttggcttgcacacagctgtcttctaccagcaagttttcattgtgccttgcctttatgcataccttggtatccaaatcttccctttttataaggacaccagtgttattcgattaggatccaccttaatgacctcattttaacgtgattacctttgtaaagaccccatctctggggccaggcacagtggctcacacttgtaattccagcactttgggaggctgaggagggtggatcacttgaggtcaggagttggaaaccagcctgggcaacacggtgaaaccctgtctctactaaaaatacaaaaattatctgggcatggtggtgggtgcctgtaatcccagctacttgggaggctgaggcaggagagtcacttgaatccaggaggcggaggtttcagtgagctgagattgcaccactgcactgaggcctgagcaaaggagcaagattccattaaaaaaaaaaaaaaaaaaaaagaccacatctctaaatataaggtcacgttcccgtggtactagggattaagacttcaacatattatttgggatgggggaaggtaaaattcaatccataaccatacataaaggctttaaccaggtaactaagtcagggagcagaaattagggggaagatctagcgatacgaggtatcccctggaagtttgcagatcctgtgacacatggctacattaaaaatcaaatcaacccaattagtgaactgaattacttccagaggtgtctgaatcaaggcagacacataaaaacatcaggtgggaacaaacattctaagttcataagaaacagaaaatcaagagctcccaagcacgagagaaatccctccatgtgcctcaggaagactcaaacggcatagcgctttggtcatcaaactttttgtttttgtacagatgctttgaattttaacttaggggctcttggatccattcctggctttggtatttaatattaactagctttgactatgtgaccaatatcctcagaatctaagttttcctcactggacaaataaaggagtagcaaggaattgctatttactcttttagttctaagttactacgaatcaaagacaaatgccaataacatattttctaaaagaaaattatttcttctggtttactagattcacattgagtaaacatttgcttcaataaatggtaacatgctcctggtctaaaaaccattcattcataatgaaacactgagtagttcgccctgaaaccacgaacaggatttcattgactaaatctatgttaaaatggctcatagattttgtttttacagagtaagcctatgaaattgatcagtattatgataaaataatgaattggcaattatataatgtcatatcctatgtactttaaaagtatgctagctacaaaaacctcaactatatattatactcacctggtattagattatctgtcaaaccccatcagcaataggtaattacccactttttacgagcactataaaaactagttgtcaatcagatggatggagcaaccaatttattcttgtacattgccattacatcaaattgcattatatgctgacataacctaagatcatatagttgtttatccattaagcaaaaacactaatcagaaaaattaaggtttaaacacttctagcagaattcaagtaaatgctctggtaaataatttttcagcctgggcaacaaggcaaaacctcatctctacaaaaaattaaaacaaaaattagccaggtatggtggtgcatgcctgtaattgcagccactcgggaggctgagttgggaggatagcttaaggccaggagctcaaggctactgtgagtgatgatcctcagatcacgacactgcactccagcctgggcaccagagagagaccccatctcttaaaaaaaaaagaaagaaaggatttttttttccaacctgagcatgaatcacaaatgctgactgtacattctacctttttgccccttttagggggggtctcattctattacagattacaaaaatattttatccactttatatgaaagctgctttcataactaaccgcttaatatctaccagtagacatcctttcacagagaaaatagaagtcaagaaccccatctgagtatattaatagggttcatttattattgtttgttaaatgtctcataaattgtttcagaccaagtagagaggaaacagaccaccaatagagatgtaaacattttgaaaagatgagcagttgtctgcagacaattctgttatcagtgtagatgtcagtccaattactgcactctgtagcattcagctgcccaggagaaaactcaaactgggaaactataggctgtgtttatacacgccaaatgaagtgtgaagttgtaccatgctggtgaagttgatccatctagatgccaatcaaatctgttaagtgaaaacaagaagtgtatcctctcttctgactaggtgtgttgctagccatgtggctaagtttcccacggtgttctctcccttggattaaataaatatactgttactattgactaatgtttcttttgggaaactcaagcaatgtttccctccagaagacatcttttctctgagaaatgatgctcatttggatattaaaacctaaatttcaaaatctgaaactaccctccattttcagtccaatgatgactcaaagtcttagagaaagaaacaacctgagacaataagaaatgtatgtggttttaaatgcatttcttacactttccagcaattaattttcatttacgtgagtgcttgtgccctgcaaaatcaaatgttttttaaaattttatttatctttaaatttattttgttttattttgtagagacagggttttgctctgtcgtccaggctggagtgaagcagcataatcatggctcactgcagccttgaactcccagctttaagctatcctcccatcttagcctctcaagtagctgggactacaggtatgcgccaacaggcctggctaatttttatattttttgtaaagacaaagtctcggtacgttgcccaggctggtcttgaactcccagcctcagtctcccaaagtgctggcattagaggcatgagccactgcacccggcccaaaggacttttaaagaaaaattaaatggggcaatgattttcatcagttatacctctcacccccatctcccacacatgagcacacattcataaacttttgatttttcaggcaccaccccagctgttttctgcagaaaggaattaatgaagaacatgattaggtctccaggaaggacttccagaccaacgttaacaaaaacagccctccagggtaattgcgggttttgccacaggtgggagactaggaggctgtccctacaacttcattcagagccctatttcaccttccagaccttccctggcatgaccacttttctctccatctgcctcaactactaatgcaggtaggtgttaagacaatgcctgattggtggagctaaatcccatctggaaccctagctgcaagggagtccaggaaacggcattgttggccttccatcctttgcagtactggactacacacttgaatgatgtggaatacatgccaagtcagtcagttaaccacagcttcccacaaaactactccacatgtaggcttattccctgccaacatgtttgttatttgaaaagcaatggtattttattattacatagttcattattttttctagtatgtgggatcattttaatccatctgcctttcaaattgtattatgtttaagcaggcataaagttaagtcctgacacaattatacagatgatcattgacttaacaattgttcagcttatgatatattgactttataatgatgtgaaagcaatatgcattcagtaaaaactatcttttgagtgcccatacaaccattctgtttttcacttttaatacaatattcaatgaattacatgagatatataacatgttattataaatctgactgtgttagatgattttgcccaattgtaggctaatgtgagtgttctgaacaagtttaaggcaagctgggctaagctatgatgttcagcaggttaggtgtattaaatgcatttcaatttaggatattctccacctacaatgggtttagcaggctgtaattccatcataagttgaggaatatctgtgtgtgtgcatgtgtgtgtgtatatgcatatatgtatacagtcacacacatatatatgtatatacacacatatacatatagacacatatacacataaacatatagacatatacatatatatacacacatatatgtataaacacacacatacatatacctatgtgtgacctatggtcacaccactgcactccatcctggaccatagaacaagaccctgcacctaaaatgttatgtgtgtgtgtgtgtgtgtgtgtgtgtgtgtgtttgtgtacacacatatgtacatatatgtgtctatacatatatgtctatacatgtagatgcacatgtgcatgtatgcatgtttgtgtctatacatatatgtgtacctatagacatatatacatatagacacatgtgtatacacatatatgtgtgtacctatagacatatatacatatagacatatgtgtatacacacacatataaatatagacacatatacatatagacatatatatgtgtctatccatatagacacatatatacattcatatatgtgtacacacacacacacacacacacacacataacactttagatgcagggtcttactctgtggtccaggatggagtgcagtggtgtgatcataggtcactgtagcctggaactcctgggttcaagtgatcctcccgagtagctgggactataggcatgtgccaccatgcctggctaatttttttaattttttgaagagagaggggtctttctatgttgatcaggctggtcttgaactcctggcctccagtgattctttggcctcagcctccccaagcattgggattataagcatgagccactatatacccagccaagcatctgtatatttaaactcctgtacttttgggtcttctttcagaggacaacactatcaattattcatcctaacataaaaaagaatatggagcagtttttaaagaaatagaaaggctacaacaccaaaaattctctctgaacctcatctcttagacttacgggatctgcaatatggcagagaagcatgcggtgccagggcaaaggaggaccataacgtgagaagttttcctatggtgttatcaaggaaggattagatttccctacaagcactctcagcagatctggggtggagaggggatggtgctgagagtcaacgacgaagtcccagcagtcagcccatgagtgtcattgattcagccagttcaataagcaatacccacaggcatctatcagagagctcacaatgtctctgataggcaggcacttcccaatggctgcaaaactgtgactaagcttgttacgagtaattactcagctgagtatttcatgtacagcaaaatctcttgagaagctttttaaaataaaggtctcaagcctcaactctcaagatcctgggcttggactacagaacctgtccccactccctcaagtaatgctgataaaagctggctgagtcgctactgtagagaagctggacaatgccatgggggaggtgaagggacaagaacgcgggttaggcaaacctcatgcaaagcaaagaacacaaccttctccagtttatgatttttctctagttagaaactggagttgcattcttgcagggaaaaaagacattttctaaaactggcttgtacttttagatttcaaacttaaagctattggcatggtatattggagaacctcctccacactcttataaaatggaagcacacacgattttcacatattattttgggccactatcctttcccagaagggtctgctttgtttagctcaagtttaaatcaaagagcagtgttaacttttgttgtgtaagtagtagaataaatattaggtttctctctgaatctgctcatcttcagttatcatgaataacatgaaattcctgccattgaagtaccatgtgagccatcctatattataaaacattacttagttttcctggcttttttttttttttagaataaaggtctcaatctgtcgcccaggctgaggtgtagtggcacaatcatagctcactgcaatggcctcaagcaatcctcctgcctcagcctcttgagtagctgggattacaggtgcacaccactatgcctggctaatttttgaaaatttttcatagagacaagatctcactatgttgcccaggctggtctcaaactcctggcctgaagtgatcctcccgccttggcctcccaaagtgctgggattacaggcgtgagtcaccacacctggtcttcatgacttttcttgatagcatatgttacaaagttttcagctggatgaaattttgagttattagttaagatttcataagataatttacatccagtaacagatggcaatgcagacctgtttccaacagtggcaacagctggttgggtacagacaacagtgtttattctactttcagtgcagtgtgccttgatgagctccttgcactaaagatcaaacaatactttgcatagaagcatgcctggccatacactaaccatcagagctattgcttagaaggccgattcctggctcaatctcagcctcctctcttgtcaggacacctcatgaagcagtaaaaaatggtatgaggactttgaaaaataattttccatggtcagtttcatggtgaaaagtgtctattgaatagcctcctagatggaaaagagcttttctaaataaaaacttaagagcatgtaacatataccctcaatcactggagaagtctaaatccattcctcatggcccaggaccatgttaccccatggttactgttctacatgcagtgaaggaaaaaggcagaggccaaggaggataatgctcaaaaagacttctgcactgcagtgttttgggtgaaatgtccgtgagccatattactgtgctaagattggattatgcttgcattaaagcgggatcatatgtgttgattttgcagaatggccttgaattttgttgttgttgttcctccctctgccattcagcatgtggtctggaagtgaagatgtaacagacagcacaattacacacacacacacacacacacacacacacgtgtacatcacatgcattgagtccaatgtaagagcaacattctagggttctttgcttaaatcctaccactcactatggcatcttgggcaagtcattccatacctctgggtctcagttttctcatttgtgaagcaggttcactgtgcactgatgacccacttgtctgcatccagtgagacagaacactcatgcacagagtaagtaaagtgggtttgttactttcaactaggcagcaagaagcaatagaagctgggacttcatagcaagccactcttccaaggctcagaaaagctgccccgggtagatgggggtctcttctgtgcatgcccaagttgcactgaagctaagagaccccataaatcagcctgccctgggtttcacacctggggccatgggacccgctgggctaaagcattgaaggacatcctatttctatgaggggattggaacagagcctggactgttctaggtaactcccccttatctcaagatgttgcattcccagcacattctatagttattcttaagaactccaagaaaaaaaagaggggagaaccaagactactcaaaggactgtcctgcatcagtggaaacagatgaattacaattcagttagaatgacagaggaatcgttaaggtttttttttttttaatttcaatagatttttggggaacaggtggtgtttgactatataagttctttagcggtgatttctgagattttggtgcacccatcacccgagcagtgtacactgtatccaatgtgtagtcttttgtccctcatccccctcccagcatttcccctgagcccccaaagtccattgtatcattcttgtgactttgcgtcctcatagcttagctcccacttatgagtgagaacatatgatgtttggttttccattcctgagttacttcacttagaataatggtctccaatttcaacaggttgctgtgaatgccattgtcctatcattgaaaatattatccagcccagaatttaagattgtccaaatgtcttcccttcaaatcttattgccttagtttacaaaaacagagggactataaaatatattttgacacaattaactatttcttgtttactattaatttcccaggcagcttggcactaaattaccaatcttactctatgtctggtatggagcactctgcaagtctataattctttttaatatgagatttctgtatgaacatgaacatttaagaagtaattttaaagccaatgcctattccaaataatgagccttacagagaattggaaaataacacaggactgtgttatttcttactgtcagaagactagaattacagtcctggctctgccatctactatatcattcattcattcatctgtttatttattcaataatttaacaaatatagattaactacctaccctgtaccagacactggtgaagttttgtgcacatacctgtgaagagcatgtactcttctctcatgaatcttgtagtttggcagagaaaaagataataagtaaacaaaccagaatgtattattagagaatgaaactttactttttgtttggatctgagtctgccagggcacaatttgcaaaatgcaaacttgaactagaagtctgggcttttctcagtagtcatagaatccacacactatacagagttatatggtcaacgatctcagggtcagtgggctcatttagagcttatgtaagcaaattgaatttcctattacaaacacactccataacttaagacagcaagtgcaatttttataatgagcagttttcaggcatatgtcgttaaactacaaggctcacttcaggtcatcagcaacctaggaagagcatcttataagtaaagactgtagtttgccaagttcagacctaacaccttgctcccaacagtctctctgtttataatcttttactggaattataaatattctctgttccagtggttcttagagtggatgcaccaagctcagggtgtttgcagagatatccctcggtgagtgggaaggaaatgtgaggatttccactttgtatctcatgaatagtaaatagtaatagttcaagtccagattaatgcttcctccctcatgcaagatgtaagatgtgatggggctccccagtagggataggagtgcctcacttgtttttactcatttttattttcagcagattgcaacctttcattaacaagtgcctgcttaagagaatttgctggtgatgccacctgggtttaagtatattaatcctcacaaaatggatgagtgacttaaagcccctacaaaaaaacaagagtgaatttgctaagaatcatgcaagcacaaggaggcaacgcatcacctaacccttgtcagggcattttcaaatgaaagacaacaactctccaataaaatctgataaaatcttagctcccactccaaacaacaatctgaattttctggaagactatgtaatggggtgatctgcatctgctatcatgatagaggaatctctttttttttttactttttttttttttttgagacggagtcttgctctgtcaccagactggagtctagtggcacgatctcggctcactgcaacctctgcctcctgagttcaagcgattctcctgcctcagcctcccaagcagctgggactacaggcacacaccaccacactcagctaatttttgtatttttagtggagatggggaatctcaccactcctgtattgtgtatcacgtgagacatttgataacagttggatgtgtttataatttacaaataatattaggtcggtgctaaagtaattgcggtttttgccattactttcaatggtgaaaactgcaattactttccaccaacctaatagctaagcacaggaaagtgttattgttttatcatggggatacgtgaccacaaaaatctggagaatgatgttctagccactcccattctattgattaagaaatgtaatggttagcagtcccctttgaatgtcatggctgtctgtgtttgagaagaaccatatgaaaatgatgttatgcaaccattttcgggggggctacagaaaggtaatttcatgtgattcaacctatcaaatacaatttggcttttctatttttattaagaaattaagccttgcagggtgggatcataacatcaggagtagtcatgagcggtggttaaggcaataaagaaaatccaactgggtatcaggaaagacaacgactatatcagggatccctggggtggagatgggaacaaagatggaaatatggaatggatctagttgtgcaattatccagggcgatgatgatggaagcagaaggagcagccggggcaagagtcctgcagcggcactgaggctgggttgggtcgctatgtctgaggtgatgggtccagggaaggaggatccatcaggattctaggcaagagaggccacctaagaaaagcaggcaagccaaggaggttggatttcatcctgtggacagagggtgttgggtaggatagggctggctctgcctaagactgtggacactgaattcccttctggaagccttggtttctctgatcactgtgagaataataccaatttcacagaattactgtgagacacacacattcttaaaggtactggtccccacatctggccccatgtgggcacccagcaaacatcaattccctccccttctttgatggactgcatcaatcactttttccaatttttccaattttcataggagtgcctatttaaagaaggtgactttaaaatattttaaataaggccgggtacagtggctcaagcctgtaatcccaacactttgaggggccaaggcaggtggatcacttgaggtcaggagtttgagaccagattggccaacatggcgaaaccccatctccactaaaaatacaaaaattggttgggcatggtggcgctcgcctgtagtccctgatacttatgaggctgagacaagagaatcacttgaagctgggaggcagaggttgcagtgagccaatatcgagccactgcactccagcctgggagatggagtgagaccttgtctcaaaaaaaaaaaaaaaaaaaaaattttaaacaatctgcataaatgccaagtaacaaattcgtctcattgatcctattacacaagaagtagggaatgattagtgactaaatattctacaagcagggactttcagaaatgtttttaaattaataaagtaaaaatgaacaagtgaaaaaattatctcataataattattatgttttgtattctatttccttgtgctcagttttccttattttattaatgcctatgagtaatagaggtagtattcataggtattagtaaatcaattctgtccacatttttaatgttcattcttttttttgtttgttttttttgagacggagtctcactctgtcacccagtctggagtgcagcggcacgatctcggctcgctgcaagctccgtctcccgggttcacaccattctcctgcctcagcctcccaagtagctgggactacaggcgcccgccaccacgcccagctaattttttatatttttagtagagacggggtttcaccatgttagccagggtggtcttgatctcctgacgtcgtgatccgcccgcctcagcctcccaaagtgctgggattacaggcgtgagccaccgtgccgggccttaatgttcattcttatttccatttcacactttcctttttactcttattgtgagggcttctgttgacgttttcaaacaatttgagttttgggaaaggcacttggcatgattccatctttcctttcttttaagaaatatacccaacctagtgtttcaaaatgaggacatcctcctcagagtagtcacctttggaagggaatcactgtgcccaaatgttgatctattagaatagcccatagagtgtttccaaggtgcatactgtcaccactttggggcaatgggctaggatgtaagcctcatgagagaaaagaccatgctgctcacatctttgtgcattctcaccaaaagccagattaatctctatttttatcaccagaattggatgcaattatttgagtgatacaagaaagcaaattcatccaccaagaaggacaatcgccatggagaatgttacaatggacacaaagtcagcaacatgagagacctgccctattcaatactattgcctgcagctctccaaccgaaagcgctaagcccagaaacaggtacaacgtgggcattccaatgctaaaagtattggacatgttcaagccctgatatcaatttcaacaaggaagtcacatgcaacttcctatcactgcagaagtttctggattaaatatccaatattggtttccgaaagtgatcactttgaaaggaataagggttttatgaacatctgtgctgggacgtgacttggaccaacccagtgagtgtttctgtatagtgccatctgctgctcccagatcagactgagatggcattaagtgagcacaaaaccaaaaatctaggatgaaggagatggaaagtttccaggtggtcagttggtgatagcatgaaaatgagattctagcaatatggagaagaagctgacatagataaatcagtgcagaacatctgtgccttagatgccatagaaatgctcacagagaagggagataggacagttacagttgttttccttttttaaagcagtggaaagaaactttgagaacttagagtccaagtcaatgaatatttgagtatctttaaactccagtccctgtactaggtgctgggcagctgctgtctctatgtccatggagcctggagtctcctttggaagacacacaatcaaggttactttttacaaattgcaacctgtgacaatgcatgagacagaagaagattaaaactttcgcctctggtggtggagttttggatctactgaagagcagtttgaaacaggtctagactttgatgtacccgtgagaagagagagttacaggttatttctaaagggtgttatcagaacaagtcatggcactcaacaaggttcctctcctcctacccaatacaaaccttaagggggatcatccaatggtccctgtttataacagcacagaagccaaagccagctcaccacctgtttttgttcatcaagttttgctggaatccagccttactcattggtttgcacagtgtctgtgctatttccacactatatcggcagtgagtagtgaagacagcagctgtacagctgctaaaccaacaatattgactatctggccctttacagaaagagttggccaactcttacttatataatagcagcatacattgcagaaaaaagaaacaaaggctcataactatacatcaggtatagcaggtgtaaggtgatattgcaacaccaaacaaatggaactgaatacagagatacagttacactttcctttaagtttgctatcaagttgctttctaagaatgtatggagtggctttttataatgtataattgatcacttaaaattccaattgtttttctgctgtacaaacatttctattgtgtcttggccttcttgtgaagtggagaaacagaaacatcgtctatgttgtattgctatcacggttccctggccatctgcatctaactgtaaaataaacagctctccagaagcacctatgcaaatatgagcacattcttctactgatataatttgcattaagctgaatcatttcccagaataaattccaagggtatataattttaaactccaattatggcagttgttctaaaatgggtttatccataaaagaggcaggtcctttactaatttacacaaaatttttcacaaggctgataattgaagttctaaaggcaatgagtttaattataatgccacctgtcttgatatcagatgaactgtttactttggaaataacagtaaagtaggttaatttttctttcaaggaaattttccaaagcatcatggaagtgtggatataaagtatttccctctgcatttataacaggtactcatggtccaagaaattcttgtcattgacaattgacagacttctctaagtaaagtttatctctttatttttggatggacaggatttggattctagttttttaactcaccaaaaagcacccctttctagtgtgctgagttaatacaaggacaacagaactaataaatccaagatatctctgtggagatagagagagcagctgcccagcacctagtacagggactggagttaacagacactctttatcttcaacaaagagttgaacaaggactacaaaatccctatgtctcttttataattaaaaattgagtactcagaatcatatcatttagctaaactattgtctgatggagtgcacgtgttttaagaaacagccttgcattccagaaaaatgaagttgatgatatttcttgaaattagaaacacattttctgcatcatggttgtaccaggaggatcttagtttcttaaaagtggcaaaggatagtcaaagaaacatgcagctccaaatatatatatatgatattgcatataatatagattacatatattatatatctatatgataaattatatatgaatatatgatatattatgtattgtatatttatatgataaattatatataatatataatatattatatgatatataagtatatttgatttaatttaattatttaatttaatttatttataattaaatatatttatttataattaaatatatttatttacaaataaatatattattgtatgcattatatctattatatattaattatgatatattatttatatgtacatttccaaatgtgctcttagctcttgttagtataggttttaaagattttttggactgattccttgaaagaaacctccttgaatttttattttaatggtagaaatatcttgatgacttcatggtaaattaagatgtagaaagagagccgtattaaggcaggacccctcaacactggcgaaacataagactctcctggagaggtttttaaatcctgatgcccagcccacaacctgacccaggtgcacctgaatgtctatgggtgggtctcgggcgtgagctttttttcacattccaacagtcaagttagagtaccctggacagaagtaaatcacagccatcaaaattaaaggccatgaatagaatatatagtaagggacagattcattacaaaggacctcagcaaatgagcatcagtcatttagtaacaatgccttgttataaatacagcttcaaaaccatttgtttgaaatccacatcttcaccttcactccatggccaagacttctaagtacctagcaacatgccaaagtcagtcatttgtcagctttctgccaaatttgagaactgcaatatggtagtgtggaaagagggcttgccttttgggaaacagaccctggaattttataggaacagcttctgaaaagccaaaaagatggggtaagaagctaagctcagagacagggcagacagtctcgcccaaaccacaggaacgaagttagggattgacacccatctatagtcagtcctctggaaaacatacctgtggccacattaacctgaaatgtgctctttttgagagcgagaacaatgattccaaaatattaataattgttacttgactaaagtttgaacatcaagaccgtgtattaaaattcattgctagaggccgccctaagaataattcctggaagttgccacgctgctaatatgtgtgattagcagcgtggaatgctgtgtgacaacagctgactgcctcccttcagtttcgtggggaaagaacacagcattaaatctcatttaagtggccccagaaaaggtaattgatcacatgtacgtgaacatttttttatcaagaggaaatttgggccaggtgcagtagctcacacctgtaatcccagcactctggaaggccaaggtgggtggatcacctgaggtcaggagttcaagaccagcctggccaacatggtgaaatcccatctctactaaaaaaaaaaatacaaaaaaattagccaggcatggtggtgcacgcctgtagtcccagctactcaggaggctgaggcaggaaaatcacttgaacccggaaggtggaggttgcagtgagccgagatttcaccactgcactccagcccgggcaacagagtgagactccatctcaaaacaaaaacaaaaacaaaaacaaaaaaaggaggaaatttgtttcacaggcatagaatccacgagaagaggtatcatggttgacagtgtctggcatcctcattaatgactccagagagacgccagtgactgaacatggcagaggacagaaacctcatgttgtggctatgcataaagcagaaaggtccttccagaaacagtgcttccaaattccattttaagaatgccccatcatttcccggccagatcgcccctgacgagatattgcactaccaacaggaagacaccgttgaatgcattctggacaaaagacaggtctgagagttcacatggattctggcaagggaaacgtatgatttggccactggctcagaaaacagagttttggaaatataagaagaaattaaacatgacgtactgagctaattacccaggacacacactgtgaatcattacacaagatgcattctccgtacaaggcagtgctggatgtagacgtgactctaactcattatattactgtcttcagaggcaaacatactacttgctgggtttttttcctctctgcatgaatgtgacagggaatataagtgtgcccttagttcttgcatatttgtgatgttttctgattctccctctctccctccacgttgattgacattttcctttatcttgctttttattttatttttattttttgtacagatgagttctcgccatgttgtccaggctggtcttgaactcctgggctcaagccatcctcccacctcagcctcccaaagcgctgagattacagtcatgagccactgagcccagcagacattttcctttatctttctattgaatttgataggattgatcattatgcctttgaaattctcttctggcttgtcatgcgacattttggtttcatagactctaactcagtaccttgcatactccataaatagttgttggattgatgaatgaataaagtaattcattaattatccctttttttccatattcttctccttcctttctgtcttctttgttttacctgtattggcttaattaccacttcctttacataatctctggatgatccttaagactcatcactcggctgttttcccatctttggatgcctcatccattctcatttcatgacattatgatcagcagaatgggtgggtgcaaagatctactacaggcaacagagaataagggcaggagtcatcctcacgggctgtgaggaaacaggtagaactggggagtgtgggcagacaggatttgagacatgatttgctgagctgggaggtcacttctaagcagtacaggaggtagctagatactacaggtgagcacagttatgaaaggtaagacaagcactaactagggtagcaagctaagatgggagtttggttaatcagtgctggaaaccaggaagacaagagaaaatatggcatgcatgtcagaggtatggtttccacatgccagattccacagggcatattctgccgggcattgaccaaggaccccactgtggcagaccaagtatgcatcgcctttgaaggaatacacaaggtaaagattccattataattttcagcctttaactattcactggtggaactattgctcttcaaataccctggacatttagaatttagccttctcccatcaccttaagtaacctataactaaactcacacactactgattctgattgagtctttgcaaacttatttagtaaaacttatttggaaccccaaatcaatatctacagcagttttgaggtcatttgctggcaaacgcagagcagtaaaaaattctagtcacctgatgcataggttcccagctgaggttgaataaggagacactttgccttcttgtttcaaccctcagacctaaaacaagtatccttttttatatcaatatagtggcacattttccacatttttgtgctctttgttggtgactttccttgtttgaaacagctcccaagagtagactgctgcagtgctgtctagagttcccatgttcaagaaggctgggatgtgctgtatagcgaaaatacatgttagagacgctttgttcaggatgagtcatagtgctgttggctgtggagtccacgtgaataaatcaacaatatacatgccacaaggtgtctttaaatggaaatacagtccaggcatggtggctaatgcctgtaatgctagtgctttgacaggctgaggtgggaggatcacttgaagccagcagatcaagaccatcctggggcacatgatgaggcctcatctctccaaaaaaaaaaaaaaaaaaaaaaaaaaaaaaatagcagggcatggtggcacacacctgtagtatcctagctactcaggaggtcaaggtgggaggatcacttgagctcaggagttggaagctgcagtgagctgattgcaccactacactccagcctggggacacagagagaacctgtgtcaataaataagtaaataaataaatcaacagaaatacacataaaacaatgttatgtattgatcagttgatgaaaatgtaaccagaagttcccaggaacctaactctgtatcttcccctaggagcaatattcaatatttgctaattcaatgtttaggatgacatatagagtatcacttccatgaataacaagaatcaactgtgctctattttcccagcatttgtttcccaacctcctgcactaaggtgcagcctgtctttcattgctatgccttctttcacctgcaagctaacatgtggtttctacaattctcgattcacaggctctctgccttcccctttctttccattctcaaagcaatcctcccttcctggaacctatttgatagctgaatcattgccatctgataggagctgttctccccagctcccaactcctttctcctctctgtcagcctggacaaggcattgccctctgttcttgcacaagccattgccctctgccttggacaagtcattgctctctgtccttgcacaagccattgccctctgcctttccacaagccactgccttctgccttggacaagtcattgacttctgctcttagtgtcctccaccttcccttccacccagtgagatgtatcaccatctgcagagtccagtggaaggggcacctcttccatgaagacctctatggttcctaccttccgctttcccttatccccatactctcagaggtcctatggtccaaggcactaatgtaataaactaaccgagtcaactttctcaaccaagtcaacttcctcatcagtttggacagatcccatggccaagcactttttatgggaagaaccggtaacctctttgtgcttcttgggattgtccacagcactcagcacagttgctgattgaactttgctcctgtttccatcaaattgagacttcctgcaattagggttgcaggacaaaatataggatactcatttacatttcattttcagataaacaacaaatgcattttttagaattagtctaactcaaatattgcttgagatatacttgtacttaaaaatgatttgttgttcatataaaaactcaaattaaatgtggtgttccatattatcatttgccaagtctgataaccctactgctatggactgagttgtgctctccacaaaattcttaagttggaacctgtattagtctgttctcatgctgctgataaaatcatacccgagacttggtaatttataaagaaaaaagaggtttaatggactcacagttccacgtggctggggaggcctcacaatcatggtggaaggcaaaaggcacaccttacatggcagcagacaggagaggacttgtgcagggaaactcccctttataaaaccaacagctctcatgatacttattcactatcatgagaacaacacaggaaagacccgtccccatgattcagttacctcccaccaggtccctcccacaacacatgcgaattgtgggagttacaactcaaaataagatttgaatggggacacaggcaaaccatatcagagccctaaccttcagtgtggctgtatttggagatagggcctatgagaaagtgataaaggttcaatgaagtcataaggatgggactctaattctataggactagtgcacttacaaaaagaggaagagacagcagaactctctctttccaccatgtgagagggcacagcaagaatgtagcccatctgcaagtcagcaagggagccctcaccagaaaccaactctactgatccttggtcttggacttccagcttccagaactgtgacaaaacaagtatctgttatttaagccactcagtctgtggtatttttttatggcaggctgtgctgatttatatacctactgacaagtttttaatttttgctatgtcattggggaaaaaaaactactttataaggaatacaaaagtagcagatttctagcttcttaactgtgaagtggaaacatacacaattaaaagatttaaaccttagtgaggaaattattatcaaaggtaaatgtatagaaagcaatctgtaaatatcatggctgaggagacacaaaatgtgatccaagtcaggttagatgaattgatgctgatgccaaggacgtgaccttgaacccgattttggaggaagagagaaccagatttttagagaagtcaaggaaaggtaaacaaatgccctggagaagctaatgtagaaatgatcacatgaattcattcatgtcttgctcttccacgtcactgtcactgatgtgttattgtttgtttttaccattttccccctaaaatatcaagaaaagtgttcatggattgtgaattacaaagcctgatacaattagtcacaagggaccattatgagtccttctgcaaatgtctgcaagggccagggaaataaaaagtacttacttgtctgaaaaaagcagggaagtaattaatcactatatggtagtatttatgcatgctatgaagatgattccctaggatgaaaattcctattggtaacattattctatgcaaccattattaacttagttagaaaggcaaatttaaaaaatttagagccctacagaaataccatttgacccagcaatcccattactgagtatatactcaaaagaatctaaatcattctattacaaagatacatgcacatgtatgttcattgcaacactattcacaatagcaaaggcatggaatcaacccaaatgcctgtcagtgatagactggataaagaaaatgtggtacatatacaccatggaatactattcagccagaaaaaggaacgagatcatgtcctttgcagcgacatgaatgaagttgggagccattatctttggcaaactaacacagaaacagtaaaccaaagactgcttgttctcacttacaagtgggagctgatggatgagaacacatggacacgtggaggggaacaacacaccctggggcctgttggagtgggggatgggagagggagagcatcaggaaaaatagctaagggatgctgggcttaatacctgggtgatgggatgatctgtgcagtacaccaccatggcacatgcttacctatgtaacaaacctgcacatcctgcacatgtaccacggagcgtaaaataaaagttgaaggaaaaaaaaatttagagccttaggaccaattaactctcaaaatccccagtaaagggatgcaggtattgtcatacatttggaatggttgttctctgctggctttactcctaaccacaaccacctccacaaatacagcaaagaaactcatctaatacaatctttcataacaagagcttccaaagatttcagctctcaattccttcagtgatgtttctgtagcggagacgtgcaaagtttatctgcctcagctcttggagtgagatttgtgagacaatgcaaagtcctatttttgtatcacaagtctgacatcagctccattttctgagaacaaacagccaaaaaagactcactggagcagtttgcaatcatttgtgtgaagtggatctccaggctagtcctcaggttgataaaggtataggaacaggacagcagagccaaggatggtgtgggggggttggttttgatctctcaaaaggttccatctgttacagaggctacttggaggaactcacatgtaccccaaaccagggaatcagtcgttcgaccctgaaaaggatgcatgggtttctttctttgtttctaaatctatttatgtgggaagtcttgagatagcatacaaaattaaatgatgctttccaaagtgcacgtttcaacaattacttcaaaaaagagggtgtgtttggtctccagtaggttgctgttactactcaacaggccagatacagtttcttgtctaaatgctgaccaccagaaaagccgactgctatttctgatcatgggtgcaaagagagaaagtgcaggaatctcagaataggctgactgtcggtcctgaggaggtgggctgttagttgggaaagtgattaaaaatattttatatttgcaagagagaagataaaacaagagtgtagaatatttaatttcccacaactaccaccaaatattgtgtaggctgtatataatatatatatatactatatattcttcatatttattgtatgtaattactatatattatataattaacaaatgtaatacatttattggacataattattatatatactattatatattactataatatctaatatttttagtactatttatttattatactattactatttgttatttactattattagcaaataatagtaatttactcattactattagtaaaatattagtaatatagtaattatacataatactaatatgttattatattttttctctagagaagcctgacaatttaaaattcatttttaaatttcaaaatcacctaccaccttgatatataagctaaaataaaactgcctgctattggtccccaaggaatgagtcaaattgccaaactctaaactcatataaacactgtgaagggataaatctaagcagataataagcagatcaaaataaaaagtagatcaaatagttttccttaataagactgccttagtccatttgggctgctataataaaataccatagactaggtaacttaaagaaaacggacgtttattgctcacagctctggaggctgggagtccgagatctagccatggcagattcagtgtctggtggggactcgcttcctagttcatagacggcgccttctcactatgtcctcacgtgggggaaggggcgagggagctctgtggggtctcttttataagggcactcataccgtccatgaggctccactttcatgatagcatcacctccccaaagccctaccctctaataccaaaacattgtgggtgaggatttcaatataggaacttgggggaacacagatgttcagattatagcaaggaccttttcattagtggatttgtgaaatcgctacaatctacctcaacaggcaggagtttagaatcctactccagtttatattataggctgaaacttgattttttttctttagcagcagattattgaatgggttgttatgcattgagttgttgtcgttgatctgcactttcatttcttgctctttaatgggcagtaatcacgtggagaagacccttgagcgcatcttcagtctcagatgagtccctcttgaggccgagtgaatttgaacatctaatgtagtaacaaagtgctaaggtccttaacattgtttaaatggaaaagtaaatgttttcctttgcctgaacattagattgttttacctgtgcatcttagcactcacagaagggcaggtaatgcaatatggaagtgcctatacattgcacttgaatgctggtggatgtcctagctctatttcaaggaccaagggatgctggccactgtctaaggcggatgtgcaatttcacccttcaatgtggttaattggtttgtccccatatgtgatgtagccaggagctcccttcaccttcctcctgcagtataacacaggtgagtttttttttattttttattttctgcttcacagaagatgtcttgagagtcctggacttggagttaaattttaatgtgaccctggtacatggagatgtagacttttctgtctccgggctgttccggcctttgcttctacagagttgttagggatgatagatgtggcgggacagaagactgctaacacattctggggtttgtttgtttgtttttttaaattctgagtagtataattattgcaattccattgtttgggagtttctgctaagtattttataagcctgtttttaaagccaggcttaaataacatatatcaccaggtctatgtagttggtgaatataagagtttgtggtttagatgtgttggggttgttggccatgttcataaggtagtaaaaaccccgggacagacccattgcttgccctaatcctcagatggctatggtctcctttcttaggatgtcaggagtagaagtcagcaagtcaggaagagggcagacagcacatcatagggagagaaagctactccactgctaggtaatttaaacatcatttgtagaaaaccaatatttctacatgacataactcaatagtgtttgatttctttagtgtatatatgattcttaaaattataatatacttgtgtgtgtgtgtgcactgccagatagatattggagtagactccaaaatctctatatattattcagcatttaacagaagaaatcaaaatactccttgcagtagccccttgcagccatggtcacaggattcacgattcaacattcatttttctcttgtaggatgcagtttgtcttggttcaacacagagtgtctcaagtcagactgttgaatttcagtccatcatgaactagtgtctgtgaccttgggcaggtcgtttaactgccccctgcctcagtttccccatcttagtctattcaggctgctataatgaaataccatacactaggcagtttctaaacagcagacatcatttctcatggttctggaggctggaagtccaagatcaaagtgcccgcagattcaatgtctggtgagtccccactttctgattcataggcggcaacttctcaccgtgtcttcgcatggtgggaggtgtaagggagtcctcatgactttatcacctcccaacggctccacttcctgatactatcaccttaggggtgaggatttcaacatcaaaaacttgcaggggacaccgacgctcagagcacagcatctcctctgcaaaaagggattatatttgcacctggggcattgtaggtttcacatagaagatgagatatgtaaaccctgcatggagagaagtacttcacgcatagtaggtgctcactcactctctggtagccaatattattattcagggtatcatgcagtggcactttgagaagaccctgtgtcttccttctgctgtcacagccacctgcagtgagatgtgaaggtgaaagggctgaggaagggaggctaagcccatggagcccagggagcacatgagtccacaggtcttcctggttgctccatgttctgagcatcctcagctccccatcatggaagtagacacctcttgaaggcagctgcataaatgcagaaataacacctggccatctttcaactcaactctgtttttctttcggcaaaagacatgtcaagattcatcgagttcatgcatttttattttttcaacatcagaaggtttcaaacacagagaagccaaacacaattgctgattttctggtcttgccttaaacaaccccagttattattggaaggcctagatttgattaatgggtatgatcatgggttcatccttctgcttatccaacgaggtgactctggttactttttaaacaactaaagcaggggtcagcaaatgttttctgtcaagggccagattgcaaaattatttttggctctgtcggccacagggtctgtgtcaaagtattccactctgccagcttagcagcaaaacagccacaggcgacacagaaagggatggggcagctgaggaccaataaagctttttttctggacactgaaattttaatttcacagaatttttgtgtgtcaagaaatattcttcttttgattcttttttgccaatcatttaaaaatctaacaaccattcttagcttgtaggcaagaacactgaaaggaggtggtgggctggatttagcttttgggccataactgtccaagtgatggaatccacgcttctcttcagtataagagtccagggtctctaagatttctgtcttactatcctacccaagagaaggtctttcttaccccttcatttgcacctacttaaatccagtcctaagagggctggttgaagatccacttgttctgtgtagcctgtctaactccctccagtctctttaaccacatttataaacatctgtcaatcgctcagtgtgacacaggctactgtcatatttataaatttctgtcaatcacagggtgtgacacactcatcataaagacaactgcaatggctttgaagatgggccaaacagggtttgatctccagctcttactggccacttcaagtctttgttttcctgtctatacaatcatcatcataatacatacttggtaagattgttattgtgggccgggtgcactggcttacgcctgtcatcccagcactttgggaggccgagggagaattgcttgagctcagaagttagagaccagcctgggcaacatggcaaaaccctgtgtctacaaaatatacaaaaattagcatgacccatgcctgtaatcccagctactcgggaggctgaggcacaagaactgcttgaacccaggaggcagaggttgcagtgagccgagatcacaccactgcactcgagtctgggtgacagaacaagactttgtcccaaaaaaatttttttaagattgttattgtaaggatttaaacaaagacagtacatttaaaacaccctaaatgattttagctcgtaaaacaaatctgtgatagagatgatgatgatgatgatgatgatgatgatgatgatgaagatgaactgtaaccatgtacgataattttggttaattgatgaactttgtaaatttgaaatctctatccctccatactaacgctgactgtggctatatcagatggaaatgccccttctggatgaaaaatgtttaaagtccccaaatatgaatccctctcaaactgctacttcaggcctaactggaaaaattaagatattaaaatcttaatatcttaagatattaggtgcagtggctcacacctgtaatcccagcactttgggaggccagtatagggggatcacttgaggccaggagttcaagaccagcctgggcaacatagtgagaccgtgtctttacaacaaataaaacaatatagcctagcatggtggtgcatgcctgaagtcccagctactgaggaggctgaggtgggaggatcacttgaccccaggagtttgaggctgtagtgagctatgattatgccactgcactccagcctgggcaagagagcaagattctctctctaaaaaaataataataatctgtttccttacagtagtcatttataaatagagctatttttttcccctaaaaaactggaggaaatgactgatgacatttttggttgtcaccacttgggggggggggcgctgctactggcatctggtgggtggaggccacagatgctgttgaacatcctacaatgcacaggatgctccccgcctccaactaaaacatgatgtgtctccaaatggcaatgtagtaccaaggttgagaaatctgttttacaaaagagcaagaaagtgaggtagtaaaagagagagggaaggagagagaaagagagagggagacggagagggagagagggagagaaggagagagggagacggagagggagagaaagagagagagagagagagaatgctaacaggcatttccttccctttaagtaactttttcaggaaattaaatcactgcttttaaatcgctatggcgtaaaaggactctgtactttcttttttagagagggagtcaaccactgaggacacgagggcataccagatgaccaattttttttgtttttttgttttgttttgttttgtttttgagacggtgtctagctctgttcccaggctggagtgcagtggtgcgatctcagctcactgcaacttctgtcttccaggttcaaacaattctcctgcctcagcctcctgagtagctgggactacaggcatgtgccaccacacccagctaatttttgtatttttagtagagacaaggtttcaccatgttggccaggatggtctccatctcttgacctcgtgatccgcccgcctcggcctccaaaagtgctgagactacaggcatgagccactgcgcccggccgaccaattatttttaaattgctccatggggactaatacaggacttgacccaaaatgaaaagataagctttctcatcagctggacaactttttgctggagttggaacagtctgtctgtgtctcatagacactgaacaaatggctgcagagatgatgtaagatcagatcaaatataaatctgatcctagatatcattgggcctagggaactctaacaagatttctcttaacataattgtaaaaacactcaaggagatgcctcctatattggaaagcctaacaaaagagcaacgaaacatctacagccaacgatcaaagataggtttcttacaggtaggacgtctacagctgagtcaacaaacactgatgccaggacactccttaccttgctatcttgtttgtgtggttatttaaaaccgtgtctctacctgaaggacaaacccagcctttccacttatttacatgcttgctccacggggcgcagcctgacctgtctcctggctgaatctgttgaataatgcagtcgataataagaattctccactcatctgaaaaatagcgataacaattttccagatagtcacactataattaaaagccactgggtgcgatgcatcactctatctaaataactatatctaaatataagaggaaacggtattgccacaaagaccctgcattgggcagggagacatgtgcaatatacaaatacttgattttataattttttaaattccaggaaaatgtaactggtttcttgcaaagctagagctgggcagatcatgagaaatactctttttttgtttgcttgtttttttcagagagtgtcttgctctgtcacccaggctggagtgcagtggtgcgatcatagctcaccgcagccaaaaactcccaggcacaagcgattcttccccctcagcctcctgagtagctgggacgataggcacacaccatcattcctagctcattttaaaatttttttgtaaagatggcggggggcgggggtctcactgtattgcccaggctggtctcaaactcctggcctcaagcagtcctcctgcttcagcctcccaaagttctgggattataggcaggagccagaaatactcttttccaacacttgggtttcataactggtaaacagaaatctcaaatggtaaattacatgctaaaatcacataggtcttgtgaccagacagtactagaagccagtctgtgttcccaattcaattctgtttccctcaaccaggcttgaccttggcactattaacactttgggctgggcaattcctggtggaagtggctgtcctgtgttatgtgggatggttagtggcatcctggcttccacctgttagacactgtaaccaaatgcgtgtccaattgctcaccaattgcagagaccagttagaaagagcatgttcggtataaagaaagtgactttattccagaacttagctgaggggaagaggtagaggctcctgccttaagggtattgctttgtatttgggggcagagggcaggggcttttaaagaggcactgggcgtaaatggcatgcaagggagaaggcaaggagatgtggggtctatgtgacttgcttgggatgtcttatctatttggtggtctggctggtgccatcactggcagagctagcctgtaaactgacacaatctcctggtgagagagagttccaggggggcctggtttgcttcagtgttcgctctctggaacttctaagttaacacatagttacaaaagcttgccatgtagggagtgtctgctggagagaaggtaaaggctacaattgcattcctaaagagctaagtaggaggagggggaaaaaggaaaagaggaaattcatttttttctttaaaaacaaggtattcggttacaatgtcagtaatagctgtccccctccccaccaaaatacatttaaacattaataaatgtcccccaagaagaaaatctccccacttgagaatcactgctctaaatctatcttaacttgactataatattgaaagtatgcttctaaacccaatgatgccacatgcagcaatgtcacatttctgaaaacaaaggttctattggcaaatgagcatgaacttcttacagctaaataatcccatttcagcttttattacaacccattccttaggtatcctcttcaggaatcctatataagaaactttcaaatcacctttcaccttccaaagaattaatgatctcctttgctttactcttttttcactgaatcagtcagtgtctcagtggcccacagacagggtaatgagagacagatgtagtcacaaaaggtctatttataaaaatgtgggtgtacctttgacccagcaatcccactactggttatctacccaaaggaaaagaaatcactatataaaaaagacacctgcacttgtatgttcattgcagcactagtcataatagcaaagtcacagaaccaacatagtgtccatcaatggctgactagataaagaaaatgtggcatatatacaccatggaatactacgcagccagaaaaaggaatgaattcacgtcctttacggcaacatggatgcagcagaaggccatctatcttaagggaattaactctaaaatggaaaatcaaatattgcagttctcacttatacgtagaagctaaacagtgggtccacatggatataaaaatggaaataatagacactggggactcaaaaagagggaagggtaggagggaggtaagagctgaaaaattacctattgtgtactatgctcactacctgagtaacaaggtcatttgtaccccaaacctcagcactatggaatatactcatgtaacaaacatgcacatgtacccccaagtttaaaaaatatatatatatttatttttttttttttgagatggagtctcactccatcgcccaggctggagtgcagtggctcaatcttggctcactgcaacctctgcctcctgggttcaaatgattctcctgcctcagcctcccgagtagctggaattacaggcacccgccaccgtgcccagctaattgctgtatttttagtagacacggggttttgccatgttgaccaggctagtctcaaactcctggcctcaggtgatccatccgcctcagcctcccaaagtgctgggattacaagcatgagccaccacggctggccctaaaataatttttttaatgtgggtgtagaacagctgttctcaacaggaagcgagttgtcagtgtcaggagacatttgggtttgtcactgctgtggagggaggtgatagcagcatctggtgagtagagaccagggatgctccgaaacagcctacaatgcacacagcacagccctccacacacaaacaagagttatccatccctaaacgtcaacaggtgccaaggttgagcaactgtggtttataggaacaagggggagctggcaataacccaaggccagtagctaccaaactgtctccaccaccaggctcagaaggatgagggaaggaagtccaactggtactggaaatggggagaggtttgtactctcagccattctgagaggagctgcggcatttggttgagaggctcagccaagctcaacgtgccctggaagggagcagccaagggaagagatatataattcaattctttcttctcccctgctcactgtccaactggggctccccattggccaaactctccaggacaccagcagtacagaagccctgtggatggtgtccatgcgaggcagcccaggagggagagaaagcagggcaagaatgacagacacacacacaagccctctaagcacactgaattttctagcattgcactgacttatctgatgcctgaggctatttcacttcggattcctggatgccaacactcactgtccactgctctgagatcctcatggtcaatgcctgtccatccctgactgcttgaataaatccaaccacggctctcttctttacttcatctccttggtagtgcactttctcacagctgcttacattcttctgaaggttgtattgacatagaagaaaaaagtctaatcatcttaacagtgataacttggatattgaatcctacaactctgtttcttagaaaaatgttggatctgaagtcagaggttttggatatgaggcagtgctctgacattcactggactctgaggctcatatgtgtcccagttgagtaatcacaggttccttaaccctgaggtgcactcaatggcaacatcaggatcatagtagcaagtacaaaggaagatgacgaagattatacaaaggtgtattaatccatcttcacagcaccataaagacatacctgagactggataatctataaagggaagaaggttaattaacttacaatcatggcgcaaggcaaagagaaagcaaggcaagtcttcacaaggtggcaggagagagagagagaagagggaagtgccagatacttatgaaacaaccagatcttgtgagagctcactcactgtcccaagaacagcataggggaaatcctcccccatgatccagtcaccttccactaggtccctccctcaacacatgaggattacaattggattacaattcaggatgagatttgggtggggacacagccaaatcatatcaaatggcacacatatagcgatcagcccagagacttcggtgtacaaaatagcaaagagtaagtattattttcatgaagaaaacctcatgatttccatgagggaatcacatataagaggtatcttaaatgcaaaataaaaacattgcaatgatatttattatttttaatgcacttacgccctaagccaaaggtaagatagaataatttgaaacaattttcaccaataacattggaaattttccctctggctatgttgaattgttttctcctctccattcctcaggaagtaatcttcatgttctcaaacttgacgcattctatgcctaaaaccttttcatcaaaaccttttcattatcttccatgcggccctatgcccaaggacattattcaaagagctcaatgtgagatgttcccatgccatggctctggggggcaaggtgttgcatctggagataagccagtttggaaacatctgttgtttactgctgctattggatatccaaaaagcacctgcatgttgactctcctcctggtggccctctcagcttcataccataagacacgaaataattgacgacaacaggcacaagtttccaataacttagggaaaaatttaaaacacgactctagggacagtgagttgcaaaagacagaaactatatgaagccaagaagaggagataaagaaatgattatgtattctctctgacctcgccccccaaccgtgtttgcactgaaaattgcattgagtgtagagaaatggtgagattttaattatgtgctctgtgcagaggcctcgaacgcaggcgcttcttgtcgagaatcatctactggcagagcgaagatgctattggacactcctggaaacagacatgctgggcatgaagaagctaaactgaggcaggaatgagagctgtaaattatctgaaattgctggggaagaggccccaaagcacagagaggcatcagcaacatcaaagagggtatgacaaccccagtccaatttcagctggggggaaaagtaaaacaaaacaaaacagacagcctgtttccagactgagagaaccacatgcctagcacatgtgggaacatcagactgtagctgagacacctgtggcagcttccagcacactgaaaatgcaaaccctattgtggaagacatggctggaaatggtccagctccttcctgcttcttggcttcccctgaggcactaggattttctttgcactttcttgaatgtgctaagcagtcggttttgttgctgctaaaactttctcctttgagtcttaggcacactccctcagtttactggtctctacttgatatggtttggctgtgtcctcacccaaatctcatcttgaaccataattcccataatcccacatgtaatgggagggagacggtgggaggtaattgaatcatgggggcggttacccccatgctgctattctcataacagtgagtgagttctcacaagatctgatggttttataaggcgctttccctgtgttcactctgcacttctccttgctgccaccatgtgaagaaggatgtgtttgcttccccttccaacatgattgtaagtttcctaaggactccacagccctgtggaaatgtgagtcaattaaacctctttcctttacaaattaccgaatctcaggtgtgtccttatagcaccgtaagaacggactaatacactactcaaacattgtttccttcatgagccgctctccatgtctgtccccacatgtgtccatcattctctatcccttaccctgttttatcttctccacagcacttagtatgtccaggcatgctacatacacatttaatgtcagtttccatggaagctccagaggagaaagccctgttttgtcttcagctacaacccagtagggaggagcacctcccacaaagtaagagctcaataaagtcactgtaggaatgaattagacctaaagcaaggtctactctggggtttttcattaaagaaagcagataactcaatggaaatacaagtctagacctggcacattgagctggctgatgtcaggcaggaaaacctctctccagcttcactggagagaccaggatgggcaagagggtgaagggtacccgcttcctaagagaaaaaggcaaagggggcaacataaacagaaaagtaagaaaaggatggaatgtttcatgagctgccaatatctcacttccaaactccatgggagcaggaaccctgactaatttgttcattgttatctccccagagactgcttggtcttcaccttcatcagatgctggacaacatactggatgaatgaatggatgtcattgcagactctagcgacctgcgaggtccagctttggggcaaacagccactaaatcagggccacccagtacaatacaaccatagcatgcccgcatgggcttctttggggattccagagaaggtgaaattctgaaagtgagagagagctgacacactgcaaatagctagactagcctttccaggagacagggattgataaaacccgagcactcctacatatcacgtactattctgttttagtctttacagtcctgaatttgttttttaaatgaagcactggaggaaacagtcgacaaggctgcccctcttttctgatgccaattgcaagctcaaaggtccctaagagcacccttaagtttgatgatttgctagaaagatgcacaaagctcactgaaagttgtaatactcatgcttatggtttattacagggaaggggtgagaattaaaaagcagtcaatggacaaacagcatagggcagaattcaggagagttccaaatgtggaacttccagtggtcctgaacttgtggagtcttgaacagtgttactttttggacatagatgtgtgaaaatagtcatggaatatgacaataagggaagctcgcctgaaccttggtgtcgagtcttcctcagagctctatcatataaaattggttggacacctgtaacagtaaagagaggcttagcatgactaagccttagcagaactgtaatatatttgttgtttataagccacttagttgatagtattttgttatagcagcctaaaagaactaatacagacctgtggttttccaaatccatcatctcatcagattatctagggagattccttgttcccactcatgacctacaaaatcaagcctccatggctagacaccagaagccgatagctgtaagaacacctccaagagattcttgtgcctggaccaggccctaatccatagatgagagcttgggagtctctactaagtagctagatatgagatcaacttgtatcagtatctctgatccaaagatacctggatctatgcttttcactgaaagagacccacatgctttagactgaaggcatacagatatctaaatatcttcttataaaaatcagtatttaatgaaagcaatgtcttagtaagttcaaatatatatattttatctgccttttttcttttttggaactttaaaaatcatataattaaaagaatagtttgaagcttgtaatatggtattaaaaaaaagaacaaagctgaaacataatttgaaattcaaagatttcttcctgtctgctttgactatggtagtatggtagtactttgagtatggtagcattcatatggcatcttcagttcttcaaacagccatcgcccaagatcactagggtccttgggagtttaagcaaggttgtccaaatccatttcaccttcttttttcttcattagtctaaagcaggggttggcaaactttggcttgcaggttgaagctgtctgcctgtctttgtaaatacagcttttttggcacatagccatgcccattccttcacatctgatctgtggctgctttcaggctacagatgcaaggttgagtcattgaaacaaagaccacccagaccacagagcccgaagtatgtctctctacaggaaaagttagctacaccttggtctaaaggcttggttatcctctgcctttgcataggagtcagcgtggattttgagaagtggaaaactgtcttccagaaatcctgcactcaagggcatgtccccctccccgtaagagtattcaagctgattgatggattttagttataggaaaatgtgtcaagtcctattcagtattatttgattctgatttaagactctgtgggggagatttccagttgcccactaaagccttttctcactcctcttctgtggaaacagagtaggtgttgtcttcaaggagagacttagccaaaggctacatttccaagctgtctttgcagctgaatttggccatgtggactcagtcatcactatggggaagagagtggagatgatggaaacagcttctgctatgctaggccatgcacatgctatggttgtactcaccttcccttcctgcagcacggaagatggaagtgccctgagcttatcagacagaagatgaacagcctagtggatgaagtttccccgtagccccagggagcagaaccttaactgtgataagaatgctcagcctgggattaatgcactgcagagagaaaacatgtgttttaacccatgtatgatagcatctttttcattcagcagattaaacttggccctgttcatcagacactattccaacctccttcatgcagtagtgagtcatgaacagcagcttttgaaaaagttgagtacaaccaacctgaaagcagacctagatagtgtgtgggagtgagatgtaccagacaaagggcacatattcaggttttacaagtccaggctctctcagaataggatacagaacacagacccatcctgcaaggagctaggacttgatgtcagagaaagaaagtgtctccaagtttgaggagtcctggaatagagatgaacagtattgtactgttggtcatgcagctgaaggctccctggaggaggaaggagacaggactaaaaaaaggaagtgtttctggaggataaaactgtgtgagcaaagaaaaggcacagtggtttaaccaggcgttgcttggggtgcacacctgcaaaaatcacagagcacagggttcaaggacccaccattcctatgcataaatttattgctcacaattctggagactggaaagttcaagatcaagatgtggcaaatacaatgactggtgaggccctgctccctggttcatagatggtgacttcttggtgtatcctcacatggtggaaggggcaagggagctctctggagcctcttttataatctcattcataagagctggctgcaaagcaaggaaatatccattcagttcgcttaacagagtaaggatggataaatgtatgcatgtggaacattccacctcacacacctgcccagtgcatagatacttctgccctttgctttgggtagagttttctctccctaaattttgttagaataaaagataataaactttcatttttttaatatatatttactttctgattttttctttgattttctttttctttttttttttttgagacagagcctcactctattgcctaggctggagtgcaatggtatgatctcagctcactgcaaactctgcctcagggttcaagggattctcctacctcagcctcccagtagctgggattacaggcacataccaccacacctggctaatttttgtatttttaggagagacagggtttcaccatgttgtccagtctggtctcgaactcttgacctcaaatgatccgcccacgtcagccttccaaagtgctgggattacaggcgtgagccaccgtgcctggcctctttggttttattctactaagcttttctttgcatctttaattgtattactttactggcctttctttttttaaataaatgtgtttcaggccatgttttaaaattctacattacttaccatgcctcatgttgaatgtatactacataatttgtcattaaggttttaatgtttgaattgcctttttaatttttttattaactgaaaatttattttagaagtgtgttcttatttgtcaagtatttatttgctttgtctttttatttttagtttctaattcaatttccatgtggtcaaagtggcctaatatgtcaatactttgaaattatttgatattttgtaagccaccaatgtgcaatttttataaatgttttgtgtgtccttgaaaacaacgtgaattctctttgtttgtccggataaaactatcttatcattcacatttcctataaccttagtattttttgttctgcttgatcaatcattttctgagagtattatattaaaagtacaacctacaattttaaaagtttcccttaattctgttactttttcactttttttctttttgaagttatgggtcaaatggacaaagcttcttaattgttttagattttcctagacggttccttttatgttaagtaatggtctgtctttgtttttaaatactgctgtatttgtattgattttctcttatgcctttttctggtttttatttttctgctttcctgatttctgttgggttgattgctttctacagtaggtttaagatttcctttgttgattcagaagctacagatttaatacacctgttctttttttgctattagcatctttcttgcatataagaaaaatgccttggtgtgattttatcataccagtgtgcatgctacccaatctctctcaataatgttaactagaattgaatcacaccttttcattcagtgttttctttcttccttaactgctagttaattaaatttgccaagaggcttatattttccctcttcctggctgtttaaggcatcccacattttctccttgagtctacatttctccttcagaatcaccatctctagcatgttagcaaagccaacttgagttgctcacacttcctggtcagccaggacaatgatcctgtgtgtgaggtagttttgtcctgttcattttctctttctgatttcatgttactattcccatgtgttttgatctaaggaagagcctaaaggaaaagcgaactattttgactggaagcttcttactaaaatatcacacattttcattttagagaaattagaatataaaaataaaccaaaagaaaacaaacctaacatgctcttaataccctcacccagaaataattactgtccacagttttatatacatcattccaaatcattttctctgcctacgtttgcaaatacaccttacaaaatatgtttcaaatactgcttttccctctgaatatcataaacacttttccaagtcaatatatcatttctatatcataatttattacatgaatatagcagaatcaattttgtcaatccactatggttgggcatataaattgtttctcatccttcatttttataagtgatacttatatcgcttacaaatcctagggcctatattttttagacaaaccatgaaaaattccttaaagtggaatttctacaaatggaattactgagtcaaagagatcaatatatttatgtcttacttagattattagtgactctctccttttacccttggaataactatgtgctgctctgtaaatgatttggattgaagaaattagcatctgcattagataacatgcatttaatatatattatattttggatctacaaaacttactaatttgtggaaagactctgtggaaaaccctagaaatattcataaagaaaacattgtttaaaatgttttaaatgttgaagaaccttttttggggagatactccaagtcctaatttcaccataatctaggcatggtaatagtaatctttttgcaagcataacaaaagattagtgagatagttatccttaaaatctcttgtacaaaagatggatttttctttcaaaagagcattgtttttcatcttacccactccagtcttccatcaaaaacttttttggaaatattttgtctaaaaaatacataaaatacctctattcatctactctatcacaaagttatttcaagttttagattcccaatgtgcagcacgtcactctaacttcaaagaaaaaatacttcaaaaagcaatgggcaccccttcttccaaattctctcacttgggagactgaaaacattcctagtgttgttagttttactttgtccccctgtctccaatttgtatagaaatattatacaaatgaagagttttaaaatgtttctcaagatctgtgcccccccaactgccactggcatatagctttaaatataaaatcacagttacggtcaggaggtagagaccatcctggctaacacagtgaaaccccgtctctactaaaaatacaaaaaattagccgggcgtggtggcgggcacctgtagtcccagctactcgggaggctgaggcaggagaatggcgtgaatctgggaggcggagcttgcagtgagccgagattgtgccactgcactccagcctgggtgacagagagagaccccgtctcaaaaaaaaaaaaaaaaaaaaatcacagttacatagacacagttatatagagaagaaaaatcacagttacatagacacagaacatagaaaagaaagggccaacaagctaaagtgagttaaacaggaagatggacacactgttttcttgttttcttgcatctgctttggtgattaatttcccttgtccacatacagaatcatggacctagaccctttgacaaggatgaaatagattcgccctgggaagtgcttcatttccttttcgcgacgcagtctgtgaagaacttggtattttgacaaggactctccatggtgtctctaaagagccttgtagaacatcatgcacatcttatttttagtgtgtttaaaagtcagtcagttcgggtgaatcctcgaatttattcaaattgcatgcaatggccctgcaggaacaatggtggccgtctagaaataggcacgctggacctggagcaccgctcagaaaagcttctaggcaaaattgtctgtttatgtgtctcctacaatatttcccttccacctccttggcagtgactgatttttgtaagactaaacacaagcacatctcatgctcacattattatggtaccgaaagaatcaacagtgataaggtactaaatgaaatagagcccaattctttactttgtgctctcacgtcgatataaagtgaaccaccctctacaatttgttaacaatctagaaggaatctttttttttcttgttctaatctgaaagtaatggtatattcaaaaattgttaacatactactaagcacatggaacatgattccataaagcatgttggtgttcaatttccatgtatagcaacataagctcccagtatcacatttttaaaaaatgtcattcaaacaaacccctttaactatattgagactctgttttcagcgaatgtagagaattagcctttgtatctctgcattgccatttctaaatagttctttttgaagggctgctttgaatagctactcattttcccatagacgtttttctaaaaactgcctttatgtgtttcactcacaaatacatggtttgttttcagtcattatataaacagagtaattatatattttcattgctattttgcctccagttttcccatattttcaaaaaaagtgtatggatttctccttagacacaatatattttgaacgaatttatgaattcacaaatgtccatccccttgtcctcacacatactcctgcttagagggatgcctcagtatctctggtctcacttatacaaccttggagaaaggagagaaggagaaacaaagagaggggagagaaggagaaagactgaaaggaaggcaaaaagaaagtgcctctgtctacttacaagcaaatacagttatgtggaccttgtatatagacctgtgattatatgccatgtcccacccacttctccatgtgtcagtcttgcctactaaatagatttcaaggtcttgaaaacagagtacatttcttatatgttttgtttaccctacctaaaaactaaaaaagatactaaagtgtttgagtatttcaacttatccatttaaatataaagtatctaaaatcttctaatatggataattcaaattctgatactttgtccacaatagcatctgttcaataatgactgccctaggtgttataatatgtgatctcacttaatggtataaactaatattagaatattaatatcagaacagaaggagtctctggggcagcaaatatgattgtcattgtatagagaaggaaaccgtagcacagaaagtttaagtaactcagccaaagtcatccagcaagtggctgttagggtaggattttaatccattttaacttgaaaccaaagcactgttttgctctattcccagtgtctatccttccttcaagtcaccaaactggttattgtttttaacaggcttccccgcacacatacacatgtactgttatctccttcatgtcaatgcatttctacccagtcacccaccaactcatgctttttctacacacacacacacacacacacacacacacacacacacacacacacacacacacacaccctggggaactggtaaatttggggactcaagtcttgcctatcaaacagtccatgtcatgattgtgtaagttgtgctgagcctgattatgctacacactgtgtcgtgcctccccaaaccattcattctacctttttccttcctttcttttcttgcatccccagttttttttttttttgcaattatgagtagtcatcagaaccaatctatccaataagatgtaataaatgagtaaataaaaattaatgggttgattctctagcttattaagtttactaagagaatcagactcagcatgtttccctcgtctttactcctttgcccttttcttcttcctttgaatacggatgtgatgcctggaagtgcagcagctatcatgggaccgtaaggtcaatagccacatggtaaaggtggcagagcaggaagataaggtgaagcttgtgttgttgatgccattctggggtgactaaactaaccctgaaaatccataaaccttttcactaattcagctagtattttgacttgattttgatgtctttccttcctagaagcttgtctacattgaaataactgtaacatgtgggttccatttaatggtcagcattaatgttatctattgttctcttccaatgtgaactgaaaagcatttagtaaaacaaggtttcaattaataaaattatcgtttctatatctatgcagatgttcctgtatttgatgtgtgtatctatgcagggaaaaaaaagaaacaatatccagggtacatcagaaaggaaatgtgacatttcattgtttttatgtttatggaagacctgccttaaaaataccttaaaagttccactaggcacagtggttcatgcttataatcctagcactttgggaggccaaggcaggaggatggcttaaggccaggagtttgagaccagcctgggcaacatagtgaaactccatccctatgaaaattttaaaaaaattagccaggcattgtggtgcgtatctgcagtcccagctacttgggaggctgaggcaggaggattgcttgaacccaggaggtcgaaagtacagtgagccatgatcgcacaactgcactccagcctaggcaatagaggaaaaccctaactcaaaattaaaaaaaaaaaaaacttaaatactttaaaagtttgtttgcaggaggcaaacaaaactaaaatttttcttcttgcattctgactttgattttaaatgtaaaacttcatacatcttgtggttaaacatgctagttgaagacgtcaagtcagaaaacaagagaaattgttgaaaaaattatctaaatataaaatagggccgacacatgatgaaacaagctttgtggatttatgagttataattcttatttattcaaagctaatgcattgttacttcagatgtaatgcataatgcctttgtaattatcatttaaatgagtggctaaatgtgaattattacaaaatagaacttaatgaccttcctcttaaagaactcttgaatagggttactttgcaattataaaaagtcacttgagccacttgctgtttgaccactctaacgcattgctgaaattgcaccaaagaaaggccaaatcacatcaaacaaagaaaggtccgtgagaacataaagagataatgtggcgatgggtaatttggacgtcatggggcaaacaaagaaacgccaaaccagagtccttcctcctttgagccagtacatgcgttcataatgaatgattgctaaaggaaaagtcacagctcttcagcaaagacatgtgccatctcacctctagccaacatcaaatctaaaccttgcctccataacatttcctgctttttaataagcctaaaagggacatattaattatgtatgatgcctgagataccagatcttattaatctgctcttgactcttctttgatttcccacgcttccacacacagctctttggatataggcagtcaacaaatgcatattcagtgggaaatttcaacatctaaaataagagtattagaaatattgtgatcctttattgttcaaaggaagtcattaagcctcgaatgacatcagcatttgtaaaccagtctcagagaaacgaaattcaatgtcccccagttccatgggcattcactgaacccctactatgtgtaagctgatcctcattgcagtatgcaagtgaaaatcatctatcatgagcttttctttgaaatacaaaaaaaaaaacataatttataccatcacggccttcacaaatctcctgcctctacaggcttaacctgctaatgtctgttctggctgctataaaaagaaaccacagacagggtgactgggtacccatcacagaactttattgcttacagttctggaggctaggaagtccaagatcaaagtgctggcagattcagtgtctagtgaggtctgtttcctggttcacagacagccatcttttcactgtaacctcacgtagtggaagtgggatctctttgagatctctttcataaaggtgaaaatgtccattcatgagggctctgccctcatgactcaatcacctgccaaaggccccacctcgtagtatcatcactttggggatcaggatttcaatatgtaaatttggggagcagaaatattcagtcaatcctacaatgtaaatctttacacaaggatacatttatcattcaaattcagaaacaaaatgatacttctacttaattctgttggtttgccacctgtttgatctacgttcatgtctccattaattctgcaacacagaattaggagagaacaactttcgacccctagtgaaaatctacaagaggaggctcataaaaatagaggctcctcttttttgctttagatatgtttaatacaaagagggataaagagagtctgaaaagttttgtggaattcagaccttctcccaaatacagtcttcaaagagtttgaaatatttatcatatacattgtactcttttcttttttcaaatgcaaatatacggccaggcttaaatagggtggactgaccaccaacatccattttttcatcttctcaaaattgaactagaatgacaatgaattaagaaaaacataaataaatttaccaagaaaaacccacagtgaatatttcaacaggtattcaaaagatgaaaagccctggagggctgttatttggcatcatagttccaaactctaagcgcttgccaagtggagcactgaagggaaagaagtcaatttatcctgtcaaccctgaaaagcctctggactttgaggttcaaagctgtaaaaggctgagaatgagacacaggttgaaaacaggagaacgacttgagaatccataaaaaagcacaaagacccgtaggtttctgatccaaccctaacttcagaaagtaggtggccaaaactgtgattgtactgaggggatgctgaatatttgaaagaatgtctggaccagctgggccaacagggtgaaaccccatctctactaaaaatacaaaagttagccgggcgtgggaggctgaggcaggagaatcgcttgaacccaggaggcagaggttgcagtgagccaagattgagccattgcactccagcctgggtgacagagcaagactccatctcaaaaaaaaaaaaaaaaaaaaaaaaaaaaaaaaaaaaaaagaatgtctggaaaccaatggatcgtgcttgcattgaataaaacaggaaacaggatagtcatgtgatttagatgtattaagatgaatcccagagagagctgagtataacctccctctgcagaacaccatggccatggctcaggaggctgcttggggcaaggtttacctctcctagaatcaatggggcaaggggctttagaagttaccatctcctggaaagaaaagactccacccccttgctatcaataatcgcatcctttcaagcagtcttccccttggaaccttcagctctaatattaccatatccctcatctctgcttctgtgagtcactctgaaaagtccagagcccttggtcattggtcatcacctaggttcttggtcattggtcatcacctaggttctagtcccattgtacactgcattttctgatcctcatctctcactcttcatctcttgatatccttggtctgagctttctgaaattttaggtccatctcatgcaaaatacctttcatcctcaactcttctgtgcattctgtggaaggaaaattatcttgggcccccaaaatctctaagctaaaggaaaattcaagctaggaactgctcagggcaaatttccctcccagtctgttcaaagtcatccctctgctcactgaggtagatgcatattttgattgcctcctttggaaaggcttatcagaaacataaaagaatgcaaccttttgtctctcacctacctgtgacttggaagcccccctctctgcttcaagttgtccccacctttctggacaaaaccagtgtacttcttacataaattgattgatgtctcatgtctccttaaaatgtataaaaccaaactgtgccccgaccaccttgggcacacgtcgtcaggacttcctgaggctgtgtcatggactcacatcttcaaccttgacaaaataaactttctaaattaactaagacctgtctcaaattttggggttcacaattcctctaacattcctcctctgtttaaaaccagctctatccttaggacacagcttcccctgcagccccctaagtagtgatcactctcttatataccccatggaccactgggcctgagagtggggtgagtgtcctccttgttcctcagtagcatatctctcccacctcctgaataagtccttggcttgagtcacgggtcatcagaatataccattcatggccaggcactgtggctcacacctgtaatctcagcactttgggaggcgaggtgggaggatcacttgagctcaggagttcaggaccggcctggacaacatgtgagaccctatttctacaaaaaatcaagaaattacccaggcatggtggcacaaacccctggccccagctactcaggaggctgaggcaggagggtcacttgagaccttggaggttgaggctgcagggagccacgatcatgccactgcactccagcctaggcaacagagcaggaccctgtctcaaaaaacaaaaaaaagaaaaaaaataccactcacaactctcattgttgttggtgtcttttgacactcaacaactccctgttattctaattcactcactccttaaaaactatggcattcttaactctcatgcatgtataattagatgacttgttaatgactgatgatgtctcagttctgtgacctctgtacctcaatggtcttgtcctacacacatcttggccactctctcccatggccataccctagacctcacaattatcaatttcttctcttcttcataaagtcagtttcaaatatcccatcctagataactccctcctaatttttctaccctctctgccgactactccaaagttaacaatcatttacccaaagagaaccctccctccattggccctatcacctttcactgtttcccatggctcccatgaactatttttcttccttctcttccttcaattgtgtgtttcctgacctatgccctcaattctctttcctcttccctacttccccgggctcatctgtcaaaccaaacacttaaattgtactgttcacctactccatgtttgaagtggctcagatgaatatggttggaaaaaaacaaataagccaggcacagaaagacaaacatcacatattctcacttatttgtgggatctaaaagtcaaaacaattgaactcatggacacagagagtagaaggatggataccagaagctgggaagagtagggggatgctggggggcaagtggggatggttaatagctacaaaaaaatagaaaaaatgaataagacctactatgtgataacacagtagaataactataatgaataataactggactatacattttaaaataacttaaagagtgtaattggattgtttgtaactcagaggataaatgcttgagcagatggacaccccattctccatgatgtgcttatttcacatttcatgcctgtataaaaacatctcatgtacaacatatatgcatccactatatacccacaaaaattttttaaattaaaaaataaatagatatttaaaaaacaaacaaacatgcaaacaagcaaacaaataggcaaacaagatcatgccgaatggcttcattttaaatttggatcactactcccaagtaagtttttaatgccggccagtaagcatattaaatttatctagaccttatgttttcccgcttttcttaatgactctttcttactccttaattttcagcatctccattcccatcctcactctcagcttacaatgttgacttctgctctgacttcacagaaagaaatggaaaggtttagaagagaatgtccaaagaatctcaccacctctctccatccacttggtttcatgctctggcaatgtcatctctgcctctggaaataccagcttctctctccttctctactggatccattccaaacagcaaacaacgatgctattatttctttcatcttaaacaaaataaatacagaaccctctcttgagccctcttcatcctccagctacatcacatgcttctgttcttgccacaaaactccttgaaataattatctaaaatcgtgttgccactttcttttctaccatttgtcctgaatcaacccccaatcacttccccaccaccatagttctcaaagtcctcagtgacctccacattggtaaatccaatggttatttctcactcctcacctaacttgatctctcaagagcatttgatacagtggactgctttccctccttgatgtcttttcttttatctctcctgatttgcctcctgcatttctggatggcctttctctgtgtgcttcctcctatccctcttaacaggatgtcatgtgctcagttctcatgcctcttctctctctacctacacttacttactaagtgtctcattcagcctcacggttttaaatactacctatattctgatgactccagacagacacctcccctgaatttcaaaaatatacaaccaattcctatgtgacctctgcacatggatatctgattgtcaagttgaagacatatccaaaaccaaggtcttcgtctcattcccaaaccagcaactcctgcagtcttctgttagtgcttttccatttgtttcttccagttgtccaggcagaaatctgcttgtgatccttgggtcagtgctttctcctatagtcctcatctagtctcttgggaaatccatcaagatgtatccagaaatcaagtgacttctcaggaacccccaggacatcgccctggtcttggccagcaccatggcttccttgaattattgcaagtgtctcctgagtggtctctgtttctactcttgccatcaactgcctcttctcatctcttcaccccgctaaaatgttaaagacacatcgtgaaccatctcagctcacaccttctagtggctccacgtctcctcaaggtaaaagccaaaggcttgactgtgactctcaaggtcatgcaccatctggtccctcatgaatccggggacacacactttgctacccacacactcccctttgcagttcagccaccctttctcccttgccagccccaaactcataccatgtccatggagccttcccaccttctcttgctgctggctgagatgttatcctgataacatccacctgactcacaccttccattccttcgtcctcctgcaaagtcaccatctaagggagcccttcccagacacgttgtgcaaaatgtcaaccccagccctgacactccatactcccttctttgttgatacgtccttcttagtacccatccctatctaacatgctgtatcttctatgtatttattacatctgttacctacctcccacctgagacagtgagccccagaatgacatgcatttttacttgttttgttcactattgtatctcttatgacaaggagttgctttataactatctgttaagtaccaaaggaaatagctgggagaattgagggtagttgctaatgagaaatagaacgggggttgaaagaggactgtttgcattattggctttttagagctacaggtcgagtatcctttacctgaaatgcttgggaccagaagtgtttcagattacggattttgtaatatttgcatacacataatgagatatcttggggatgaggccttgagtgtaaacataaaattcatttatgtttcatagacaccttatatgcagagcctgaagttaatttcatttttcccttgcgggactctggatacaccacatgttgagtggctgtattttgactgtgactcctcccaggaggtcagatgtggagttttataattgtgatgtcattttgtccttcaaaaagctttggaacatttcaaattttggatttgaggattagggatattcaacctatatttgcatttcttaaaaaaacaatgcgttatttaaatatgaactagagctatgcaatgtgcctgaatatccttgttgttctttgtaagcatttgggcattatactcatttggcccaattattgggatttggctatgcgcatctcagatgccagaatgctcgtgggaagacgagctgctgttatgtgtgagcatgagaccagctggtaaacatgatgcccaaggagaactaaggtgcacatcttgccttaaaataaatacaatttaaggccgggcatggtggctcacgcctgtaaccccagcactttgggaggccaaggcaggcagatcacttgaaatcaggagttcaagaacagccaggccaacatagcaaaaccttgtctctactaaaaatacaaaaattagctgggtgtggtggtgcacgcctgtggtcccagctattcaggaggctgaggcaggagaatcgcctgaacctgggaggtggaggttgcagtgaggattcttctctttctctcatattttgatctgccataagccagggataacatttcttcatttgtgtcttccctcttcaaagcctgtttaagcaacaggtctctccctgtgccccattcagtcagatgtctcatgattaggcagatgctgagaactgtatctgcagtgacagggtttggtttttgagcaaaaggaatgggcagcaggaacatcagtggatcctcatgcttcaaggtccctggtgttaatggaaaaaccaactctgaaaaatattttaaagaagcctactctgagccaatagcagtgaccacagcccaggaaaaacacaaacccacgaagccttcagcaagtggtcccgaggcagtcggattataatttggttttacacattttaagaagacagaagttacaggcaaagacataaatcaatacatgggaggaggtgtacattggtttagtccataaaggtgggatatcttgaaatgggagcttataggtttataggtgaattcagagatgctttaatttgcagctgggtaaagcagtaaggctctgtctaaaacctggagtgagcagaaagggatgttttctgttaagataaggatgctgtgtagcaagattgatgatggcctgtaggggtgacttaactcttgcccagcacagccttaggtcctgttgataatttggtatcttattgccacaaagagtctgttttgtcagtcttatgatctgtattttaacatgaatgctggtcacttgtgcctaagccccaaaagggagaggatataaggtgtgtctgatcccccatcacatcatggccgggaactcagtttttcaggtttctctgggatccccttggccaagacagggtccattcagttggtgggggacttaggattctatttttagttgacactgggtagggtcctgcataggacaccatgctcttttccaagatggtactgtgcgttaagacaaagaaagtgctcttgagaaagccctgccagaggaagccctcacgaattccgcacccgtagctgcctctcagccttctgctgacagtcagacaggagtgtactgtggaattagagcacctaaaaatacagctgaataaacacacaatgcaaaacacaaaggaggcacgaattgtggatacacttaaatgggaacagcaaaacttaaattagaggtctgaaaagcgtgctcttttcttggaaggcgctgttctcctttttctaatgatgctaattccatgaacactgaatgtaaccctttaaaagagaaaaatgaggcagctccgcactaattcagtttaattaatgccatcctgttctttagtctacaaacagttattgaaattgcaagatagctatatctgtccttccttaactgctctctgttcttttacaaaaccattttattgtgcattcagagctaccaaaaataaaactaggattgttccaatagcatttccatgcttcctatagaatgagctcacattaccacttactcttgaggagtctaccagtgagcttgatttgctttggataaatgaatcctccatcatttttttaagtgactggcaccctggtttttttgtttgtttgtcttttccacaaatgttcttagccatgacctctaatggacacaaggagacaattcctttttttttttttttttttttttgagactgtgtctcactctgtcccccaggctggagtgcagtggcacaatcacgggtcactacagcctcaaactcctaggctcaagcaatcctcctgcgtcagcctcctgagtagctggaactatgggtgtgtgccaccacacctggctaatttttttttttgaatttttattagagatgatgtcctaatatgttacccaggctggtctcgaattcctgagctcaagcgatcctcccaccttggcctcccaaagtgctgggattataggcatgagccatggtgcctggccaagaagacaattctttatagtgcctccagctctaaaaagttaaaattactatgctataggcatagaatgagacatctacaaaaagctaccccgtgtttttaattaggtgtttagtgaatcactttgaaaattctgggaagtaatttcctctcctttaaagaaaagaacattcttatattccttatcagataacgatgctgttgaaagtggatacacttatagctgggatcctcagttgtcccagtgctaagatgcctatgcagacatcaactcagttcacatcagctctaactgcatctcactttgtgggcacctgcagaccagttcttctcaggtgctgtgcccatagcacagagagcttcttgggatgtgtagggagccttagcccctaaaggttcactgaaaaatcaccgacatgaggcagactgattaagaggagaaaaggcatacagattaatttaacgcatatacacaggagccttcagaatgaaggcccaactccccaatcaggtctagaagcttatataccatctgaggttacagaaagaatggcgacttggatcctggtgaaacaggtggtgggctgggggagaagagaattctatggaggggattactagagggaaggaatggatcaggaacagagattaacttgtaaagagttctctttggaagttaaatgatccttagagacactcatcattcttggaaaaggcaggtgtggtcttctcttttttttttttttttgagacagactgtcatccaggctggagtgcagtggcatgatttcggctcacttcaagtgattctcctgcctcagcctcccaagtggctgggattacaggtgcacaccactaggcgagcttattttgtgtttttagtagagatggggttttaccatgttgatcagggtgatcttgaactcctggcctcaagtgatccaccaccccggcctcccaaagtgctgggattacaggtgtgaatcaccgcacctggccacatcttggtcttcttttctgttatagacaatgagataatttggagggaaagaaaaaaaccactgttctccttggtgggtctggattttaggcagataaaggaacttcagtttcaatgggagagacaggggtttggggaggacatcagagagaccttgaggcttcttcagctcagcgtgtccaaacgccagattttgggcttttggtttctgagctctaacagtaggaatagcttgtgaaatctccttgagatcttatgtttcatttttgaaaattcaaatatttgtcattccactttataatcacatcccaatattgggtataatataaaattaaaattataaattacaatcaagtggacaccttcaaaatgatgtactataaatgacttagcacttcctaatattgacacttcaaaaaacagaggccgaggagggtgaattgcttgagctcaggagttcgagaccagcctgggtaacatggtgagacccggtctctaccaataaaacaaaaaaaattagccgggtgtggtgttgcatgcctctggtcccagctactagtgaggctgaggtaggaggatctcttgagccggggaggcggaggttgcagtaagcccagatcgtgccaccactgcactccagcctgggtgaaagagcaagaccctgtctcaagaaacaaacaaacaaaacccagagccatagttatcctatcactttgtgtgctctggaacactctgacgtatgttagggacctcagtttgcaaagcatggtcctagaaaaacatgatcagatgtacatagttattcctgttcattggtatcaatcatgtacagcacacgccagaaacgagaaggcaataccacattacacaggagctactttctactagatttccagattcagcaaataaaaatatgagatacgcagttaaatttgaatgtcagataaacaactgtcaatgaaaagagtcaaactctgtaaaatatttgaaaagatttattctgagctaaatgtgagtgaccaatggctgtgacacagccctcagtagatcctgagaacaaggcccaaggtggcctggctacaattaggttttatacatttagggaaacataaggcatcagtcaatacaagatgaacattggctcggtccaaaaagatgggacaaccggaagcaagggcttccaggtcacaggtggttttaaagattttctggttagcaactggttgaaagagttattgtctaaagacctggaatcaatagtaaggaatgcctgggttatgacaaggggttgtggagaccaaggttttctcattcagagagaatagattgtaaatgtttcttatcagacataaggagccaattctattggtaattccaaaagggaggagggaatcttgatgcacatccagctccccttttctgtcagggccggaactagtttttcaggttaacttcggaatgcccttggtcaagagaaggggtccattcagatggctgagggggcttagaattttatttttggcttacacaacaaataatattttattatacacatgccccatatttacgtgatattcaaatttaactgggtgccctgtgttttgtctagaaactctatgactcttagggcttttcctgcccccagtcctgtctcaatcctctttcctttgatgtgatggggcttatcctttcatatgatagggctgtgttactgagaattcactgcattactaaacatctccttctgcaccaggccatggttaagaagagaattttgtggtaccccaagagtatagaggaggtggtggaagcagcacaggtgcaggtggttgaaaaataggataggactttccagggtcttccaggatgaaggtgatcctaggctacctgagagaagacaaagacaaggtgggggggtgttgctttgtcagtggtgtttgaaccagagtgactccaccttgaacaagggctgggtaaaatgaggttgagacctgctgggctgcactcccaggaggttaggcattcttagccaaaggatgagacaggaggtcagcaggactggtgtcaccagagacagatcataaagaccctactgataagacaggatgcagtaaagaagctggtcaaatccaccaaaaccaagatagtgacaaaagtgacctctggctgtcctcgctgctcattatatgctaattcaaatgcattagttgctaaaagacactcccaccagcaccatgacaatttacaaatgccttggcaacgtcctgcagttaccccatatggtctaaaagcgggaggaactctcagttctgggaaaaccccacccccttcccagaaaactcatgaataatccacccctcattcagcaatgatcaagaaataaccataaaaatagccaaccagcagcccatggggctgctctgcctatggagtagccattcttttgttcctttctttcttaataaacttgctttcactctactctgcagactcacccccagttctttctcgtgtgagatttaagaaccttctcttggggtctgaattgggagccctctccagtgacaattcctttagatcaaggtctgagctctaaatctcctgaccttgctttcttgtttgtttctcctggaacttctggtcactcctgcctcaagtttcttaacaaaatagagggcacccagttaaatttgaatgtcaaaaaaagtgttgcatccttatacaaaaaaaaaaaaaaagtttgttgttgtttacctgacattcaaatttaactgtgtaccctatatttttattcgggtgtgtgatgcttggccgctgcagttatcctgtgacctgaaggatagaagtcatgttccaaactcaatagtagtcccaagaaagagaaaggttctggttccattcctcaaatgtcttgtgcctctcacacacgttccatctctgcattgattggaattattattagcgccaggacctgggtgtcattgtttattgatttggaagattcttgtgttcctggtttatataactgaatggatggtggtcttggtcacagcaacagagaatgctcaaaaaagagccagacttggaatgtcatcaatttcattaaatattttttaacttttttatagagacgaggtctcgctatgttgcccaggctggtctcaaactcctggcctcaagcagtccttctgccttgcccttctaaagcactgggattataggaacaagccaccgtgaccagctttgcattatatttaaaagcaaaagcgtctaacacgaaggaaataattaggtagatttgttctactccataggagggaagtgtatgtagccaataaaataattgcatttgctatttctgtgtccgttcctaattgctgcagagccagccagtcagtataaatcagaaaatttaaggagcagcgctcctgtgtgggaatcttgaaactcaaagaagctcagctgaaagggaaggattccatgaacccttgcacctgtggacaggacccagacgacatccagactgcagtaccgggaggacgcaatcccaagataaaaaagatcagtcatgtcccttttcggttcttccctactctatctatagtcttagctgcagagagtaggttaaaaaaacaaacaaacaacaacaacaaaagacttcactatttaaaaaacctctctaatgaggttttgaaatgctaacttaaagatgtttaactcttttgctgcttcacacccaaatgcttttaaatcagtaaaaattaattcatcccttatctcaggaaatatcttatgcaagtagcttctttaattaaatacttataaataaacgcacaaatatgtgtgtgtgtttatgtgtgcaccatacataagttaagttcgtaaggcaaacttacaaaaccctgcctgtctttggtattgggcttggcaactgctttttaacacagttaaaaagccgagcgttcctggcaggcagatgacttgatatggagcagacagaggtgggcttacctgtgctccgtcatctgttacaatcaagcgtctgtcggatgatggattgttcttgccgggagggcttctcctcccatgattaaacgtgtgaggcgcgtgtttcagcagttcctaatcgtacaggtggaagcacacagattttcccttttctggcccctttttgaaagtgcatagctcatccattgtgcttggtaacccccatgtcttcatccttaaagaatccagtagccatagaggtggtggaggagccatgatggccgaacaggaacagctccggtctacagctcccagcgtgagcgacgcagaagacggtgatttctgcatttccatctgaggtaccgggttcatctcactagggagcgccagacagtgggcgcaggtcagtgggtgcgcgcaccgtgcgcgagccgaagcagggcgaggcattgcctcacttgggaagcgcaaggggtcagggagttccctttccaggtcaaagaaaggggtgacggacgcacctggaaaatcgggtcactcccacccgaatactgcgcttttcagacgggcttaaaaaacggcgcaccacgagattatatcccacacctggctcggagggtcctacgcccacggagtctcgctgattgctggcacagcagtctgagatcaaactgcaaggcggcaacgaggctgggggaggggcgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaagacagcagtaacctctgcagacttaaatgtccctgtctggcagctttgaagagagcagtggttctcccagcacgcagctggagatctgagaacacgcagactgcctcctcaagtgggtccctgacccctgacccctgacccctgacccctgagcagcctaactgggaggcaccccccagtaggggcagactgacacttcacatggccgggtactcctctgagacaaaacttccagaggaatgatcagacagcagcattcgcggctcacgaaaaaccgctgttctgcaaacaccgctgcggatacccaggcaaacaggtctggagtggacctctagcaaactccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagaacacaaaaactggaaactctaaaaagcagagcgcctctcctccaaaggaacgcagttcctcaccagcaatggaacaaagctggatggagaatgactttgacgagctgagagaagaaggcttcagacaatcaaattactctgagctacgggaggacattcaaaccaaaggcaaagaagttgaaaattttgaaaaaaatttagaagaatgcataactagaataaccaatacagagaagtgcttaaaggagctgatggagctgaaaaccaaggctcgagaactaggtgaagaatgcagaagccccaggagccgatgcgatcaactgcaagaaagggtatcagtgatggaagatgaaatgaatgaaatgaagcgagaagggaagtttagagaaaaaacaataaaaagaaatgagcaaagcctccaagaaatatgggactatgtgaaaagaccaaatctacgtctgattggtgtacctgaaagtgacggggagaatggaaccaagttggaaaacactctgcagggtattatccaggagaacttccccaatctagcaaggcaggccaacgttcagattcaggaaatacagagaacgccacaaagatactcctcaagaagagcaaatccaagacacataattgtcagattcaccaaagttgaaatgaaggaaaaaatgttaagggcagccagagagaaaggttgggttacccacaaagggaagcccatcagactaacagcggatctctcagcagaaaccctacaagccagaagagagtgggggccaatattcaacattcttaaagaaaagaattttcaacccagaatttcatatccagccaaactaagcttcataagcgaaggagaaataaaatactttacagaaaagcaaatgctgagagattttgtcaccaccaggcctgccctaaaagagctcctgaaggaagtgctaaacatggaaaggaacaaccggtaccagccgctgcaaaatcatgccaaaatgtaaagaccatcgagactaggaagaaattgcatcgactaacgagcaaaataaccagctaacatcataatgacaggatcaaattcacacataacactattaactttaaatgtaaatggactaaatgctccaattaaaagacacagactggcaaattggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgatgaaacagactttaaaccaacaaagatcaaaagagacaaagaaggccattacataatggtaaagggatcaattcaacaagaagagctaactatcctaaatatatatgcacccaatacaggagcaccaagattcataaagcaagtcctgagtgacctacaaagagacttagactcccacacattaataatgggagactttaacaccccactgtcaacattagacaaatcaacgagacagaaagtcaacaaggatacccaggaattgaactcagctctgcaccaagcggacctaatagacatctacagaactctccaccccaaatcaacagaatatacatttttttaagcaccacaccacacctattccaaaattgaccacatagctggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacacaacataccagaatctctgggacgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccgctagcaagactaataaagaaaaaaagagagaagaatcaaatagatgcaataaaaaatgataaaggggatatcaccaccgatcccacagaaatacaaactaccatcagagaatactacaaacacctctacgcaaataaactagaaaatctagaagaaatggataaattcctcgacacatacactctcccaagactaaaccaggaagaagttgaatctctgaatagaccaataacaggatctgaaattgtggcaataatcaatagattaccaaccaaaaagagtccaggaccaggtggattcacagccgaattctaccagaggtacaaggaggaactgataccattccttctgaaactattccaatcaatagaaaaagagggaatcctccctaactctttttatgaggccagcatcattctgataccaaagccaggcagagacacaacaaaaaaagagaattttagaccaatatccttgatgaacattgatgcaaaaatcctcaataaaatactggcaaaacgaatccagcagcacatcaaaaagcttattcaccatgatcaagtgggcttcatccctgggatgcaaggctggttcaatatacgcaaatcaataaatgtaatccagcatataaacagagccaaagacaaaaaccacacgattatctcaatagatgcagaaaaagcctttgacaaaattcaacaacccttcatgctaaaaactctcaataaattaggtattgatgggatgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcattcttatactccaacaacagacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgagtaggaagaatcaatatcgtgaaaatggccatactgcccaaggtaatctacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcatatctacaactatctgatctttgacaaaactgagaaaaacaagcaatggggaaaggattccctatttagtaaatggtgctgggaaaactggctagccatatgtagaaagctgaaactggatcccttccttacaccttatacaaaaatcaattcaagatggattaaagacttaaacattagacctaaaaccataaaaaccctagaagaaaacctaggcattaccatccaggacataggcatgggcaaggacttcatgtctaaaacaccaaaagcaatggcaacaaaagacaaaattgacaaatgggatctaattaaactaaagagcttctgcacagcaaaagaaactaccatcagagtgaacaggcaacctacaaaatgggagaaaatttttgcaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaaacacatgaaaaaatgctcatcatcactggccatcaaagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatccagaactggaaataccatttgacccagccatcccattactgggtatatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctggggactgttgtggggtcgggggaggggggagggatagcatcgggagatatacctaatgctagatgacgagttagtgggtgcagcacaccagcatggcacatgtatacatatgtaactaacctgcacaatgtgcacatgtaccctagaacttaaattaaaaaaaaaaaaatccagtagctgggaggattaaagtgaggactaaatctcacgaaagagaacaaactgcctatttttggtcaggagtcgcatgaattatgccaatttaagaaccacctgcctaaagcacatttttttctttttcttttctttctttcttttttttttttttttttgcaatactagcctggcagaagctaagaggtatgaaggcgaacatgacacctttatgcaaatgtcacattttactttcaaattcctaagcacaattatccattatgtcccagataattggtaataacttaaaaaagcagataatggataagtattctggtggactaattataatgtatgccaaaaattatctttttacaaactcattctcaactctttggttcttttgatttatgcaaaccacggctttttatctctaggtttcattcctcattttaagagatctggtgaaaacttttacctttaaggaagtggaggaaatccaattgcttttccagctagacaagatagatttttatctttatcaacagtcttgaaaaagtgtggaaggaaaatatgttactatctgtgagaatccttaaaggagtcagaaaaaccataaaaccatagcattagataaagtaatatattattttagatttattatttattagatttattattcatctatttaataattatttaatatctatattaatattgtaaatataatatttaatgctatattaatattattaatatatattattaatattattaatctatttaatctataatagatacattattttgtgattccttaaagtcatcacaaaaaccatggcattagatgaaataatctattattttaatagacatttcccagtgcttataaaaaagacatatttattattacaactcggaaatcttattccatgaaaaaaactcaagaattctgaggccaggtgcagtggctcatgcttgtaattccagcactttggtaggccaaagctggaggatcacttgagcccaggagtttgagaccagcctggggcaacatggtgaaaccctgtctctacaaaaaatacaaaaaattaggtgggcatggtggtctgcacctgtagttccagctatgagggaggatcatagctcatatgatcgctcaagcccaggagggtcaaggcctgcactccagcctgggtgacagagcaagactctgtctcaaaaaaaaaaaagaaaagaaaagaaaaagaagagaaaagaaaaaagaattctggatattctggatagctgttaaagaaggaatcccataaatatcttttcaaaatgaaaaggcttgcatatgatcatttgtgtttggtatcattatttctgttggcatcattccttctatacagttgtgttaactgaaatcaagaagtgaaagacattctgagacagatataagggtactgtcctggaatactgagactataacctttagcctctcctctgtaaaataagaatcttcaaaactctttttaggggtcagcttcattcatagcttatactaggggatagccaactatggcccattggccaagcctggccctctgcctgtctttgcaaataaagttttattggaacacagccacagacattgcttacatattgcacatggcttttttcacactacaatgacggaattgagaagtggcgacaaggaccatatggctcacaaagagaaaattatttaatttctggacacttagagaaaacactgcctgacccctagtttgaggcaattacaggtgttgatgggaatcagcaacatcaggccagagtgaatgaagttgttctgcttcatcactaggcaaaattacagccagcaattagaagcactcactccagcttaccaaaattcagagtgattttcatgttgcagctgttcttgaagatagcgaagttggaggcctgactagaactccagactttggccctgtaattcatcactcttttactcctcacccactgattaagaactatgatggagtacctgctgggagccatcttccttgcaggattaggaaacagagacacgagagtaacaagtccctgccctcctaaggaccattgtttacaaactatctgggtgctcttgtttacaaacttccactcccatgtccctgcacaccactgttgactcctaagtgcagtggagccccaagtacaaagtgtgtcttttagaaacatgaaaatctgcaaaaaacagatatttagatatgtatttcaattttcactgagtgataagatcaatttcagagttggcaaaaactgacaaaaaccttatatattattttaaagcaattttatgacaaggccaagcccaagtgaagcaaacaatatcttgttgcaatggccctccctctttcccattttcttcccaaacttacaaacattgggtggtgacatagcatagatgttataatgctacaatagagtgtagtacagtattccttctgcaatccacttaatcaatggataaatgttgattgtgtatctactatgtacctaatgtgacatggtcagtggagatttttattgtaagagttgacctcttaagggaaggaaattccaatctcctcaccccatgctgactcaacctctaaaaaaataaagactagtcaagttcaaggatgataatttatttccagtttcttttttctttttcttttctgtctttttttttttttttttttgacaaggtcttgctctgtcacccaggctggagtgcagtgacacaattatagctcactgcagcctctacctcttgggctcaagctatcctcctgcctcagttgggaccacaggtgcacactaccatgcccggctaattttttaactttttgtagagacaaggtctcattttgtttcccaggctggtcttgaactcttcaggtcaagcaatcctcccaccttggcctcccaaagtgctgggattataggtgtgagccaccatgcctggcctggtttctattttctaaggttgagtcatcttgtggaaaataagaacaaaacttgggatttttttttccagctttattgaggcataaataacaaagtaaaaatgctgtatttatttaaggtatacatgtgatgtttgatatatgtatacattgtgaaataattaccacgatcaagctaattaatatatccatcaattcatgtacttactgcttttctgtgtgtatgagaaaaattaagatctactctctagaaagaaataatcttttttcagcaacatggatggaaatgcaggtcattatcttacgtgaaacaactcagaaacagaaagtcaaatactgcatgttctcccttatataagtgggaactaaacaagggctacacatgggcacagaatgtggaataatagacactggagactccaaaaggcaggaggagggaggcgaggggagggttaaaaaattacctattgggtaccatgtttactattctggcaatagatacactaaaagcccagaattcaccactacacaatatacgcatgtaagaaatctgcacttttacccactatatctataaaaatgttaaaaattaatattaaaaataaaacaaagttctactctcttagcaaatttcaaatatattgtccaatgttgtaatactgaattattctaatactgaattatatatttgaaaactttaatatttaaaagtaacaatttgctacatttacaagaaatgaaactagggaccaccacaggccctagtttcctacaatcttaagatgacagacttcctttacgtaatctgagacctatcagagaactggctgtccagatagggaaggataagttgctctttctgcatttgctgcttcttaattgccttcaggtcaaaataattcttagggccaaatggtgtattttggggtggtgtattctaataccttttaggtaccctaaggatgaatagtgtcccctaaaaagtgatatccacttggaatctcagaaagtgaacttatttgaaagcaggctttttgcagatctcatgagtcaaggatctcaagatgcaatcatcctggagttagagtcagccctaaatccagtaagtggtgtcttcataagaagtggggaagacacagagaaacacacacagggaagacagccacatgaagatgggggcagatattggcgtggtgtagccccaagccaaggagccaaggatggggccaccttggccacagctggaagaggcaaggtaacactccttcttagagcctttagagggaccgtggtcctgctgacaagagtgacttttggacacatggccttctaaactgtgagagaataaatttccattgttgtaagccacctagtttgcagtactttgcttcagcagccaaatgaaaccgatgcacccaaagaaacatctcatcaaccccctttagtaatcacctgccacatttatctctgtgcatggtgaaagtccttacccagtgcctcagaactatgatgtacaatgtaggaattctggaggccttaacataagcaggacaccatgaggggccttctatggcacgtacaattcaagactttcacgtatatttccaagttatgctaccaactacacatccccagagagccctcatcactagtacttctaaaatatttaatagaataatagaacatttcttcctttgccaattaacatttcagcagttactttaatatctaaaatattttaaaggtttctttcatctcggtagaaattctttgcagccagggagctgtgactcaaagatgtattttagctcagaagcaaagccattccatttattatcccagatttttcgttaatttgaatttttgttattatggttcagaaatttggaattgaatggaaattttgctcccacacttgatccagtgtgagatgttgaaaaagtaggcaatatttaccctaaatacaagacatttaggcagatatattgggaataaaaccctgacattctagaaaatgatgtttttattaataccagaaatattccggtaggtgttatctgtactcacaatatctaatactcaagagtatgatgttggcatttcaccagtaaagaaaagctgcttttctgctttcctcctaaatggtgctgcatttccaacacttcacaaagcattgaacacactgccactggaggcagccatgaatattttattccctctcaataaaacagttaaacacatccattctctgccgttcaaggatttgtaacctaaggccatggctgcacaattttaaatgaacagagttagaaaaaaaaattaaaaagaaagaagtccaaatttcattccttccatttggtcatttttgtggagccaactatctaagatctacgcacaaaagaatacgtggaattacatggtttggctgagtccccacccaaatctcctcttgaactgtagtccccatgtgttgtgggagggacctggtgggaggtgattggatcatgggggtggtttcccccatgctgttctcatgatagtgagtgagttctcacgagatctgatgattttataaatggcactttcccctggggttctctctctctcctgccaccttgtgaagaagttgcttgcttcctctttgccttctgccatgattgtaagttttctgaggcctccccagccatgcagaactgtgagtcaattacacctctttcctttataaattgcccagtctcgggcagtatctttacagcagtgtgaaaatgaactaatacatggaatgattccacattatttgaaaaacatgctatatatattgagagtgagatacatcagggacccctcttaggggcccaccccccacccatcccctgttcccaagcatggaaataaggcaaaatctagagttccttcaagggaaattccaggcacctagctggccctgagaagtaacagagcaacttgataagccagaagggaatagtagcctaaaacaatagccaaggaagctcatagccaagagttgtttgggtccctatagaaacaaaagataatatcttagcatatgttcctgagttgtttttcagaagcctggatccctgaaaaaatggatccactggcatgtagacctcagacaaggggcaactgaggactgagctccgactgcaactctttgttctaaatttcttcctgaggggcctagaggaagtcatgcccatggaccagagctcagcattcctttctgctgatcccaaatttttagacaaaactttccctccttatccgatcacaaatcagagaaactttgaatccacctatgacctgtaggccactcccctgaaatcgagatgtctcaccttttttaggtaaaaccgacgtatggcctccatgtattaacttatggctttgcctgtaacctctgcctccctgccttttaaaacctccacctgcaagccatcagggaggtcaggtcttaagcctgagctgcttgattctccttgcttgctgccctcaataaatacttcacttcctcttactgcaatcctgatgtcagtgtttggctttggggtaccgggtgagtggaccctagttcggtttgatgtcaacagtgtgttgtatgtggaaggatccagaagctcctagacccaacttggttacatcagcaagccacaaagttgaaggagagacttagaagaagcctgggaatcaggaggcagtgatttccaatgtgcacaaacatacctgtgttttttccccttttttgtcattaaaaacaaatatttagatgtttttctgtatatgctttaaaatctaatatgtttgtattttgtctgtctttaaactatagctacttggaaatattaatgaaaaagtggccaaggaaggtaaggcaaccattgatgaataaaatctaaatggtcaatatacacaaagaaatcaaagaaatgtttattaaaaagatgaaattactccttttcaatttatgaaaattgcaagaatgtttttaagagggttcccaagagttttcaggaaagcaccagtatggggacttctacaccttgcagaaaaatgcataaattgaaaaaaaagaaacacagaaaaaaaagcaaatcataaagttgtgcacacacttggactcggaaactcaaactttgggaattcagcctgaagagataaacatgaatatcgtaaactaaaaataaaattctaagccccacaactgacttaatgaaacatctcttagccaaagggaccccagaataaccttgaaaactgaaggccacgacgagacggggtgtcagacacacctcgttataccccatccctcgctaaccaccattagacttgcttccctaagggttaaatagaaaccagccctttccaaagactccactgctgatatcaaccaaccgcccgatgctgcccctaccctttgtgatttcagcacagcaaccaaccagtatttcttcctgataagagaccctgaccatggagtggttctggctcgtctatggagaatgtgcaatgagggtgttagtgtcttctgcttcaccttctgacatcagaaggctgagaactcaatcctgggatcatgctaacatcaccattccttgtacatgggacacatgaaggggcatgaagctccactgcaaatacacacgtttcttctttcatgaatatctgtgatgcctcttatagcttattgaatacgtatattcaaccaccctgctcagcataaattcctgttccctttgcccctccctcgaagtgtctgtttctgtcttctggccacaggctacatttcccagtctgtcagaacagccaccctacaggctacaaccctttataagaaataaagctcttctttccaaatttatgtaccttgttttcttcagttgacaatataaggaatgatttagctacaaggttgttttagcagaactgacaacaactttattgcccaatactgggacaggggaggcaaaatgtggaaagctctcaaatggagtaatgtgtacccaaaaccaatgatctcaaagaattatgtgtattatacagaaagacgtgaatcatatctgaaatgtaaaaaaaaatcacaaagcagcgattacataatgatcctgtcttatggaaaaacattaaaagttttgctacactgaataaagtatggaaggtcacacaaacatatatgaaacatgaatcattccagtggtgggtttgttgttagtcttcacagtgttctttatgcttataggtattttctaggtgtaaagtaaacatggattaatttgatgctttgaaaaagaaaagctgttttaaaagttgaattctatattgtctgtttttttttgtttgtttttctgtttgtttgtttttttttttttaattgagacagggtctcactctattgcccaggctggagtgcagtggtgccatcttggctcactgcaacctccgcctcctgggttcgagtgattcgcctgcctcagcatcccgagtagttaagactacaggcacgcaccaccacgccctgctgatttttttgtatttttgtagagatgcggtttcaccatgttggccaggctagtcttgaactcctgacctcaagtggaactcaggtgatccatccacctcggccccccaaagtgctgggattacaggcatgagtcactgcacccggctgaaagttgcattatatattgtcttggtctcaacaaatacacaaaaatggcatagttgaggagggtgcaactacaaatggcagttgggaatgaacagattcatagattgcttacattttatcactaaggtggacccaaaagttattaattgaagtagtaaccacatcaaatgtgctttaaaaaatattaagctgtatgaggctgggtgtagtggcttacgcctgtaatcccaacgctttgagaggccaaggcaggaggattccttgaggctaggaattcaagaccagctgggcaacatagtgagaacccatctctacaacaaatttaaaaattagccaggtatggtggcacattcctgtggtcccagctacatgcaaggctgaagtgggaggatcagttgagctcaggagttcaaggttacagtgcactgtgatcacaccagacgtagtgagaccctgtctcaaaaataaataaataaataaataaataaataaataaataaataaaaataaagctgtttgaattgcacataaatcccatgaaaattatataccatatcattcataatttgacagtggttaaagttatagacagatgctaaaatttgagcaattccatttgtcctttaaacagaacaagcatctaaccacaatattgtcctttgggctttcaaatgatactatctttcacagccagcctcttaaaaggaaaaacaaaaaggaggaatattagacatctaacatgattccctgcccttcctgcctccatgacttgtggctgcagataaaacaaacgaagaagttttagatagagtgaggcccattctcctagtacacaaaagcactatttttatattgactcaggagagaactcacctaaaattattctttggttctgacagctatttgcaggctttagaaaaggggaggaaaggagtgcctttctcaatcactctttaaataagtgcccttgggtgaaaccgacaccttgtcttctacgttactcctttgagactctcagagcatgcagaggctgagagattgagacactgcccttccagcccctcagtcagactcctaaataccaactctggtctcttttgctcgcttcccattttatcagtgggggcaactgatatttcatgtttcttatttgagaacagagctttttaaacattaatgtgcacacatatccactggggagttttgttaaaattgtagattctaattcagcagagctggggtggggtccaatggtccacatttccaacaagctcccaggtgaagcccacgctattggtcccagactgtgcctgaatattaaggttttagatgatgctaaagaaaacaagaatattttcttgtacatgatcattttccatagtttgcatatcgtgtgttcagctcaaggcagtgttgtggatcattttccatcccagaatgtggattgggtcattccaacacaatgaatgtctctgaaatggataaaacagtaaagacatggatgttccagggtttttcaatctagcgtctgtggagcataagggaactgtccacttccatggaaatttaaacaactaggctggtatcatgctcagcgaggaggcagaactggaatataatttaaggacagtggtgatgagctgtgttcgcaatgggggcacatgatgttggtgtttcctaagccaatcctttgccattgcacagaagtcagagatggtgacacattaggtcaacccatggcaccatgatatatcagaacagaaacataaatcatattactgaaatcatatatctggagttgggtggtccttgacatatacatacactatatcaacaacccagaaagaaggcggtctcttcatccgagtggcctgagacaaatggcatgcagaatttgttgtccttgctttccatgagaagtccactcccactaagtactttgagatttgttatgaaaactttattaaatgtatcacaagtgagatggaggggtttgactcagtcctccagatctttatcaccttgtgtgcttttcactatcttcttgctcctattctccctcctccttatccttttcctccttggatgatctgtatctttccagtgaagcacagcccttaaacccatatacaccactaaactccatgctccataaaaccaaagggtctgcttttctttaagagactattcagcaaccatgtattgttcctcttgtacatcagttaaggctcatctctcacccccaactgctaattgcttaatctttctgcagataactctattaaataaaatgttctttctttttctgtttataaatattgcttttcattacccttatgttaaatgttaatgtcaaaactccctgtattaattgtctactgctgaaaaacaaattacatccaaattttatctttttaacacaacacacatgtattatggtttctctgggtcaggaatccgggcacagcttagcccactaagtatcttcttctggatcattcatgaagcagtgatcatggtgccagccagggctgggatctcatatcatccatctgaaggctccattggggaagaatctgcttccaagctaactcacatggctcttgggaggatgtgattccttgtaggctattggcttgaagctaccctcaattcctggccatgtggaaatgggaccttgccctgtctccagtatggctgctcgcttccaatagaaagagtctggtaaaaatgatggagtcaggctgggtgtggcagctcacacctgtaatctcagcactttgggaggttgaggcaggcagatcacttgaggtcaggaatttaagaccagcctggccaacgtggtgaaaccctgtctctactaaaaatacaaaaattagccaggagtggtggtgcatgcctgtagttccagctactcaggaggctgaggcaggagaaccacttgaaccagggaggtggaggctgcaatgagccttgatcatgccactgcactccagcctaggtgacagagcaaagctctgtctcaaaaaaaaaaaaaaaaagatggagtcatagttttataacttaacttatttctcatcagttagtcatttcttttttttttttttttttttttgagacagagtcttgctctgttgcccaggctggaatgcagtggtgtgatctcggctcactgcaagctccacctcccgggttcacgccattctcctgcctcagcctccagagtagctgggactacaggcacccaccaccactcccggctaattttttgtatttttagtgtagacagggtttcaccatgttagccaggatggtcttgatctcctgacctcgtgatccacccacctcggcctcccatagtgctgggattacaggcgtgagccactgcgtctggccatcagttagtcatttctattggttagaagtcatgtttttaaaaatgagattaacatttaaataggtttggatggcagtgtcccgtaaataggtaggcttaggaaagcagatggcccactctactgtgggtggacttcgtccaatcaggtgaaggcccgagtagagcaaaaagactgacctttccttcagtaagagagaactccttctgcctaactagctttgagctgagaccttggttgtgtgttttttttttttcctgccttcagcctcaaactgaaacactggctcttcctgggtctcaagcctgcaggactttggaatgaaacaacatcatcagtgctcctggatccccagcttccaaactcaccctgcagatcttagaactggtcagcctccacaactgcatgaacccatttcttataatgaatctctatctaaatatagatataagtatcatgtatttaaaatctatctcatttatctacatttatctacctatctacccatcatccatccatccatccatccatccatcatatctatctatctatctatctatctatctaatctatctatccatccatccatccatccatccattatatctacccatccatcatatctatctatcgagccatccaacaaaatgctggatattttgttctgtattcttccaataactgataaatccttattctactcaactctttactctagggatcctatggctctagttccatgacatctcaagaggactccagcaccatattttgctcttcatgaaaatatctaccaaaggaatgggaactggagcttctatttatgctatggtcacattccccatggcctctaccagtggagggataatgacacctgaaaccatttagaagatgcctgcatgaagacaacctccccagctcagccaggcataaatgcaatggtggttgatgctcttgagtggaaatggcccatttctacaacttgctgcaaaccgctactgtgcacagtgcctggcttacaactgcagctgatgtgttatagtgctgcagtcggcatgccttccttggttgcagaacactctgaattggctggaactttttcagaatatctattcattagatcctaaatgtttataataaaatgtcaatgccagggatagctaacaatgacaacaaatgcttgttgcccttagtttcttagaggagaagaaagagtttgcagcaccaataacttcatgggaatttgggccctgtgggagaagacacatattaaaactaaaacctgggtagttaatttcactcttgataactgttaaatacaggagctacaactgaagtcatcccagaatattcctggatcactattttatttagggactcaataagctcatctccaatcctgctatatggaaacacccattattgagaaaatggaatatcacagaaagtaagtgttcaatgggcattacatatatttgtacagtccacagtggattaggaacaattttcttttccttgactcttttctcctttggtagtaatttttttagagtaaaatttctattttgaaataattttaaatgtacagaaaagttatgaagatagtacagagattccccatatatcttagcttcccctaatgttaacatcttacacaaccaaagcacattcgtcaaaactatgaaaccatcattgttacagaactactaactgcattacaggctgtattaggatttccacagtttttccaataatgatcttttctattctaggattcaatccaggacactgttacaattagtcaccattagtttcctctatactgtaagagtttctcagaattccttgttttgtgtgaccttgatattgctgtggtctgaatatgttctcccaacattcacatgttgaaacatagttgccagtgtggtggtattaggaggtgagatatttgggaggtgattagatcatgagggtggagccctcatgaatgggattaatgatcttataaaagaggtggtaaggagctgttccccccttttgcccttccaccatgtgaggacacagcaagaaggcaccatttatgaaccaggaggtgagccttcaccagacacagactctgtcatgtcttgatcttggacttcccagcctccagaactgtgaacaacaaatgtcggttgtttataaattacacagtctaaggtattttgttatagcagcacacatggactaagacatattttgtcttagtccctctatcttggtttgtctgatattttctgatgattaaactagagttataggttttggggaagaagatcttagcagtgaggagcacttttcatcatatcatattaggggttcacatgatttatcattatgatgttagccatgatcacctggtaaagacagtgtctgtgaagttttcccactgttagttactccttgtttagttttgaccatgaaatttaaaagaaatgttaatttaaaaatatctggtgttatatttatatcttacttcaattgagtttattttttctgttttcaatttatttctaattcaattccatctttgttcttttctttcgtctagaaaaaaaattaaacatcacatttttcatagaactctcctgcttaaacctggaggctgttcatggttgggataaaagaaaacccatattttgagcatctcaaaaggtatgagggagtctaataaatattttatatacatttcctacttacatttcataagaaatgtaagttaaatattaatacaccactttttttttcaaatgaagaaaccaatttcctgaggccatagggaaagagaggaagtcataaaataggtaggatagaacccagattgtttagccagaggttcaagatcaaccataaacttttcaaatttgattcctggagttctactgcacggacacactcctacagaaatgccagggtctgtgccctgcagcaagaacattccctaagcagcagtgcattgaacattcacccctatagcccccattctccaagttgcttctccaaatgtcacttatcctccaagcctggctgaagcccacctcctccagaaagctcttgttgatcactatgcccttgatatggttttgctgtgtccccacccagatctcatcttgaattgtagttcccataatccccacttgtcatgggagggacctggtgggaggtaattgaatcatgagggtggttatctccatgcttttctcaatgatagtgagtgagtcctcacgagatccgatggttttatacccacttccctttcccacttcccacttccctttgctctgcgcttctccttgctgctgccatgtgaaggatgtgttttcttccccttctaccatgagtgtaagtttcctgaggcatccccagccctgtgcaactgtgagtcaatgaaacctttttcctatataaattacccagtctcggtatgtctttattagtagggtgagaatggactaatacagccctcaacaactgttccttttacactgaacacattgtttcttacattctttggcacttgataatattctgggctcctttgtttcccagtttgttaaacagggtcagtccatgcatgtgccatactgtagaggggatgaactttccagtcctgattgacagtgctgtgctagaaacccccaggagagctctccagcatcctggctggaaccatgcactgcatccttctcaccacatactggctcctctcggcttttacccctcttgtggtcactctcatatagatggctccgtgtcagtccgtgtcagccaactgcaaggttagaggggcagtcctccaggctggcttgcttctcacaatcactccaatttcaagtaggttcacaaaactaccctgttttaataatttgctaaaaggactcacaggagtcactgaaaggtgttatgcatatggttatggttcattacagctaaaggagacagatttaagtcagcccaggtaaaaggcatacagaaaagagtctggaaaagttgcaaatattgagcttccagatgtcctgtccctgtggagtcatgggcagtgttgctttccctgcattgctatgtgacagtatgcatggagtatgtccaacctggaaaggccacctgagaattgagtccagagatttcactggggctctatcacacgggtattgatgattgcccatggggcagatctccatctccagcccctcaggaggtcaagctgatgctgcatgggtcaaagaccctgcccccctacattccactgataagactctggcatgaccagcctcctacctgacatcacattactaaactatgcagtgacccaaggctatcaggcagtcaatcctaccaggcttgacattccaagggctttgggatcacctccctgggcagatttcttgctgaacaagattaaattctttactacatagtgaggtacttctgtctatcttggagacctttgtcctcttttaacttttagttccttttttttttttccttttagagacatagtcttcctctgttgcccaggctagagtgcagtggcatgatcgttgctcactgcatcctccaactcctaggatcaaatgatccttctacattagcctcccatgcagctgggactacaggtgcatgccaccatgcccaggtattctttttgttttttgtagagatgggtcttgctatgttgcttaggctggtcgacttttagttctttatatgccttcttaacataaccagattatgtttgtgtatgcagacaccaagacattgaccgtgatgtttctctcagtgctaggatcacagacaattttttagttctcattatgcttttctactatatccatattttcaacagaaattgtcgcttttataattaggatgggaaaacagattttaatgaggcttttttccctaaaacatattgcttaaccagttttgctcacaatgagcaccagaatttgtccactcagtaagtcacttatataacataatatttagaggatcctatgcttttatttctgagttatgtaaaaaatgacagaaaaatatgttaagaataatttaaactccattcattaattaaactacacatagtttaaactatagggcttgtatattacccctgaacaatataaacatatacacgacacatatatgcaaacaataattagctacttgtgtagatatatggacattttgtgcattgtgttactcaggaacatataagactctgtagccagtgtgataatgaagataaatctcctttctatctggtctaaattccttttctgcccattcaatgctactatttcttgtttgtttgtttttggagatgaaatctcgctctgtcgcccaggctggagtgcagtggtgcgatctcagctcactgcaacctccacctcccaggttcaagtgattctcctgcctcagcctcccaagtagctgggactacaggcgcatgccaccacgcccagctaacttttttgtattttagtagagacggggtttcactgtgttgtcagtcaatctgccagcctcagcctcccaaagtgctaggattacagcatgagccaccacgcccggccactactatttcttgttaagtatgcatcttcagtgggggcaaacattgctccttagggaacaaaatagatttttagggcaaaaaaaaaaaaatcaaactatctttatcagtaaagtatagaaatgcatgcagtacataaacagatatgtaatatatctgtattaaacttttgtggggaggggaaaatgcccaaaacacaggaaagatgttgaaaaacatcagtctgaactatctgggctggaggtggtgaccctgtttgcagaatgttcttagcttctgtctctgcaactgtaaagtgttcattttcagcaaattctttataaatacatttttagaaagagaaggatgctttgctgttacggtgtacaaaatgcctaacattaagtacttcttgaccaagactgaattttatccctctgactatggcccaacctagctaggcacaactctgtttgtcatggactttgcaaccaaaagccaccatagaagggtcctgattccattcttaatggcaggagtcacttcctggtgagttatgtgttttgtactctgttgggtctgctttgaaaagccccctcctttccactgcctggcatcttctacacagcatcacctatgtgagcctaagggcacacatctctcagatgagatgagaatgagaatggattcacctcatcatgtccaatgaagccatgactaaacaatgaaaggcagatgaaaaatttaaagaaaaccacttccataatgggaaattctcatctatccttttactagaagtatcagtgttgtgccttatcccaaataactgctgatgcatgcagcctgagcccaggggaggagttgaagataaggttaaagagagctagatagtgttccatcagtcaaggtcggctatggtttgaatgtgtccctggaagttcaggcattggaaagttaatccctgatgcaacaggtttaagaggagggacctttaagaggtgattaggccatgaaggctctgcccttatgaatggattaatgcccttatcatgggaatgagtttatctcaggagtgggtttcttattaaaaaaaaaaaaaatagttcagctctcttttccactctctctcaccttctctttgctcttctgccttttgccatgtgataacacagtacaaagtctctcaccagatgccagcctctcagtcttgaacttcccagcctccagaattgtgagccaataaattcctcttcattataaattatccaggctgtggtattctgttataacagcacagaaaagactaagacagaaaactggtacttagaagtggggttgcttctttaacaaatacctgagaatttggcagtggctcgggaactaggtaataagtagaggcggaaagaatttggaagagcaggctagaaaaagtatacattgccataaatgtaatgttaagggcaattctgatgaaggctcagaaaaggagagttgtaaaggaagtctggaacttgttagagattacttaagtggtggtgatcacaatgctggtagaaaagagtaaagaggctgggcgtggtggctcatgcctgtaaccccagcactttggaagaccaaggtgggtggtcaggagttccagaccagcttgaccaacatggttgtttgaaatgcttgttccccagtgccataaggaaatagcacttgaacataaatttaatttactcagcaaggccatttttacttcctacagaaagggtacacgctccagcagttttgtcagagtataccgaacaaaggagatagggtcatttataaccttacgcgtccaccctactgctgtgtccggtttccattggctggaatgggacctcatattctgtatttgttccaactggctagcaacttataactttttaaaagaggcaaaggtagaggagaacaaaggaaggcggaagtaacttgtggaatgctgagaaaggtaaaaacaccttcaaagaaggaagaggagcaggctatgacctaatgcttgcttggaccagtataagtatgccaggtcaaatatttaggctaaattgtgggagctaagaacataaagtacactaatttccttatcatggctagccggtatttaagaatgttagcacaggcctttgaataaattttgcttctaagagaagttactatttattcctaattaaatggggaggaaagtctttgaagaggaacctctactttactttttacaatggtgaaacccagtctctactaaaaatacaaaaaattagccaggcatggtggtgggcacctgtaatcacagctactctggaggctgaggcagaaaaatcgcttgaacctgggaagcggaggttgcagtgagctgagatcacgccattgcactccagccaacattgcactcttgggcaacaaaagtgaaatgccatctcaaaaaaaaaaaaaaaaaaaaagagaaaaggtccttctgatgaggtctcagatggaaatgaggaacaacttattggacactgaaggaaaggccatcctttttaccaagtggcaaagaatttggctgaattgtgtccatgtcctaagactttatataaggcagaacttaagactgatgagcaagaaattcagcaaagcattcaggatgctgtgtggtttctcttaattgcatataatacaatgtgagaagaaagaaatgatttaaatgcagactttataattaaaagggaaacagaacttggagatttgaaggattctcagcctggctaggaggtcaagaatgaaagagcattttcaagagaggaaaacaggggtgtggccaagagataaggaaattaacatgataaaacaagccagaggccattcagcagaacaatgggagaatgatcctgaaggtatttcagagattagcaattctgcccctcccatcacaggcccagagtgccaaggtctggggaaaggaaatatgtcaaaagagaggcccatggtgcccatgggaccacagtactcactgccctgcaccacctgaagtgtctgcttcccacattccagtgcagtgctcctcaggtgccccagctgtggctcaagtgagcctaggttcagcttgactccccactgcagaaggcacaagtcatgaaccttggtggtgtccacgtggtgctaattctgcaggcatactgaatgcaagcgctgtgcaggcatggcttccgccacccaaattttaaaggatgtcaatgacaacctggggacccagaaacaggcctgtgacagaggaggagctgctgcagacagtctccaccagggcaatgcctagtggagctttgggagaagagtaaccccctaatcctgagaccccagaactacagagctaccagcatttaatgccagcccagtaagccacaggcgcctgaccccaactcatcagagaaactgtgtgctcttcagtaaaatggtggggattgggcccctagggccttcaaggcccaacttccaccccagggtatctacaaggtggaatatagagtcaagaaatactattctggagccttaagatttgatgttgttcaccctgttgagttttggacctacatttctgtaagtccaataaatttctgttctttacaaatacctatttcttccttttgagagaatgtgtctcctatgcctgtcccaccattgtatttggaaagtagatatcttgtttgatttcagaggctcacaactgagagaaatttgcctcagaagaaatcaagcttcaaatcttacctgtatctgatttagatgagactttggacttttgacttggtgctggaaggagttaagactttggggctattgggatgtaataaaagtattctgcatgtaagaagaacagaaattcaggaggccctgggcagaattctgtggtttgaatgtatccccaaagttcaggtgttggaaatctaattctcaatgtattacaatagtgttaataggcgggacctttaagaggtgattaggccattgagggctctgccctcatgaatggattaatgtcattatcacaggagtgagttccttatataaggccaagttccgcctcctcgttctctctctctttgaggcagggtcttgctctgtaacttactgctcttgctctctctcaccctctttgccctttcactttttgccatgagatgacacagcacgaaggccctcaccagatgctggacccccaatcttggacttcccggcatccagaattgcgagccaatacatttctgttctttataaattattgagactccagtattctgttatagcagcacaaatcagtctatgacagggtccaaccagaaaaccaggaatcacactaggtatttccacagaggacattgaatgtagggaattgattacacaggtgttgacagctacaaaagcaaaaatgaaacatcaggtcatgcagagacagtagctttagaaatcagctgccaccaacagagtatagaacacaggttggccagcttttttttgtgtatgtgatgggtcagacagtaaatattttaggcgttttgcaccatatgatccatggaacagctgctcataccttgccactatggtgggagagcaaccatacacaatatggaaataaatgggcatgggtttgttgcaatgaagcttttttttacaaaaacaagatgtgggctggatctggattccacacatacaaaactcattttaattacactctccttatttttttctaataactatttcctataccaaaatgccacctggcaaactcctattcatccttcaagactcaccaaaagtaggccaggtgtggtgcctcatacctgtaatcccagcactttgggaggacgaggtaggtggattgcttgagcccagtagttcaagcccagcctgggcaacatggtgaaaccccatctctacaaaaaacacaaaaattagccatgcctgtagtcccagctgcttgggagactgaggtgagagtatcacctgagcctgggatgtgaagactgcagtgagccatgataatgacactgcactccagcctaggcaacagagtgagaccctgtctaaaaaaaaataaaaaataaaaaagactacccatgtgttggtgtctcctctcaagcatgaaatccaccaaagcatgcttgcattcatccctgtatttgcaagaaactagcatagtctctagcacacaggagtgctaaacaactgtttcatgaaaagatgaacaaaccaggtaataagcaaatattaaccaaaaaattacccacatgtgttaagcatttacaaggagtaaagaactgtttaatgactctccttaaccttcccagaaactctaggaaggagactgtgattaccatttatattttatgaatgaggcaaatgaggcacagagacttcaagctacatccctaagtttatatagatggtcagtgcatgacccaagaacagaacttgggagtctgagtccagagcctcattcttgcactgctctggaattccatatccgtgcatggtctttacccgtgatagcaacacagcacatgcaagaagtcttctttatgctaagaaagaataaacatacccttcataaataatgcaaaaaacaagttaactgcttctgaagagtggaaacctgctttcaaggagtctgaagtatggtaggaattaataaaacattttaagggtactctacaattcaaatatgaaaaggaaaatcaattagtgatctgaaagaactaacaagtaaaacaatcattttaattttccatgtatggagaatccacaacattcttgagagtgttgagcatacaaaattcattccctgtgctatgtaagtataattttaaccagtggtagaaatgccagtcactgtggttggatcactgttttaatttagcatggtctgcctctgaggttaaaaaaaaagccaaataaaatagcacacactttctcattaagctgcataatttcatcgaatttgtttgattgaaatactacaccccggtgtttgagtctacaaacacatttacacacaataaatttaacaagctcacaattgtaggtattaatcccttatattctgtctagttttcaatcttccttataaaatagaagacaattccagaaagtcccttgtttggatttgattctattatttctacagcatgaactcattttctatataacacagtcactttggaaaggtcttattttgttaaaggggtcccggagcatatgtctaagtaattacagtctcttcaaaatgcaaacttttatgccataaaattcagttagtagaaaagtttcctttatgtgcaaagaaacattttgattttactttttgttttttgagttccatacaatgttaaagtttagatggtttaaaattggttttatatggctgttgatttctttgtaaattctctaaaaactacatttctaacaccattctgtgtgaataaatctagagtttcaaatatatctgataagaaattatttctcacatctctcttaattctaacaataggtgttggtataacaaattaacactagaaagcattttacatgcattatttaatttatttttggtggaacagatgttggtgccatcatcttctctaatcggcagatgaagctctgagactattttaccagagctagtgtcttagcacaggctaagttgcagcatcaaatagatgcaatcaattctggctcagacatagtcagtctcataaacaatgtgatcatgtactgcagggcactgggaaactcagatccacacagtcattcaggtatccaacttgtcatgcttctacgatctttaactcatgtcttcaagggtccctgtgagcatcaccatcacagtcagctggaagaaagagtagcaggggaatctgtggggtacttttataaggaggttctggcttcatttctgcttggcttcttcctgggaggatgtggtcacatgggcacagctaacagaaagggaggctggaaatgggaatgcctgaggagcatttattacctccttcaggtaagaaaaagcctggctctgacatgactgagccaagtcctcagccctctgtctatactgtctgaatgccctgtgggattgagcccttaacctgcagggtcccactctaactccaggcagacagtgtcaggatggaactgaattataggacacctagtgggtattcattggagaattgcttggtttatgggggaaaaacccacatacatctggcatcagaagtgagtaggggctgacataagagaaaaatgaccttcttgtttttcacataaacaaatatgcaggctgtaactgagagatccgcaggggtgtgtttgtgaaacctctaaaggtgagaccaggtggtctgagagcaaacaatggggaccttgatgctagccaccaaatgctgtgctcaaagtgagacgtcagaagtgattttccaccatgccaatccttcggatcatatgcacaatatttgggctattggttttaatccctcatgcccaacattttgcagttgttctaaagaaacatacaggttctaaagccagcactataaaaaactgactctatattcgtgggaggaattgactcttcggtgagtgtttgccaggtttttcattcgtcacattttctaacaagaagaatgcgattgttcaaatcactcagggataagtggcttgcattagcacgcctattcagggactttttctagaagcattctaggaagtaaaatgtgggttgatatctttattataggcaacacggggctttatttacaaacaaagtgctttagacaaggtcttttgcataatacaaatagcaagttattttcaaatggccataatacttgtagtcaaaacctctttcaattgaaatagcatcagcatatgtcttattttctggaaaatgtacaggaaatggtgagaaatgcacattctatatactttcaggagaactaagccattgaagcaaaaggaaaaccaagtagcaattaaaagattcgattccctactttgggaagatacaccaatttgattcaagaaatgggtattgagatgggcacagtggctcatgcctataatcccagtactttgttaggctgaggaagacagtctgcttgagcctgggaggttgagaccagcttgcgcaacatagtgagactctgtctctacaaaaaattttaaaaattagctgggcgtggtggcacacaactatggtcctaactacttgggaggctgaggtgggaggattgcttgagccctagaggttgaggctgcagtgagcagtgattatgccactgcactccagcctgggcgacaaagcaagactatgtctcaaaaaataaataaataagtaaaaaagtcaataaatgaataaataaataaataaaaagtgttgagctcctttgaggtgatgttcatgccgccatggattaaaggtcaaataagatacgatcctttcccccaagaaatttataatctagctttacaataattcatttaggtattctcaactgctatgtcagataataacacctttcctaagttttttccccctcctagtaccatctcaattcgtaagaaccaaggaaacagtgatatctacttaagcccaggcaatcatccaaagaattaaaagctaggtaacattgtcctctgtgtgatatttgcttgattattttaacaaacagaagtcagtaactgtttttgcatgaaatagtcataggccaaggctctcttctttgatttaaggctctttggggtcactgaagtgtcatttggaaaatgacttcccaatgcataatgatcccctaaagcctgtcgtaagtgctcttccatgagagcagcgatttattttcttccaagtattgttttaaaacagtaagcagccgaaggtcagagaggctctggctcatgaaaacaggcttaacgcaactctaagatattttttaaacactggagaggagaaaaatttttcataaatacacatttagagaaatggttcaacagacatggaaaagatacgtttctcttacccccaagcacatggttataacccatgaaacaatatacataaaagaaaagaatagatggctttagaatatcacagagacctggattcaaattccagcctttccttgcattgattatgcccattttgtttgcaaatcaaagtttttgagctcagtcgcctcatataatacaaaactacctgcctcaaagattgtgacaattaaacacgatactgtatacaaatgctaaagagcaaagccagctgcatagtatacactcaataaactgcagtgatgagtgctaagattattgttaaacaggagttatacacaaaataattaggcatacagtatataaaacccaatcctctcttcatttgtgggattatgtcaatcggatatctaatgctatgttacttgtgaaataatcattttcataagcaggaaaaataaaaacctatgcagctataaaaatcaactgtattaaagactttatttaactcttgagttaggaaactggttgtaagatgttgcaaccagttcaaagtcgactccaaacagacacatttatagatcaggaatattgaaacctcagaacataaaactaccttcttccaccgttcgggaaggaaataattgaaactgtaccagacaggacataatttgcatatgaatagacaggaatgattttgcactcagttatctacaacttatgaggatgtaagtttggtcccacagaatcagaatctgataatcctagaggctgtactcttccaggaaatgcatcattgtcctttaaagcacatttttctacaattatcacatatatatattttatatataatataggaaataaaaatatctattttgtgtagatatgtttgcatgtaagtgttgttcaattttgcttgctgttttgtataccacatcatacatattgtctttcacatacacacccacctgtaaaagttaaaattactaaaattgagtgaatcttggttctatgcctgttatatagaaactaagtaaatgatggagtgcatcaaagaattgtacaatttgagcaaaaagattatctcactctgccatttctcttaatcattccaccaacactttatgaacttcttgagttataagcaataaaattccaaatattgaaagttgtgtttgagtcctttagactggatcgccttcatatttttttttttttttttttagagacagggtctcagtctatcacataagctggagtgcagtggtgcaattgtagcttgctgcaaccttgaactcctgggctcaagagatcctcccacttcagcctcctgagtcgttgggactacaggtgtgcaccatcacagctggctaattttttgtattttctgtgaagatagggtcttgctatattgccctggttggtcttgaactcctggcctcaagtgaccctcctgcctcagcctcccaaagtgctgggattacaggtgtgagccactgcacccacccagccaccttcaggcatgttaaggatggtgaggaacagggatgctggttttaacaaggttccctgatggtggcctcatgtgtgctgctcccacagcgtggctgagggtggaagctgattcccggttggaggaaggtaagggaagtgcaccactgccttctctctggactggaaagagacgggctgtgtctagggagggtatgtagggggccgtgtttcaggggttgagggtcattggtaattggtcacgttcctcctttcaggaagcaggagttggtcctgtaggactcctttcccagagagcggctgccacaggaggacagaggcatctgcagccgccctggccttctatctggtgcagacccacgcggttcctcccccatgctgctagacctggctgtctcctgactctggcttcctgcctggccctttcctttccatcctggccctcaccccttagctggtgtccccagcatgtttttcttgcctgaagacatcagaactctgcttcttctttctgttctccttcctcttaggcaggctgcagcctcgtccctgtgaccctctggagctctgagaggatccaagagaatacagctctgccatccaggtctgcgtggcagcagatgctctccctcacccagaagtccatttgagtggccgctttgcacctatgccgtgaaaatgtccccaccttcattaaaaaagaaccagagcaatcactaactcctcactaccccatgttggggctcagaaaacaatgccccaaaatgcaggtctcagcagtggccttggaagcgaacttctctctgtgaccttctcctgccctcctgtctctcagtcccatccttcccagaggcctcagagaaactagaagccctccttcccttggctggtcctagaaaccagaacccttctctccaaagccagccataaaacctaaaaataggactttaactttccctctgcctttctgtgtaaaaactagccataaagaaattccctgacctaccttatttgactgtagatcctaaaacccccattccagagagggtcccacctcacacccagaaggaaagagcgctgctcagagaggccaagaagaatctagacagacaggctggctgggtttccacactcagtccattagctttagatcaggccctttttgtccaaccctgtttctacatgctgtccatgctttgttgaacctaagtataaaaatggatagtttcccctgtatccttgggccttcattctgaagtctcctatttgtacacattaatttgtgtgccttttctcctgttaatctgccttttgtaagtttattttccagtgaaacttcaggggaccccttggcccctacaccccacacacttgcacacaggcacatactcaccaccatccgtgtagtacacagtggatagaaataaggtgggatgcagagacgcaaatgcaaaattctatttctatctgatggatcagtggaagggaaggtttgtgtttaacaaggatgtgtccgtgcctttcccagtttcaggagcaagtgaaccatctgggaatctcatgaatgtgaaaactttggccctgtgggtctggggcaggggggtgtgagtcactgtcttcactgtggctcagagtctgtgatctggagagctgatggtggggccgatcgtctctctgcgggagagtttggtgtcaccatcatctcttaaagctgcagtgtgctggctgagcaggggtctgtgttttagggggttggagtaattagtttccaccttcttcatctttctctccttttttttttctttttcctaggttggagtacagtggcacagtctcggctcactgcaacctccacctccccagttcaaggaattctcctgcctcagcctccccagtagctgggactacaggcacgtgccaccatacccagctaatttttgtatttttagtagagacagggtttcactacgttggccaggctggtctcaaactcctggcctcaaatgatctgcccgcctcggcctcccaaagtgctgggtttacaggcgtgagccaccgcacctggcccttcttcatctcttatgtttccaagggcctaggcttcattgttgccagtatcttctcatagatctagtgttggtcaacgttgttcagtcacttctaggatttactgagaccagcagctccccctgtgcactaactgccttccttatggccatgacatggccccacagacagggggccaagcctctctaaaccatctgtgaaaagaaggcaacagagtgtatgtgagcacggtgggtgtgaatgactcccaaaccaccctaaggctgagatgtcctatgacaaaccttgctacccacatgaactccgctaaaaacatctatctgctcttaaaatagtcatgggccggcatttcattgtccatagactgcttgacagcctggagctccacctccacccaagccataggtgtcctcgtctcttggctgccacaccaaggcagactgtgtctcagggagcaacccaaggggtgaggtgtgaagaaatgttcccacatcaggccctgctgtaggaataaaggtagatctcttatgtttttcagaacagatctctttgcaaaagctaatcatcccttaaacactaataacaactgcaggacacaacctattgtgtctgaaaactgtgaagggttaatcacattttctaaacacaaagtactttcccctaagcacatctgggcccacagggcagtggctcatgcttataatctcagcactttgggaggctgaggcaggaggatcacttgaggctgggatttcgaaaccagcctgagcaacatagaaagatccagtgttgacaagaaattttcttttgaaattagccaggcatggaggtgcacacctgtagtcccagctactagggaagctgaggtgggaggactctttgagcccaggagttcaaggccgcagtgagctatgattgcaccactgcactgcagcttgcatagagcaagacccagtctctttgtaaaattttttggaaggtctgctattatttcaagctaaaagtttatacagtaattgctttgtgttgtgtaacattctagaatatgacatacatacaaaagggtgttttaaataaattattccttttgggcataaaacgtgtggggtttaggggccacggggtcccctgaagtttcactgaaaaataaacttacaaaaggcagataaataggagaaaagacacacaaatcaatgtgtatacacgggaggcttcagaatgaagatccaaagaaatatagcaataataaaataaataagtctgagtttgaattaacacaatttagcaactgagtcattctttgtcaatcatttagccattttgaaaatcgctttgtaaaattttttggaaggtatgctattatttcaagctaaatgtttatacaataattattttgtgttgtgtaacattttagaatgcaatgactatctgcaaagggccttttaaataaattattccttttgggcataaaaaataattttgtggtgctttatgggtagggaggtgagcagtagggggttgccggatggatgatggatttgagcgaacccaagattaggaggatctatctggggtaggacctggcggtacgcagaatagactggactcctatttggccataagcattgagcccctttgcattcatattttgaaacaaaattgccctagagaataattattcatcttttcaaagactagagtaatgattgctctccaggtggctccaaacacagactttcgggatctcatttagatgtattaatattaacttagccagccaagctttttatccataaagttatacaagaggaggaaaagagaggactgcctgtatgatggataaggtcaatagatgtcagaacagctgggtgcagtggctcacacctgtaattccagcactttgggaggctgaggtgggtgggagtttaggagttcaagaccagcctgatagtgaaaccccgtctctactaaaactacaaaaattcactgggcgtggtagcaggtgcctgtaatcccagctactcaggaggctgaggtaggagaatcgcttgaacctgggaggtggaggttgcagtgagctaaggtcacaccactgcactccagcctgggtgatagagcaagactccatctcaaaaacaaaaaacaaaaaaacaaaaaaaaacagatgtcagaatagcttcagcccctgtcttatacctgctacaggtaaaggtcccgctatggacaagaggatgctgcatgttcatgcgccacctgacagatccatttatacagacctgactttttttctgaggcctctgttctgttccattggtctatatatctgtttgataccagtaccatgctgttttggttactgtagccttgtagtatagtttgaagtcaggtagcgtgatgcctccagctttgttctttttgcttaggattatcttggctatatgggctcttttttggttccatatgaaatttaaagtagttttttcttttctcttttttcttttctttttttttttttgagacagagtctcactctgtcacccaggctggagtgcagtggcgcaatctcggctcactgcaagctccgcctcactggttcatgccattctcctgcctcagcctcccaagtagctgggactacaggcgcccaccaccacgcccggctaattttttttttttttgtattttcagtagagacggggtttcaccttgttagcccggatagtcttgatctcctgacttcgtgatctgcccgcctcggcctcccaaagtgctgggattacaggcgtgagccactgcgcctggcctaaagtagttttttctaattctgtgaagaaagtcagtggtagcttgatggggatagcattgaatctataaattacttttggcagtatggccgttttcacgatactgattcttcctatccatgagcatggaatgtttttccatttgtttgtgtcctcttgtttccttgagcaatggtttgtagttctccttgaagaggtccttcacatcccttgtaagttgtattcctaggtattttattctctttgtagcaattgtgaatgggagttcactcatgatttggctctccgtttgtctattattggtgtataggaatgcttgtgatttttgcacgttgattttgtatcctgagactttgctgaagttgcttatcagcttaaggagattttgagctgagatgatggggttttctaaatatacaatcatgtcatctgcaaacagacaattgacctctcttcctatttgaacatcctttatttctttctcttgcctgattgccctggccagaacttccaatatgatgttgaataggagtggtgagagagggcatccttgtcttgtgctggttttcaaagggaatgcttccagcttttgcccattcagtatgatattggctgtgggtttgtcatagatagctcttattattttgacatacgttccatcaatacctagtttattgagagttttaacatgaagaggtgttgaattttattgaaggccttttctgcatctgctgagataatcatgtggtttttgtcattggttctgtttatgtgatggattatgtttattgatttgtgtatgttgcaccagccttgtatcccaggaatgaagccgacttgataatggtggatgagctttttgatgtgctgctggattcagtttgccagtattttattgaggattttcacatcgatgttcatcaggggtattggcctgaaattttcttttttagttgtgtctctgccaggttttggtatcaggatgatgctggcctcataaaatgagttagggaggagtccctctttttctattgtttggaatagtttcagaaggaatggtaccagctcctctttgtacctctggtagaattcagctctgaatctatctggtcctgggctgtttttggttggtaagctattaattactgcctcattttcagaacttgttattggcctattcggggattcgacttcttcctggtttagtcttgggagggtgtatgtgtccaggaatttatccatttcttctagattttctagattatttgcatagaggtatttatagtattctctgatggtagtttgtatttctgtgggatcagtggtgatatcctctttgtaattttttattgtgtctatttgattcttctctcttttcttctttattagtctggctagcagtctatctattttgtttatcttttcaaaaaacaagctcctggattcattgattttttgaagagtttttcatgtctctatctccttcagttctgctttgatcttagttatttcttgtcttctgctagctttggaatttgtttgctcttgcttctctagttcttttcattgtgatgttagggtgtcaattttggatctttcccactttctcctgtgggcatttagtgctataaatttccctcgaaacactgctttagctgtgtcctatagatttttgtatgttgtgtctttgttctcattggttttaaagaacttatttatttctgccttaatttcattatttacccagtagtcatttacaagcaggttgtttagtttccatgtagttgtgcagttttgagtgagtttcttaatcctgagttgtaatttgattgcactgtggtctgagagactgtttgttatgatttccactcttttgcatttgcgaagtgttttacttccaattatgtggtcaattttagaatatgtgcgatgtggtgttgagaagaatgtatattctgttgatttggggtggagagttttgtagatgtctatcaggtctgcttggtccagggctgagttcaagtcctgaatatccttgtttatattctgtcttgttgatctgtctaatattgacagtggggtgttaaagtctcccactattattgtgtgggagtctaagtctttgtaggtctctaagaacttgctttatgaatctgggtgctcctgtattgggtgcatatatatttaggatagttagctcttcttgttgaattgatccctttatcattatgtaatgcccttctttgtcctttttgagctttgttggttcaaagtctgttttatcagagactaggattgcaacccctgctgttttctgctttccatttgcttggtaaatattcctccatctctttattttgagcctatgtgtgtctttgcatgtgagatgggtatgttgaatacagcacactgatgggtcttgactctttatccaatttgccagtctgtgtctttttattgggacatttagcccatttacatataaggttaatattgttatgtgtgaatttgatcctgtcattgtgatgccaggtggttattttgccagttagttgatgtagttgatgcagtttcttcatagtgtcaatggtctttacaatttgctgtttttgcagtggctggtactggtttttcctttccatatttagtgcttccttcaagagctcttgtaaggcaggcctggtggtgacaaaatctctcagcaattgcttgtctgtaaaggattttgtttcttcttcacttatgaagcatagtttgactggatatgaaattctgggttgaaaattcttttctttaagaatgttgaatattggtccccactctcttctggcttgtagtgtttctgcagagagatccactgttagtctgatgggcttccctttgtgggtaacccgacctttctctctggctgcccttaacattttctccttcatttcaaccttggtgaatctgacgattatgtgtcttggggttgctcttctcaaggagtatctttgtggtgttctctgtatttcctgaattttaatgttggcctctcttgctaggttggggaatttctcctggataataacttgaagagtgttttccaacttggttccattttccccgtcattttcaggaacacccatcaaatgtaagttaggtcttttcacatagtcccatatttcttggaggcttgttcattccttttcattcttttttctctaatcttgtcttcacactttatttcattaagttgatcttcaatctctgatatcctttcttctgcttgatcgattcggctattgatatttgtttatgcttcatgaagttctcgtgctgtgtttttcagctccatcaggtcatttatgttcttctctaaactgattattctagttagcaattcctttaaccttttttcaaggttcttagcttccttccattgggttagatcatgttcctttagctcagaggagtttgttattacccactttctgaagcctatttctgtcaattcatcaaactcattctccgtccagtttggttcccttggtggcgaggagttgtgatcctttggagaagaggcattctggtttttggaattttcagcctttttatactggtttttcctcatctttgtggaattatctacctttggtctttgatgttgatgaccttcagatggggtttttgtgtggacatcctttttgttgatgttgatgctattcctttctgcttgttagtttttcttctaacagtcaggcccctctgctgcaggtctcctggagtttgctggaggtccactccagaccctatttgcctgggtatcaccagtggaggctgcagaacagcaaagattgctgcctgttccttcctctggaagcttcatcccagaggggcacccgccagatgccagccagagctctcctgtatgaggtgtctgttgacccctactgggaggtgtctcccagtcaggaggcacgggggtcaaggacccacttgaggaggctgtctgacccttaacagagcttgagcactgtgctgggagatccactgttctcttcagagccagcaggcaggaatgctgaagctgcgcccacagccgccccttcccccaggtgctctgtctcagggagatgggagtttcatatataggcccctgacttgggctgctgcctttctttcagagatgccctgcccagagaagaggaatcttgtgaggcagtctggctgcagcagctttgcagccagtgagctctgccccatctgaacttcccagcagctttgtttacgctgtgaggggaaaaccgcctactcaagcctaagtaatggtggatgcccctctcccaaccaagtttgagtgtcctaggttgacctcagactgctgtgccagcagtgagaatttcaagccagtggatcttaactagctgggctccatgggggtggtatccactgatctaggccacttggctccctggcttcagccctctttccagtggagtgaacagttctgtcttgctggcattccaggagccactggggtatgaaaaaaaatctcctgcagctagcttggtgtctacccaaacggctgcccagttttgtgcttgaaacccagggccctggtggtatagataccggagggaatctcctggtctgcgggttgcaaagaccatgggaaaagcatagaatctgggccagaatgcaccattcctcatggcacagtccctcacagcttcccttggctagaggatggagttccccaacctctcgcacttcctgggtgaggcaacgccccaccctgtttctgctcaccctccatgggctgcacccactgtctaaccagtcccaatgagatgagctgggtacctcaattggaaatgcagaaatcatctgccttttgcgttgatctcactgggagctgcagactggagctgttcctattcagtcatctcgccagccacccaagaggatcttttctgagccaaagtttagcacctctgtcccagctccttccttagagaattctgaatgtgggttccacttaaagaacaacacagcatcaaggggcatctgacctctggtcatttggagacttcaaccccctattactttctatggatgaaaatcaaagcttctgctgtactgttctcagagccaaagcctgaggtgaaactcctctcctctgattttttgagcatggaatataaacaaaataattagccactcaagaggcattgcaaacattaactaacatgtaaccttgcaaaacagggaaggttcttatttgtaaatgccaatcactacacagaaaaactctaaggatttatatcctaggcaacagaaaattgctctgtaaaagaactcttcccacatgttttactaaatttgcaatatttgagcttgcatttaaataaatacagagtttcctacctctctctcaagtgtctcttctgcaaatccatgctcttttctccatgccactccaggaacaggcaggaagaacccaatctcacaacggggaccagagactgccgccttaccttagaggagcagaaaatgtagtatcaaggacaccttcaggatgtagacagtaaggtgactgctggaatcatctaagaggagggagttttaagcaaaactttgctgccctgcaagtctgaaaatgacattgttgacctagaatcaatagtatacaccttcaaggaatttgttctccataataaagaccatttctgtgttgacatgtacctcttctagtttaaagaataatcaatggaataaatttgagacatcagactgtatttttgcacccatggaacaaattattattttcttccattggggtttgaatttgtgactttggacaccttgactattaaaggcaagtgatataaagctgaaatcaacattactaaagtgagagcatcccaggagtcccacctgggacctctgcttaggtctccatgtgttgttgctactcagatacttggacagtgacttggcaaaccaaaagccaggaaaaagaggctctaccagctgaggctaaaatgctgatacctttatctggcctggccataggaagctccgccatggcagagaaagtcagcacttgcatagacaatgcatgagctagctccacagtctgaatctgagcctgtgctctgccattttgtaatatggacttgccaggaagatgttcaagaacatcatgaaacctctttgggttccaggtcttggctacctcctgtccttgcaaaacaagtccttcacatggtccagccctgctagcctggacactggagtctggggccagagtcccaggttatcataaagtggtacatggcactgatgattcctcacacagaagatgccaattaaacaatgccttaaacagtgtgtgtaggatttgaacaaattccatggctatgggttcaagggcagtctagtaacacagaaccttaccataaactctgtttgccttctttagtttttcaacccaattctgcagggcactctgtggtcctttgtagatcatgtatccttggagacgttttgagacattaatgatctctttgatggaatccatgatggtttttgtgctaagtcccatcttcagtaggaaatgccatgtaatgttctttctaaaaaaagagagagagagagagagaacaacttggatttacaatgtaaacactatttgtattcatttttccctgtgctgttaacatttttggaaaaaagtagctatttgtttaattttagtttaatttgtttttaatacatgtgtatcgttgtccagattgtactcaccattaaggaatgagaaaagagcaatagttgactctattaggtcaaaggttgttaaaaatgtttataataacagacagatgacgtaacaaaaaatgaacaacagtcatctcagacttaaacaaaaaagacataataaaataaaagaataactaaaaaatctttcaagaatcaattctgggccatcttagccaatgaatatttttacagataggtatggtcagtgatcgtggtactgagaagttgccaaaagcaaatgggaagactgttggtgcagcagaaagtgtgaattgtattctacaatcttgctttcttgtctcttgataaaactgctccattttccattcccaagtccattcaccagcctcaggacatccagatgtggacctcaaagcaactgctaacactaatagaatccttgcttcttaaaaaacccaagcaacttaaagcagacaccatatacgcagaaatcaaggagcatgtgcagaggataaaacatttttgggcaagaaacaaagactggtggctgagggttgtttctcgattaaaattattttaattaatacctaatgttatataatgctataacacaatgttatcatgcataaaatgtcataatttgttatgtcgcgtaatagtatggtaccctccaaagtgtgtctccttacagctaaattagcatgcattcaacagcacacattaacataccatgattaaagtatttcaaaataaataccatgcaggatctttgtttattttgtttagctcctcgaattataggtggtcactctctgtcccccaccacctcctccacacacatctgaaggacacttagaaagatactctccatgaacatactggtgaaaaaaagcaagtgaaattgccgattatagtgttctagatcctgagcaagtttgttccacaaaatccttgtagataaaaaataaaatgaataagctgctcccactttggaaataaagacaatagcataaaatggtaatgaatggttggtctataggcacaaaaggcatatttaaggaatgggatatgagggggaagatatgtataatagaatcattttattggaaaatgaaacagggcacctagttcctgctaagccttttccagagacggataattgatgctaggtccctgcagaaagccaatagggcattgctgataggcgaggactaagcaaagcttggcttccagtgcttttttttaattaattaaataaatatgtttattatatttaaataaaattttaaagcttgaaaatatcaaaaaggagaaagaattgataaaaattgtcaaagcaattctttaaaaagaggcaaatagtagctctagaattaaaattataataatcagtatgaaattttttttctatagttgaactttggcttctgcttttaaaaaccatattttttctttattttctgacttattttagattgaggggttacatgtgcaggtttgttacttgggtagattgcaaacccagatcatgagcatagtacccgataggtagtttttcttcttttcttttcttttcttttctcatttctcttctcttctcttcttcttctttccttccttccttccttcctttcctttctttcctctcctctcctctcctcccttcctctcccctcccctccctccctcccttcttccttccttcttctcttctcttctcttttcttttcttttctctgagacagggtcttgttctgttatccaggctagagtgcagtggtaaaatcatggctcactgcagccttaacctcctaggctaaagtgatccttctaccttagcctctgcaggagctgagactgcaggcatgtgccaccatacctggctaatgttttaaatattttgtagagaaggggtcttgctctgttgccgagggtggtcttgaactcctgggctcaagagatgctctcgccttagcctcccaaattgctgagattacaggcatgagccaaagtgcctggcctccttttacaatattaacttcctcctttgttgttgaccattagcacctccaatggtagctctgttatcagttttgcagcactcaaggtgcattacagccggccctctgtatccatgggtttcgcatctgaggattcaaccaactatggatgaaaattaaaaaaaaaaaaacaacaagaatgattatgtctgtactgaacacgtatgtccttttattcttgtcattattctgtaaacaagagagtatagcaactatttacatactatttacattgtatgaagtattctaagtaatataaagatgatttaaagtatatgggaggattgtgtagtttatatgcacgtaccacgacattttataacagggacttggacatctgtggattttggtatccacagggttcctggagccaatcccccacagataccaagggaaaactgcactctctcctttgcatggtgctttatttcccactagagaaagcatgaaaaacagatgctgtgtgatactcatctccacatcacccacacaacccagcatgagaccgacaaaagctcaaggctccataaattgatgttgaattggattgaagctgagcttcagcatcaactaaattcaaatcttcacccaaatcctatgtggcgcagaaatattgatggataagatgatgtgatgtctgggaattacttcaaaatgagccagttggtggggggtaattgaaacaagattggtcagcagttgagaactgttgaagctgagttacatcatgttcattgccattattttctctatgttgtacatgtttctgttttttgatttaaaaaggttaggaagaaaccccaatgttttaaaactggcaggtgtttaataaaactttctctatatacttattgctatggcttatctactaatgagtgcttcttaccgtggttattcccatattcttgaaacagccgatatagcatttttagtgccattgttagtataaaaaaaaattaaaagtttcatcagagagtctcgcttgaaaaatgccttctgttccaagaactggaaataattacaaagccattttttaacctataaatcccaaccccgatttaaaagttattttttcattttccctatgttttaagggaaaagtaacctcagccccatcatttcatatattttacttcttgggccattttagaaatcatctattccagtccaaaattttagagatgtgaaaattgaggtcaagaaacatttttgcctttccccaaatcgtagagtcaatcggaaaaaaggcaaggattggacacagaccttcagattaggattttaaaattcgtatattcattttacaagagtttggtgcacatctgctggatgccgggcagaataaacaatgcagccaaagtccaggccttcatggtgactggcaattctgttcctaggattacacccaaaagaaatgaggacttacagacacacacacacacacacacccccaagagaaatgagaacttatggatacacacacacacacacacacacacacacatacacacacgcacatacccaagagaaatgataacttatggagacacacacatacacacacacacacaaatacacacacacaagcatatacccaagagaaattagaacttacggagccacacacacacacacagacacaatgtgtacacaggtgttcatagtgtaactgcctaatgtgttcctcctgccaactgcaaatataaaataaactcacccagacatggcactgcagtaaagaaagagcttaattggcgtgaggtcagccattccagaattattactcaaatcaatatccccgaaggcttggaggttggaggtttttccaagatagtttggtgggcagggactagtgtagggggcatgctattggttggggatgccatcataggggtgtggtaagtggtcctcatgcactgagtccacttctgggtggaggctacaagactggttgagtcacgggtccaggtggagccatctgattgtcagaaatgcaaaaacctgaaaagacatctcaaaaggccaatcttaggttctgccatagtgatgttatctgcaggagtaattggggaagttgcaaatcttgcaacctccagaatgatgcctggtaattatttggaattcaagcccctctcatccttctaacttggtggcttttcatcagttttccaaaaacagtttagtttgggggaagggctattatcttttaaactataagccaaatttgtcccaaagttagcttggcccatgcccaggaatgagcaaaaatggccaacctgtgaggctacaagcgggacagagtcagccatgtcagatttctctcactgtcatacttttgcaaaggcagtattattcataatagccaagaggtggaaacaacacaaatgtccattgcccggcgaaaggataaacaaaatgtggtccatccatacaatggaatatgatccagccacaaaaaagaatgatgttctgatacattggcaacatggtggaaccttgaaaacacgaggttcagtgaaagaagccaggcacaaaaggtcatgtaactgcccaaggggttcgccttgcccgctgcctagacataggcgatttatcaagacagaggaattaccatagagaaagagtaattcacacaaagatggctgtgcgggagaacggagttttattattactcgaatcagtgtccccaagaacttggggatcagagtttttaaggataatttggtgggtagggggacagtgaatcgggagtgttgattggttggcttggggatgaaatcatagggagcaaagccgttctcttctgctgagtcagttcccgggtggggaccacagaactggttggcaggtccagatggggccatccggttgttagaaatgcaaaaacatgaaaaaaaatctcaaaatattggtcttaggctcacaatagtgatgttaccttcaagagtaattggggaagttgcaaattttatgatctctggaataatggctggtaatatttagaactccagcccctttcatcttgacttgttggctggtggtctttcatttgttttacaagaacagtttagcctttcgggaagggctattatttaaactatatattaaattccttcccaaagccagttcagcctacgcccagtaatgaataaggacagtttagaggttatgaggtaagaaaatagaatctggaggcaagaaacagaaggccgattcacacttcagctatgacaggaaatatcctctccatagggcataggccaagtaaataactttgtaactttacttcatcctcttcatttacatagggcgtaccccaagtaaccaatggaattgtctagagggtatttaaattcccaaaaattatgtaacaggaccgttgatcccctatgctcgggcccactcccacactgtggagtgtactttcgttttcaataaatccctttattccttccttgctttgtgtgtgcattttgtccaattttttattcaagacgtcaagaacctggacaccctccactggtgacagttagaaataagatgatgtcagctaggtctgatgtctttcactgtcgtaattttctcagttatgatttttgcaaaggtggtttcagtcacaggttgtatgattccatttatttgaagtgttcagaataggcaaatccatcaagacagaaagacagactattggctgccagagactggagaggggaaggaaaagaaggagctaatgagtatggggtttattttgggcagtgatgaaagtgatctaaaatacactgtgctgatgtttgcccaaacctgtgaatatactaagaggcattcaattgtacacatgaaatgggcgaattgggtggtatgtgaatgatatctcaatatagctgttctattttttaaggaaaaatatagagtgccataagtgctatacaaaaaaattaaatggggaggagatcagggagtggaggtgggttaagttttagttcaatgtcttcccaaaattccctaaattcctataaattagtaaatcataaaagattccttgaatcaggagtcaagtaatgccacacccagagccagccaccaccctcctggtacattaattagattgtactacatcagtacagatttaaaaaccattcaaatgctttgtgactccaggaaattcagggtgtaagcaggagaatactgcctccgaatccatggaaaatcctgccttcagaacaggaattttatctaaggattcacgcaatttgggtttcacactatttgtacactcaggggctgtgctttgcaaatataatgccagaaacaccagaaccaaaattaggtgattcaataccaactggcccactgaaagcatagagtcaagaaatcagtgcctgagccattatggggctggtacttttaaaaatgaatggacttgatatttttgcaagttttattatggaaaagtgcttttgggttggtcaaaagccttcagaaatcgttctacagcccggctgttcccacaccaaactaagggtcaggctgcttattctagaggaccaatgaatgagatgcagatgaactgggaaagaagggactttttacttctgcagccagttacagggagaaggcctagaaattatcaccagaccaactcaaaattacaaagttttccagagcttctataccttctaagctatacatctatgtgtaaagtgtgcattcatctaaagatataagcaattaacttcatttaatctataactaagatttgagtcctgaagaccttcctctggagcctcagtaagtttacttaatctaggtgggtccaagtgctggggtgattgcccttattttgtctcctgctaactcatggaggtttggggagttcctttagtccccaataaagcttgtttgtggaaacttagggagtttcttcagacccctaataaagctgtttaatcctaaataggtcctgctaagaattactttgttaaaatcttcatgctttaaggcccaggaaaggcctgggcagaactcttggtgggcttttgttacattccggcctttgtatgagggcaccggctctatcagcttttaatatttaacttcaccactcggtcagtgctgaaacagttgttgtggaagcctgtgttagtgagacctggccttccacacggcccatctggaggcagcctcttgccccgtaataattctcagtgcccaccttcctggaggggtgactcagtggttctgtcagaggcatgtgaaccagagcaactccatcttgaataggatctgggtaaaataaggctgaaacctactgggctgcattccctgacggttaaggcattctaagtcacagggtgagataggaggtcggcacaatatacaggtcacaaagaccttgctgatgcaacaggttgcagtaaagaagccagccaaatcccaccaaaaccaagatggtgaagagagtgacctctggtcgtcttcactgctacactcccaccagcgccatgacagtttataaatgccatggcaacgttaggaagttatgctatacggtctaaaaaggggaggcatgaataatccaccccttgtttagcatatcatcaagaaataaccataaaaatgggcaaccagcagccctcggggctgacctgtcgatgatcagagtagccattcttttattcctctcctttcttaataaactcactttcaatttactctgcagatttgctctgaattatttcttatgcgagatccaagagccctcttttggggtctggatccggacccctttcctgtaacagccctacaaaccgccctcagcgggacctttcacgttcactgagaactgcatttggagtgcacctaccacctccaaccccacacagcccaggggctcggcgcaggctcttcccagttatgctttcattacagtgaaaaaccacagcagatgacaatcgccccctccggccacagaagtctgaaagaggcacccctgtattttaatagaaatgtaataaattgtaccccgaagaggagacacctttgaaagcattctaaaggcttaacttgactgcaaagtggaaaactcaagaagttgcccagggctcgggtctgacatgaacctttgatttttgctatttctgtcattgtgtttgactctgaatttagtgtctgctctctccccggcttccagggaaacttgcatcctggagggccatcagccccaggcatccatgcaatccactgctcagaggtgataaaaaggagcaagtatgaaatatagttttagaggtgtcagaagaaaataaattgggttcacgttgcgttttcttctgcatccgaatatccccaaagcagaatttcattgccaatctcagacctgttaagttgcttcatgcaaattaaaaacgtttgcatgcaaccctccctccagctgcctgccaagacccaccccatttcatccaccatccagccgaaataaaagtaaaggctaagaagcctgctccagagcagtcacctctgatgtgggaaacctgaaaaactggaaatcaccagccaagaagaattatacgtgtgagcttcacgtaggtgggatgtgatggatgtggacagagcagcagagagaaagcccagggagcatatgctaaaaaacctgggaagaaaaatgcaaaatccagcagccttagaggtggcctgaggaaagagtttaggttagaaatatctgtgccctaagaataatgggcatctatgttcctccaagaacatcaggataaccaaggagcattaaacaccaagttaagaaggaaacacgataaggaaaccagcttaagctcaaggaaattagagactcgggggttcattttgcagtaactgctgagtgtgtgaatggaaatgaatttcttaacatcactgagctttcgttgtaaaggagaggcagtaatacctaccttgcagggttactggattgttatatatgtgacagcaactaagacagactgcttaatagcatacattgtatatcgtgacccacagaaaatgttctaaatgggggtcggcaaactatgctcatgggccaaatgtggcccactgctcatgtttataaatacagttttattaaaacacagtcacgcccattcatgacatactgtccacggctgttttcctgctgcagctgcagaattgagccattgagacagataccatatggcccaaaaagtggaatatatttactacctggcttttacagaaaatgtttgttgatccctggtctagaacatcagttaatcaccaatcacttgggaatagcaataagcttccatctgttgaccatctgttatgtctggtcatatgtgatttcatttaatcttataggtattacgatctccattctaattttgagaaaactgaggttctcaggtgttattttcccaaagtcataccattgaaaacaccaacattctgatttcaaagtcaattctacactgattctcagtggcatttttatgaaaaagtaaggatacaatgcaggaagaggggaaaaatgtcctagggcaacctcgtgggtctgcatagtgttctttctttttcatctgccatctgcagtggaaccaccacgaaaaggcagattttcaaagacaaaactgtgaacctgatttctcgaaacccagcgaggtcaggctcctccaacctcatctcttttggtgctcccactcttccctcagctggctggctttggctctctcctatatccccagcccctaaacatgcatattcctggaccaaaccaatggtcaggctgcttattctcgtggcccaataatgagatggagatgaactgggagagaagagagttttcatttctgtaaccgggtgcagggagaagacctagaaattatcactagaccaactcaaaattacaaacttttccagagcttatatgccttctaagctatatgtctacgcataagtgtgtattcatctaaagctttaagtgattaacttcttctaatccataactaaggtctgagtcctggaggccttcctctggagcctcagtaaattgacttaatctaaatgggtccaggtgctggggtaattacccttatcttatctcctgctaaagaatggaggtttggggagtttcttcagacccccaataaacttgtttgtggaggcctggtgagtttcttcagacccccaataaaactgtttaatcctaaaagggtcctgttaagatttccttcattatcttgtcatgcttcaaggcccaggagaggcctgggcaaaactcttggtggacttttgttacattccagcctttgtataaggacactggctctatcagcttttaatatttaacttcaccactcagtcagtgctgaaacagttgttacggaggcctgcctgttcagctgttagtgagacctagcctgccacatgcatacccaagtattccctagttaactcttagttaacactttcaaaatatcaactggaatgtcgcttcttcaaatgaaccatctctcccccaagactgagtcaaatccccttataagatacatatacatgcatatatatttgcatgtataaatgtatacatattcatgtatctgtatccttcactgcacttagaagagttgtaaattcacatttatttgtgtaattatttaactaaccactgagataagaacccatctagttttgatggtccttgtattcctagcaaatgttacagcacctgcctcagagtgggaatgtaataaatattttttggatttttaaaaatgcagatctttgtaaaaatggagaagaccatcattctcaacattgaaccattggatacaatagaaaatgtaaaggccaagacccaggataaggaaggaatttctcctgaccagcaaagactgatcttcgctgtcaagcaactggaagatggacgtactttgtctgactacaacattcaagaggagtccactcttcatcatgtgttgagatttcatggtggtgctaagaaaatgaagaagtcttatgccattgccaaaaagaatatgcattacagaaagaagattaagctggctgtcctgaaaaactccaaggtgcatgacaatggcaaaattggttgccttcatgggaagtgccttttagatgaatgtggtgcaggaggttttatggccagccactttgacaggcattattgtggcaaatgttgtcttattgcttcaacaaaccagacaagtaatcgtgtatgagttaataagagacatgaactaagaaaataaaagtcataagttgaaatagagattgttcagccagttgacataaggtagagcactgacaaagagaagctgctcacctttagtggtggttatgttcggagctagcagaaaagcctcctgacttcctccaggactcagggaaggcaggggaaggaggactttggtgtcttagtcccttctcacctctttggcattacttccttccctcccaacgtcgcaccttataatctactaactccaaaccaacaggaactctcctcccacgccctacattcaaacaccctaggtttacatgtgcaggcgcgcatgcacacacacacacacacacacaaaggctgttatctcccaacttcctgagaaatgcttatgcaggattctaaatcctgagccccttccaggggttgccttgagcctttgcttcttcaagagcccctccctaacccgaatgcctcgatactgagctctgggctgtctgtgtgtactgctgtttgccatgtaaaatccctccattgaacacatctgtctacttgcccatctatcccaaaggtctaggggtacatcaatatcaagggccatgtcttttcttgggattcccagggtagcctctaattaagaaaaattcacttatttgaaccaacttccccaaatagaaagttctaaaaaacgaggaatcaacagaaaattaagttccagtttcctccttcacctctcctgccccaaaagtactctttttggctggactcttcttccattttccccttctaactgcctccaatgtctccagcagaatgagagagaagctgtccaggctgcagagaggagtggtagcaactggatctcgcctcagaaggtggggacagggtaggcagagggagaatgcatctcgctggaaatgccaatgccgcatgggccgggaactgcagagagagcttcccttattgaaggaacgaagtcagaaaactgggaattggtaccttccaagagagggagagccagcaggttggagagagggtgtgtgaggtggtgtcaggctagtggacactgcatataaagaatgtcagaatataaatgtttatttgttacagagtcctggtttcgggtgactccagatggaaagtgcctactggcgggtgttttgcctctctgcacgggcacaagagtgctgatagttgcttctgtcacttgtttcattcccacgggagcatgcttgcacttcccaggttaggcttttggtcaggtttgggcttgtggaattgtttcaaatttttgacattatggttttgcaatacctagcttgccaggacgcttgcccccaagcaagttcttctctatctgccccacacagatgaggttgtgtgcatttttaccattactctccagcggaccattcaaatacaaacatactatatttgtatctcaatcacttgcacttgagtctcttttaagatttttttttcttgcccactcagcaagtaaatgccttgtttgtgatcaccaaagtcaagtgtttagacaacctgctcaggcccattattttccccatttatttgatgtctttaaaaaaattttttttaaatattgggtatagtggctcacacctgaaatccagcactttgggagactgagacaagatgattgcttgagcccaggagttcaaaaccagcctgggcaacagagtgagaccctgtctctataaaaaatttaaaaattagctgggcatggtggcatgtgcctatagttccagcttcttgggaggctgaggcaggaggatcacttgagtccaggaggttgaggctactgtgagctatgattgcaccactgaactccagctgagtgagagagtaagaccttgtctcaaaaaaaaaaaaaataaaataaaattttaaaaaataaccacttaagataacctgctaagtcccattattttccccatttgtttgataacttaaagagaatcatttagaatagaaaaaagtaagtgacaaaaaaagaaaaataaataaaaaggaaaaaagaaagaaaaatttttaaagaaaaacaggaaaaaaaagaaaatttaaaaagtgagtgacaaagtgaaaatatttggcttatcttctgagaggggaggaatttgagactgtaacaaacataaagaaaggacatctatgcgtaagaaaaaattatataattaattacccagatgcatgaggtctaaatgttcctgagtttgcctaaatgtcatagttatgctaatgacatgtattctattttatttttacttagagacagaactgaagtttgggtggctgccaacaagttgttgagcttgaaagcgatgctataaatttccaaggacatgattgcagttgcatcggatgtacttgtctactcagctgatgttcaagttcaaaatagagctacattctgaacatgggcaatgttcttaaaggagaattttcagggtgtctttttttttttttttttttttgagacggagtctcgctctgtcgcccaggctggagtgcagtggcgcaatctcggctcactgcaagctccgcttcccgggttcacgccattctcctgcctcagcctcccgagtagctgggactacaggcgcccgccaccgtgcccggctaattttttgtatttttagtagagacggggtttcaccttgttagccaggatggtctccatctcctgacctcatgatccacccgcctcggcctcccaaagtgctgggattacaggcgtgaaccaccgcgcccggcccagggtgtcttaatattgtttgacctcaggcagaatgagccaaaggcagtggggtgtaggaagaacgtgagacttgatctctgggaaatgagctccaccactcaacagcgtaagaacttgttgtgatggttaatattgagtgtcaacttgattgaattgaaggatgcaaagtactgttcctgggtgtgtctgtgagggtgttgccaaggagattaacatttgagtcagtgaactgggagaggcagacctactacccttaatctgggtaggcaccattcaatcagctgccaatgcagctaggataaaagcaggtagaggaacatggaaaaactagactggatgagtcttctggcctccatctttctcccatgctgaatgcttcctgcccttgaacatcagactccaagttcttcagtttttgaactcttggacctataccagtggtttgtcaggggctctggggcatttggccacagactgaaggctgcactatcaccagcttccctacttttgaggttttgggactcagactggcttccttcctccttggcttgtagacagcctattgtgggacctcaccttgtgatcatgtgagtcaatactccttaataaactcccctttatatatacctctatcctattagtcctgtccctctacagaaccctgagtaatacacctgggcatgtcccttagcaccttggatgaatccttaggtctgtgaaataagggagctggagttgatggtctctagaatgatttcttttcccaaagttccctggtattattacttacagaaagataacaaaatgtaacgaaatgtaacaaaaataggaagcaaattataaccaaggctgagcctgttcatttccactgaggtatctctggggtttgtgaaaatataggagagggtattaaagaaagagtgccatgaaaactgaaacagaggaagtccagagtcctctcagactctgggaaagccacacacattatgtgacacacacttctttatattcagatagaggcaatctgacatgcacttcatacatggatttgataacaggccattttgaaaatggggaaaaatagccacatagaattatatacaatgatgttaactgtactaatattgttaatcttataatattgttaaaaataaatatgttcaaatttatgttgctgcttccactccaaggactaccacatttttgtatcaaaggagcagagcataacaccatttctcttactgagtcaattggactgagctcaccccacatgtgctagaggaatcaatcttcatggagtgggatgtccagtagggcacgtggatctaagggagaatattgaaagccaatacaaaatccatatgaaattgtatgacaattaagacagaacaaattggaatattagatttcttttacatttcagaattttaactgctattgagtccatcagaaataaacctacaaaaataatgtcttcatattgatgagctttgttacagatatctcctgtttccagaccaaagcaatggaaaacaatgaagaaaaggaaaaaattaggccaggcacagtggcccatgtcaataaactcagcgctttgggaggctgaggtgggaggaccacttgaggccaggtgcttgacaccagcctgggcaacactgtgagaccctgtctcctcataaaacagaaaaaatagctgggcatagtggcatgcatctgtagtcgcagctacttgggaggctgaggtgggaggattgcttaaacccaggtgttggaggctatatgattgcactactgcattccagcctgggtgacaaagcaagatcctgttccaaaataaaataaaataaaagtctgtctttgatgaggtgaagaaccatagaaatactaaagcacaatctatgaagaaagactgtcaagccaaataaaagttgaacagtgtgaaggggaggtactaagacagggagaacacctctgatatgttctccagaattggtggcaaaacccctaaggcaaaactttgcttgaaaagacaaagtggggattcaaagtaagaatgcagaaaagaatgagggaaagcaggaatgatcatggaaactttcagacatagtgagatgtaggctacaaacatggtgtgacagaagagatatgacaaacggcagctgcttggcaaggctggtttactgagcagaaaagagttaattttttcaccctatcgaaaaaacataatggagtttcttttgaggcagagaaactccttcctaactgtgagctatgtcatgtcataacagagaactgatggggggaaaagtgctaagagatgacaaaataatggcataggggatccaaggtatgtataattggtactctcataaaaagaagggaaagtactataggaaaaaagtcaaaatatggaaaaaaagaagatgtgacaagaaatgacaggaagggcacaaaactgtgaaggaatctgaaatctttgcatagacttatgagaatattatgaggaatctcagtttcaaagaggcatggctttcttttttttttaaagctcaaaataataaagaagtcatttatttacatgtggaacaagaacagagaatggacatgcaattctcaaaactgaaaactagacagtacaatggcaaatcatcctaatgaatacaagaaggctgacatttcaacagaaattatcatgaccacaaaaaaaccctgtaaatgaacctaggtatgacaagtacatgcaccaaataggaaaggtagagtgcacagtcaaccaaaatatcgaaagcctttgcagaaaagtgtagaaaaagtatcaggaagtcttaatcccagaatgaggtaagggatctaaaaatatgaaaggaggctgggcatggtggctcacacctgtaatttcagcactttcagagaccaagacatgaagattgcttgagtccaggagttcgagaccagcctgggcaacatggcaaaaccccgtctctaaaaattatacaaaaattagccagttgtggtggtgcatgcctgtagttccagctacctgggaggctgaggtgggagaatcacttgagtctgggaggtggaggttgcagtgagctgagatcatgccagtgcactccagcctgggtgacagaacaagactgtgtcacaaaaacaataaaaaataaaaataaaaatatgaaaggcatcaaaaggggctttgagttaatattatagctagaagaacaaggagaaaaacctcatcttgggtcttatagcatcagccaaatatgagaggcgctcacaggtccttctctgaagattattctcaagccctttcttcctcagggccagagagttaacagttcttattggttctttctagctaccactgtcttttccatcttttgatgttctctttttttctttcccacaaagccaagctactaacagtcattcctgattcccaatacaatactcctgtgtaaaggtatacactgctgcttagttatttgagggcttaggtgctaatccatatgggcaaatacatacactgtaatgaacttgggatataaaacattttccccgtccaaaggcatctaactacctctcctctgccctggggcacttcacagctccccttttgcacacatttgtgtttctttaggtaaagctgacactgtttttagttattttgtgcaatatggagagaggagcatgagaaacaaatagtggatttcactgagtttttcctcccaaaaggccattaatcaaagggtagaacaataggtgggaactactgtgctcaggtaactgcttgtctgagaatttgggcatgtgtgggaatcattccaacttccaacacatagcttgtcaggtcccctgtgcactaccaagatctctttgggtccttgcttctaaaattatggaatggctgtggtcttttcacaacctacccaaattcattggaataaaaaaatagtttcaatttccattttttcctcatatatatatacacatatatatgtatatatatacatttttatacatacatatgtatatatatatatgtgtgtgtatatatatatgtgtgtgtgtatatatatatacattttttttttttttgagatgcagtttcactcttgctgcccaggctggagtggagtgccatggggtgatctcggctcactgcaacctcaaacctcctgggttcaagtgattctcctgcctcagcctcccaagtaggtgggattacaggtactcaccaccacacccagctaattttttgtatttttagtagagacagggtttcaccttgttggccaggctggtcttgaactcttgacctcaagtgatccacccgccttaacctcctaaactgctgggattacaggcatgagccaccgcacaaggcccctcccataattcttttacttaatggtttgacatcctctgcctttgctggtttggaagtactaactgaaaaaaaataaataaataaacaaaatgcaacaattattagcagaaaatcccacaatgggataagtttaacaacttgttttgagggcagggctgggttgtgtatttgtttgtaactataattctatatattctatagaatacttgtcatatatgctagctttggctagccatattaatcataaaatgaaaatagctatcaataatcatagtccttcagaatatcaaggtgtcctatagggagtactgcaaattctaggtgttccatcacctacataatggtaaaaaccatttactagttcttctacagcaagacagaatatctcctggacttttattttcctgcttcttctctttcagaatagcctgcagagaggtgattgtgaagttaaaatatagaagaacattaaaatcctaaaactatgaggaagttacaagagaatcaagttgtgaaagaaatattttccagcctgaataagctgcttcttaaatttgtgaaaagcttacaatttttctggacttatcattgataatgttgagaaatcatttataaaatagtgcagatttccatctagaaaactgaaaattaaaatgaacaaatgttctgatttttcaaagattagaagaacatgaattgcacaaatgtgagagcaagaagatggggtgttgggcagtgtcaaatgcgtgccacagagaagtcaggcagagggagttgagagaggacgctgagtttggggattagaagttacgtgagattgctgagaaagcaatttagctttgagaaaacatgagcttaatgtcatccctgaggatactttgaaaatggattattttaaggatcattggtgagtacttaagtcagaaagtggaggtcatgttgagtcagaatgggctcattttgagtaagtcatgccagactaaactcatttcactggactgataagtacaagaaatgtagtagactagaaggattgtatctcctttggagctaaaataattgacaagctttttcatcatagtcttgtggacctggtgaggatacaattaagatcagcttacaagtattgacactgaggattaagagatggatgtccacctggaggggtgtttctcagggtccctctctggctgtctcctgttggccattttagctaatgatttggatgagtaaaaggatggtgtgggaatcagagctgccaatttggggaagctgggatgacgagataataatgccttgtatgacacaattgagaccaaaagaaaccaggaatggaaaagagaaatgaagaaacaagcttcaaaggagacttgctggactagatcaatggactgaagctaacaagatgaagactgatagcagcaaagtactactcttgttcaaatataccagctacacaagtaccgagtaggggagacagggatgaggggctacacaagaaaaataatcagggcaattgactgtcagggcaatatgagactttagtctttctccagccgaaaaaaaaaacctcacaaaaaacaacctcatataacttccaacaattgcagtataaatgtagtgttgagcataatgaaagtaacctcaatttgtacctcactttgagtgatggttttcattagaataatcgagagcacatgctaattactaaaaagtatctttgatatttatgcaaattcacaattaagaataaaatttgattaaccatgtaactttggggttggaaaaatgaatttattcagtgtgagtggtattatagtctctgatgaacagatcacccacagagctgtggagttttgtcctgagtgcccaacaatatgttttcagagaaagatgactactacggcaaagaaccaaaatgcagacagatgaataagtaggagaaagggagaggagggaaaagaggctgggaactggtggggaaagggtggggaatgaggatcaaagactaagcacggtagagggacacgctctgtatttgaactttttttgatgatccatatagctgggtgacttttctctatgtctgtgtccagacttctgggtacagggagtgataagcgccatgcaatcgccatagtacctgatctcaggtaacctccctcatcatacactgtgctttgtaacatttcacacagcaataactagaccaccatgtgagtacttctctttcccctctaaacactaagataagtccatgggagcagggcgactgtgttggtcactttcatcactatgtctttaacgccacctatatagccatacgtaagcacatatgaaacactctataaaaaaagtttgaatttttgaacattgctcagcgatttaatagattccctacatggtggaaatttaaaaataggaaatataagaagaagaaacacctcaagttagtatcacaacattgcagcctgagaagaaaaaatacattctttcaatacaatgaggtacataaaatagtaatgaaaattgaccacttattagttcataaagcaggttttcaataaatttcatcaggttggtgtatagacgtcacattttttcccatatgcactaggttagaaatcaagaaagcagagatgactattttaagtgaaattttaaaacacacattttaaaaactcaaggggctgcacttcaaatagggtgcagtatatactgctggggtgatgggtacaccaaaatctcacaaagcaccactaaggagcttacttgtgtaaccaaacaccacctgttctccaatagcctatgaaaataaaaaataataataataatttaaaaattaaaaaaaaaaccctcaacggtcaaaaaagaaactgtaatggaaactgaaaatatgtgtaaacaataatagtattaaatattttttaaaaaagagaataccattagggcagtacctagtgggaaatttaaagccttgaatgtagagattcgaggtgaaaatagggcaggaatcaagacattgtgtatccaccaaagggagctagggaaggaacaacggattaaacctctgtaaagtagaaagaacaaagtactaagactgaaaaacgtctagcaagactgaatagaagcgagataaaaagagagcgagagcaagagagagaggaaaagagagagagagagagagaaacaaacacacactactggaatttgtaaaacccacaaatgtaaatactatagagataaaaatgatagccttgacagctctacaccaacaaacttaaacttaaatgttcaaaatcctagaaaaatataactgactcaagaagaaacagataaactaaaaaaacaaacgaacaaacaaacataaactgagtcagtggtttaaaaatctttccaccaaagaaaaatctaggcccagttggtttaatatgttaattctcacaaacaatccacaaataataccaaaccaatgtaactcctccaaggagtgaaaaaataagaaatttaccccaattcattttatgagactagttaactttagtaatcaaattatccaaggaaagacatttttattaaatataggaacaaatatgaatagaaacaaatacatttataaaatataaataaaaaatatataaatagaaacaaatataaataaaatagaaaaaaaattacaaagaccaactcattaatcaccacagaaaaacctataatgatcattttaacagatgaagaaaaagcatttgataaggtcactatttattcctgattttttttacagattcttagcaattaggaatagaaagtaactcccttactctgataaataatacctagtttaagaaacataattgaaacatcatatttaattgtgaaaaggtaaaagttttcctatttaacattgttagtgagattatattatattacatataatataatattaaataattgtatcaagcttcatcttgggggaaaattctagctcaataaaataagaaaacaataaagtatataaatattacaaagaaaaaagctgttatcattgcttgcttattcattgtctacctaaaaaaaccctcaaacctcaaagaatatttagatacattattagaattaatgagggtttttgatgattgctggatacaacataaatattcatatcacttgtatatcttaatactggcaaaaattagaacatatattttttagaaaatagctttcatgaaagccacaaaatataaagaattagtactgaatagaataaaatttgttcaaaaacactttattgaaaaattatagaaatactgaaaaataacaaagtaaaaataagtgacaagttatagcataatcttgaataggaagacacaacattttcaagaagtcactactcctctattcaatctgtagatagatttaatttcagtcaaatgccaagaagatttttagggaaaatttgattctaaaatatatatgaaagaacaaagagccataaataaccaagatacttctgagaaaaagaagaagatggaaaaacttattctattcagaattaatataaaattttggtggttaaacccatgtagaattaggactggaacagacatactagacaattcaaaagataaagagccatttgggtcatgaacagacgcattgaccagtgaaaagaatcgagatcagagaaacagacttaagtcccttgaattttcatgtataacggaaagagattttctgatgtgtgggaaaatacaaaataaatggtactaggacaaggggttatttatacatacggaaaaaaggagagctcaaactacatctcacactctacacaaaaataaaatccagatgattgaaaaatttaaatgccaaagtcaaatgcttaacacttcacaagacaatttaggggacaatctcatgtcctatggataggaaagcacttcttaaatcaaataaaataataatcaatagccataaataaaaagagacacaaacttgactatattcaacaaacttcagtttgtcaaaaaatgccataaagagaaaaaattaagccataaataaaagatgatatttgcaacacgtaagtcaccatggctcagtctctagactacatttaaaacgtctagaaatcaatataaaaaagataaaccacccaacagaaaaaaataaagaaaatacctgaatgaagactttgtaaaagaggaaacacaaaatcatatggaaagatgttcaatctcattaataatcaggaaaatgagacatagatattgttttatactcatcagattggcagaaacttaaaaatctagaaatatcagctgaggtgcccatatcagctaccaaggtaaatgtggaggcaaaattgcatatggtgggttttcaatgggaaatgctgacaatgtactggaggactctaaaacttgcttcaagactggcaaatgttttcaccgactttgagaatattaaaactagatcaaatgtgatactggtgaggagatttctttggagaaatctgttgccatgctgtgagtaacccaaccttttggaggggagagtgggttattactggtcccttgcctaatgggtgagcttcaaggagatcctcacaatgctttgaaatgatccttgcagttggaagacatggagaaggggtgtctgacctatttctgggaaagttaaattggattgtggactaggttctgactcacctggggagtgtagtgtgcagaagagaggcagcgccaggaggggctgcataatgggatcaatccacatttcctaaattagatggaactcatcagagggaagccggagtggaattcctttgagttcccggacattctgggaacaggacagaactatacgcacccagtggaatacagacactctccctcatcccctgtgaaggggctcagctgaaacccaccaaggagccccggaaagcaccgagaaaaaggaggcaacctctgccctctgcaagctacctagggacacagagggacctctctgtccacatattcaggtagggaggactgaactgaaactgaaaatacgtagaagacgtaatgtcaagccagttttgaagtattggctattatgtgggactggatattccaattcctgagacgaaacagttttatgaccaaaagtggctggaggatagtttagttttttgagtgtgacgatctctccaagtgtttgaaatgggtggtcggagaggataataaagttgtatgcttggtcaacattctgactctatattgttttcatagagggtaaaactataaagaaaagccagagaatgataccaaaaaaattggggagatcatttatggtgggcagtagagtgagtaggatggaattcaggaggcggcacaccggggctgtagatgtgctgatgacattctgtgactcaaggtgttgggtgcggtggccaatgtattgtgagtcctgattccctgatcatttttgcaagtattcaatagttagtataaaacaacacttaaagggaaaccataaaaagctagaagacaatatatgtgcctatttgatcaaaaaatccttttaatttttccaccctattttcatgtcccttgatctaaaatatactttttatgccattagcagtccaggttcctgctgcttttagacttttgaaaaagaaaaggaaggaatttttttctcttcatgccattcttttgtacatctctgccccaggcaatgagcacatacctgctgagttttttgaaagggggacagcgttgtggttgggaaagagagtatttatggggaggctgaaaacttcagtaaaatttcaaaaatatccacaattttgatagtgatgacctccagatgggcaaattactggtgacatttttttaatgatgtcctattggttccatggttttatttttattttttgagatagggtctcactctgttgcctaggctggagtgcagtggcacaatctcagctcattgcaacctgtgcctccaggctcaagcagtcctctcaccttgctctcctgagtagctgggactacaggcacacaccaccacgcacgcttaatttttgtattttttgtagagatggggttttaccatgttgttgaggctggttttgaactcctggactcaagtgatccacccgccttggcttcccaaagtgcagggattacaggtgtgagccactgctcctgccggtttcatgctttttataataagaatgaacatcttatgtaataataaataaataaacagaaattatttgctttggatgtagcaaatgtagatttagattgtccagagtcaggagctaagcctcatttttttttgttttagctcagtgtagagtgcattgaaggtgtcctaaaaataattccatatagtaagccaactttaaaccctgctcacagccagatctgccaagtatgagccaggtaaaattaccaaaaagggtggttctgactgacttcttaacaataacgtggcttacaaagactgatatgaaatagttgatccaacccaaacactttgctcatttcccgaaattttccatacaaacatatacaatgtaccacaacataaagatcataatgaaaggtttgccttttattcctttaaatgaccatatgtttagatctgatgtactgacagcgataattctccattaagcagaaacctaataaaatttgaaaaatagtgattttatatttagatgatactcagatcttctgctacatatgtggaaaatggaattattgctagaaacactgtttaaagattagggtatgaaaggagtattaggaagtcaggaggttctttctttaggaagcagcttatctggattcattcaaagagctttaggccagtttgaggtctttctgcaaaatgtaaattgctatatgagaaaccatatatagtccaatgatgaaagaatgcaaagccttagaagcacaggagacaattccagtatcttccctaaagttctgacaaaaaggaaaataactatcaaattattcgactcgaatgcttattatgtacgtataagtcagtcggcagatgaagagaggagggaaatatgacttctacccctagggaactcacagtcttgtgggggccactaggggtggtggtgtgacctgcctggagcagcgctaagtatagacttgtgagtcaagggctatcaaaacctaagtaaactgatggccattcagagaaggtagagttccattccacagtttccaagaagggctgtttcatggaggaggtcatattgaactagacctttaaaagttggtataatttaaaagcaaggatatggaagcaggaagaatgaaagtgagcagaggtacaggagtgaggcaagggtgagcagttttaactttttaatggtggtattataaaatacacatcaaaatttgccatattattattattattattattattttggagacagggtctggctctgttgcccaggctggagtgcagtagctcaatcatggctcactgtagcctccacctcctgggctcaagcaatcctcgtacctcagcctcctgagtagctgggaccacaagcatgaaccaccacgcccaactaatttttatatttttgggagtgacgagatcttcctatgttgcccaggctggtctcgaactcctgaactcaaatgatcttcctgccttagccccaaagtgctgggactacaggtatgagccactgcacctgaccgcatcttaaaaatttttaagtgcacagttcagaaatacatttgcattgtacaaccatcagcgccacccatcttcagagtatttttcatcttgcaacagggaaaattcatatccatgaacactaactcctcattcttcctcctccccaccccgggtaaccactatttcagtgtctctatgattttgactgctctagggacttatataaatgagatcatacactgtgtatctttttgtgactggcttatttcacttagcataatgtcctcaaggttcatccatattgtaacatatgtgaaaatttttttccttttgaaggctgaataatatttcattgtatggatagaccacattttgtttatccattaatctatccatggacacttgggttgccttcactttttggctattgtaaatagtgctgccataaacgttgaggtaccaatatctgtttgggtctctgctttcaattattttgggtttatacacaggagtggaatggccaagtcatacagtacctctagttttagttttctgaggaaccaccataatgtttttcatagtggctgcaccattttaattcttatgaatagtgcaaaagggttccaatttttccacagtctcattaacacattattttccggggtttttgctttgtgtttgatagtagccatttaaattggcataaggtataatttcattgtggtttacattttcatttccttaatgattagtgatattgatcaatattttatatgcttgctggctacttgtaaatcttctttggagaaatgtttattcaggtcctctgcctatttttttaaattgggttgatttttttttgctgctgtttaggtagagaaggcaatctttgaataccagtgatgtttcactaatgctgggccattgatttcacgagaagttgtatgaggtattagaatgtgagtttggtttcaatcatggctgaggttgagtgccttttccaaaattcaatgtgaatttcatcagaagccacaaagggtccaggagcaagaacatggtgtgactgctctctgctaaagaatttcagcctgatgacagcaggctatacatgagactgacacaagaacaggtggaaagggagactttccactggaaaaaggtgattctaacatgcagaatcactttcaaggagcaagtaagcagaaaaatagataatggcacagtggccaggcaagaagacactaggtccagaatctgaggttcaaatcctggctctgtgagataacaacatgccttggtttccccatgctactgaaatgccagtggttgggtctaggtcccactgctcactgcacagaaagccaaccactgagacaatgagcattgccagggaagaatgctttatttgggtgctgcagccaaggaggtgggagatcagtcttaaattcatctctccagctgactaaaattggagggtttatatagctgggaagggaggtagctacctgcagggaaaacagcaattaaggaggggtaaggaagcaatcatgataaatgaggagtctggtgtctcattgtctgatggtgatgtggtgagtttcagtctcttgcctgaaggtccgtttcctaactcagatgactgacaaatgttaagtttcaagttttaagaccagatgggtcaatttctatgtttattcaaaaaccctgtaaatatcagttctatgtggaacttgagctggtttcccccagttatcacagttagggttaaatgatgcaatataagtaaaacaccagcagtgtctgacacacacacagagtgcatgacacaagtggtgtgttgggacaatatagctcagtgaactccctttgtctactcagttatattgagcaatgaggcatctctgaagatgccactttgctacctctcccctgataatttcaccagatccagccatatgagcactgcaagtgggggcttagcttaaatcattcctcatatttcccttgcaggcaaatcatttggcaccaaaacaggcacagaagtccaagtcctgctgccagctccacgactgatggcacagacagacttcaggattagtcctttaatctctgtcctctattaaatgaaggtcatcatgctgctgcctaatgtaaaaggattgtggggattttcatcattcattaacgattatcttattctttgaaaccccaagaaaactatataaattccaaagtctaataggtacacaagggctttattatggataataataaaattttttttttcttttttgagatggagtcttgctctgttgcccaggctggagtgcagtggcgtgatcttggctcactgcaagctccacttcctgggttcacaccattctcctgtctcagcctctggagtagctgggactacaggcacccaccaccacgcgcagctaatttttttgtatttttagtagagacggggtttcaccatgttagccaggatggtctcaatctcctgacctcgtgatccgccctcctcggcctcccaaagtgctgagattacaggcatgaaccactgcacctggccaaaaaaattttttttaatgcgctctcttttccatataatcccaaggtcggtgaatcacctctaagccaggtgtttattttagctgatactgccttagtgttggcacaacttaaatttagttcaactaatatttgcatgatctttgcacaacacataaacgcccaggaacaggtggtgctcttcggtggtcaacaccagggtgggtggctatggcagggcacattctttctctatagcccaggtcactggcattcaaagaaatatttttcaatctctgatttttctctggaagtaggaaaatgcttccctaactgctttacttataagggtgtttcttgctaattctgtgcccagagtaactaatggggacatagacatagacatcattcaaatggcattttctctttaccataacccatgctttaaaatgaaataaaccaaacccatgccttaagacaacaatcaagaaatacattctgcctaaggaaaagtcctgcgtttgaaggtttttgtccaaataatctgacattgtggtcatgaaacattgaaaatagcatttggagcagtaagtttaaaaaatttagaaggactaaaactacttgaatgcttgttgggaggtttacaatgtagtcaaacaccagttaagcaaaaataaaatttactacttaactatttacattttctaatgtgtggtttcatggaattgttgagatagaagtagacactgaaataggagtacttaaagtaataaaacaaagatttttataaagtcatttctgacctaattaagaaaaatataatctctatcacatatgaaataaacatctttagaaaaatgcaatgtcaaagaaaacacttggaatggccaacaaatatctactacagatagaaatgaaaatatttatgttatgtaaatgttgggcatcaaattgtctccgaagttgccttctagagaactttctttagttggtatattcttcctatgaatcaaaggaatacagtgttatgatcataagtaatgagggacatgagacaattttaaggattttaggaaagtagggaagcagtgaagtgaagggtaggcagatacttcggagggtaaaaagtgtttttgattcaaaagaaaagctaaggtagtttgaagaaaacatgcatcatctactagttaatctgaggtacaacgaaggtggtgttattttaacagtgttcaaaaaagaccaattaattcttcggccatacagaaagaatggaaagattgcataaaacagattctgaggaatacaaatcaatctagcaaggaactttatgatgaaggaccaatgtaagcatagaatgcactgggtttttttttaattattattattagcagcatcattggtatggtgatgttacctacttttggagtggagctagatatgagagagctgcatgtcctttgaaatttatttggggtaaatagtgaacacagtatctatgacgagttaatgggtgcagcacaccaacatggcacatgtatacatatgtaacaaacctgcatgttgtgcacatgtaccctagaacttaaagtataacaaaaaaacgaaagaaaactatatctaaataaaaaagaaaacattctagaggtgcagaattcaagctagaagaattgtgtccttggatgtcccaaggtcaaattttaatatgtcattgaatgaaggttccaatgtttggaataatgaaaaaagtcatattgaattttgtctttgctttcctccctccccagtgtctaccaaaaaggctgggtaaacattcatgcaagtcaatacactgtcacagccacaattcgtcccagcaatctttcctggaatagtcacttaatacatatctggtgaggacccattggcacttttagagcaatcagaaaacacctcaaattgctcacatctagtgtaggagaaggctaatccatccctgtttcatgaagcatcacttcaatgtcctggaacagtcattctacccaaatcttctgtccctagagcccaacactctctgcatcttcatccattcttcacagggcttgatttccaagactctctaccatcttggccacacaccatgttacacattcactatggacactgcaccactgtggatgctgcaccactgcggatgctgtaccaagagttctgaatccaagggcagattgttatgaacagcccctttaaaagtcttaaacttgatacactggtctgtcagcagatgtgcagagcctcttatgggagacacaatttttgactcatgtgattcaatgtccataaatcttcatccaaaagatgcccatagagacaaagagcagagtaaagtccttgcagcagtgtttctcaaacttagccacccaccagaactgcctggggaactataaaagatacccatgctgaatcccacccaccacgattctggtgtaatgctatggggtgagatctggacatcaggatgtttggaatctccccaggctcattgaacatgcaaccaagactgaagcccactgtcctcagtaatgtgcccagcccggccttcctggcatcccctcatgggtacaggatgacagtttctcactctgaccctttcctttattcaatacagcacagcacaatccaagagggtgagcactgttatgacagagaacctggagtcggacctgattaaatgtcttcaacaaaaccagtgccaagccttggccattcaactatcaattactactttcaacccaggttctaaaggctcttcattagaaacatctcgggttggtaatgattggggcaaatgtgccctttggatttgattgctaccatgattattaattaaccaaattgtagagatattgagtacatttctccctcttgtttgtaagaacccatgagagacaaggccaattgcagacaatggggacgtcctcatgatagtgagatgaactgcctagctatcttccaatatcgttacttccctccagttttgttgcttgcaaaacaacagaatcttctctccatgaaatcatgggtatcagttaggaagtagcccacttggttctggatttcgtttagagatttaagatagtaacagagggtgcaggatgacgaacagcatttgtacactgtgtctggtagtggaaaatacccaacagtgtactgtatgctgactctgtcatttcctgccttctctcctcctttcttccctccctcgctccctccctctctccctccctccttccttccctcatgaaagcatagctcctttgccattctttcctccagtcacaagccatctacttatgcacatcaccatgctcatgccattaccaggggactttctatcagcatgaagacatgaaaatgcctggggaagaaaaggtgtggggagcaggcagcacccctgcaactgcccggtagcatttatacattgctcttccaccttggtttctatccatggctttcctcgtcagagcatgttcactttaacctcctctagagcaatttcttggatccttcaagggcttgagaactaaacacaatttcaaaagaaactgagtaggcacctaccttctggaaacaacatccatagaaaagacttgattgctatggtctgatttatgaacctgtggctcatatcaagattagcatttgcactagcattaaggtattttcattgagatcatttatgttttgaaataaatactacaacatcaaggaactgtatcagttggagaatagaagtgtgtatgatttgtgtatataaacatgcacatcaaagcatttatttatttcagagagttgtataacaccgttagagtaaaaattgagtgattctcttctatttctgaccctacttctaatgtcttctctgtccctctgtgcaaaaccatttaaaccttttatcttggtttcctttgtgagaaaatggggataatagatacccctgagccattctggagacgtgttttgatgccagcccagttatgtgattataggagaaaaaagctttgagcttttggcacttaggtgctacataaatattattagcaagctgctgagattttatctttggaaactaacaagcatttctcttctaaagcctcatatctttagcccctggacacatgttcctgatagctctctctttacagagatccccttggctccacaaggatagagagttctttgctgagagagtcactgccgcacgctcagatgaaaggtattcattctgcttggcagagtcatcggtagagtagctgctgatcccagcaaggcagggtgggtgatgggaagggattagattaggaagaaaagggatcctcttgttctctcactgaggggactttaaacctgcagaagcacatcagtgagcggactatgggtaagtgccaatgtgcaaagtcgatggtgcacacgttacaggttggtgagagatgatgccactcagacctgagtgcaccgtggaactctcttgacttctctctgcaaatgggttgctcctggatgtatagagttattctacaggagtcctgctcctaactcatcagaaacgtaatgtcctctgttgatctcaaaggcattttcttctgttaaaagtattatccattcagcaatatggagaaaggtcatttgtgaaaataaaatagaaatgtctgatggtagtgggggtggggggtgtaatttcctccctatgtgagtagcattaagttcactcttaatttttttcttcatttctgtaattggagactgatttatcaagaggatatagaattcaatgactaattccattaaatgcttaaagaataaaataaaggtagaactcaaaaggcttattcctgattagttttcaagatgtgtctaggcacaggaagttaaaaataataccacagtgaatgctctgacccagtgctaacaaaagcttctttttttcggtgagacttggcatagaaaagcacacatgtcattcagcagtcctgaaaaatgatgactgagatttggactggttttccagggaataaaattgagtgactttttaaaaagttctactcctagaatccgggatctaatcaatccaatatcaacttcaagggaataggccaacaaccagagatgaaattagaagaaaaataattagaatagcaagcataggttggttttccatgctatgattctgcagcaaaggtggtaatttgggaatactgatttggggaatctcttgtcatgggaataagttgtcagctttgctgagtgtctccggtgagctaaaactgattaaaacagagtgctggccctggtatgtaagctctaatctatactccatatctaccactagccattttgaaggaggagagttccctgatccacctcacaggaagtgcaacaggcgtgtggctcgcccgcttggtcgctcaaacccctgatgggagatggagcacacagatgggcaggtgcgggggctggagtgagtgctttgggctccagccccgcagtagtgtctggggagggggggtgcctgcagcctaaggtttacaatgctcttttagtcttgctgtctgcaaatggcttaagtgttaaccagctcaatagaccctctgccttttcacaagggcagagggccagtgtgacagctttctgtattcccagcttttgcccagtgtcccagaagaattgggtcacacacacaggcttgaaggatgaatgtggggttttactgaatggtggaggtggctctcagcaggatggatggggagctggaagggggaatggagtgagaagatgatcttcccctggagtttggtcatccagcagccaaaattccctctgaccacccccagtttaactcctggcattcacacgttccttcccttctctctttctctgccgtgtcatctgccatttgtctgcttgtctcctcatctcctcatctgcttctggagcctggggtttggggtttatatgggtacaggatagggggacatggcaggcaaaaaggcaacttttcccacttagggccgcgggtctccaggcttgagggtggggactttgctggggaactgccttctttacccagtatttccctgtctcctgtccatatcaatttcatgaatgtgtggtcacaacatgaacccagaatttggaggttggaaagtaggagtgaatgcactcaatctactagggtgccaattcgtagcatctaatttggtaatgatgaattagcaatagaatcttttggtaggggcagacttggcgaatcttcaaatgtagcaggattttaaaacgaatcgaatactatctctcagtcaatacaattacctccaccactccccagttcctaattcaagggttatattttcagtaactttatgtattcaaaactgtattagatgctagaaatacaaagatgagtaagacattattaatctctgtccctaaaaagatgaaaactagtgtggaagacagccaaaaaattagagattaatcttatctagaaaattctagaaacagaatgaagcacaacagaggagtattttaggcaacctcaaggcatttaacccaacctggagcctttagttaggttagaatatggccaggaacaggaagtcaagattcaacaaattgcaacactgcaataataactaacatcactttttaatagtgttttctaatatgaaatcaaaatctgcctttggataacttttactcactccctggtcttgtttctgttctctgggatgacacagaatatatcgaattcactcctactccgcttagtactgagaaggcaaaaattaaataaggcattccaaattcttgtctgtataggggccaagggaaagcttccccttcacgctctgaaggtttgctgataaccaactaacaaaaggaagattcacaggagaaaaagcttaaatatttatttgatcacagttgtatatgacatgagagcctttagaatgaaggcccaaagatacaggggaaaccgtccatttttatgcctaggttcaacaaagtatggacagccatgtagaaatagggttggacaaaaagggcctgatctaaagctaatggactgagtgtggaaacccagccaggcctgtctgtctagattcttcttggcctgtctgagcagtgcttcttccttctggatgtgggaaaaattcaccatattccttaggtcccctcaaaggcccctctattcattctatttcaggaagggcgagaggaccaatgaataaccaactttctggaacggaggtcttaggacctacagtcaaacaaagtaggtcagatcatttcttcttttgttttctcttttcaagaggcagggtctgattctgtcacccagggtaaagtgcagtggcctgatccatggttcaccacagcctcaaattcctggactcaagcaatctgccagtctcagcctctcaagtaggtaggactacaggtgcatgccaacataccagactaattttttaaaatgtttgcagagatggagtcttgcaatgttacccaggctggtcttaaactcctgggctcaagcaatcctcctgccttggcctcccaaagtgttgaaattacagatttgagccaccacacccaatccagataatttctgtatggccagtttttacacaggaaggtagagggaaaattagagtccgatttttaggttttatggctggctttggggaaaaggggttctggtttctaggacccgtcatggggaagagggattctagtttctaaggtgcctccagggagaatgggactcagaaacaggagggcagaagaagctctgagagaaagttttgcttctgaggctctttcagaaggattgcttgagctcaggagttcaagaccagcccgggtaacattgcaagactccatctctgcaaaaaattaaaaaaaaaatagcctggtatgtggcatgtacctgcagtcctagctacttgagaggctgaggcgggaggactgcttgaagccaggagtttaaggtgtggtgaactttctgaggctttgattttggggtactgctttctgagccttagacctagaatcagtattcaggtcatgggggaagttcatatgagaatctctattttttaactatcaaactgtgactcccacatgggccacttggagatgctctcactgataggcctgtcatacacctttggtgggtagggacaggaaaagagattgggtagcataagataaagtcctccccaccccacccatttcaataatggggtacacatttatcatatgccaatctgagacccttcctgaacttcacaattcatatagtgttagagagtggtctatacctttctctatgacctccagcccacacgaggttcagtgaccctaatgccacggaggccaggatgctgtgattgagatgatagcaggggtaaggagggtcttttctctgctcatggagcactggaaggaagtatctttttgggtgctggacagtggggaggtcaaggctgtgggcagaggaacactggagccaatgttgggaataattctcatgcaagcaaagacgtggtgtttggctggccacaaccccagaccttgagactccagttccacatgggtccaggatattgtttccatgtacaatatccatctgcgagaatccagcactttccaccacctgccgtggtatggctgtggtcccatgcaccatcaccttgggcttcaacttctgcaatgaccccctaattgataacctggctcttgagttgaccttacagcaaacattctttttgaagaaaagtcatagggcttcaccccactgcccgaaaccctccactattagctgccactgcacacagagttgaagcctaaggcattgcacttacacattttcatgttatattattgcatacatgttattagtttctgagtagccaggagagcattttttctgaaattaaacatatcgaatgcaccacattctttaggtcccctcaaaggcccttctattcactctattttgggaagggtgagggaaccagtgaataaacaaaggtccttgctttaaaggctgttatgaccataaagtctgtgtatttcacagcccatgagagcagcatcctgagatattatttattgtcaaacttctcttctcaggccacacatcccactgcaatggggaatgggactgagcaaattgcaagttcttggttctatgttccagttgcaatcttgctttcagttttcctgctgttaaaacagcctttgctggtaggactgtgggaagtgagaatagatttcattttacctgctgtgcatcagcagaaaaaacaagtctttcttttctcctggcagctgagatttctcagagttcttcctagaattggatgttatatatgatctactttactcatgcccacctgcatacacaccaaagcctgatgagcggtgcaaacccacccaatgttttcccaaaacagaagtaacatgagcacatgtggaactgtcagaggtgtttgaaccagagcaactgcatcttgaataggagcagggtaaaatgaggctgagacctactgggctgcattctcagatggttaaggcattctatgtcacaggatgagataggaggttggcacaagatacaggtcataaagaccttgctgataaaacaggttgcagtaaagaagctggctaaaacccaccaaaaccaagatggccacaagagtgacctctggtggtcctcattggtacactcccaccagcgccatgacagtttacaaatgccaaggcaacgtcagaaagttaccctatatggtctagaaaggggaggcatgaataatccaccccttgtttatcatattgccaagaaataaccataaaatgggcaagcagcagcccttggggctgctctgtctatggagtagccattcttttattcctttactttcttaataaacttgctttcactttatggactcgacctgaattctttcttggcgagatccaagaaccctctcttggggtctggatctggacccctttccagtaaaagaactattcattttatcttttggtcatcaccaagcaaacacaactataaataaggaaaataatatatgattgtaattttactcataatcccaaatgtctttcatgaccagcacacctttggtgtattgggtctaaatcaaagaaaaatttgaggagttgaatgaatgaggttttgatatcttaatgcactttggagaaaaccaacggttgcaaaaagctaaagaaaacgaaaattcattgtttacagatcaggccatgtgtttttcatttctgcaatggcgatgtggttgattcccatggaacacaatgagagtgtggtcttctcctttgagattgtatttattgataaatgcaaaaatgctaatgaatgctaacttgctggttctccatggccttccttcctccctccctttccaagaagggtgttgtatctgtcagaggcatttgaaccagagtggctccatcttgagtgagggctaggaaaatgaggcttgaacttgctggtcggcattcccagaaagttaggtgttcctagcctctagatgtttacagttaagggaatagattgataacgttcactaaacagacccagaattgggagtgtcctgatatcccgatatcttgagaacagaagcattcctaattttgctttaagataataatgttgattcttgaaaaatatagtaattaagaaaattaatcctttatcacaaacccttgtagcagagcacatctccccatgaccttttttaattctctatataaacaagcactgtacctaggggtgggtgtgttccttctcttactttctggaatgccctactctgtctatggagtcgctgtactttcaccactttactcttttaataaacttgctttcactttgcactgtggacttaccctgaattttcttgcccaagacctaagaaccctctcttggggtctggatcgggacccctttcctgtaacatatccacctggtcaatttagaaggcagctgttatgtttatcaggatgaagaaaataaaactcttttacttcaaaatgtatttctatgatacagtttgagacggctgttcagaaagccagcaaacaggaggagccctgcaaagctgtcttgtatggggcgatttgcgtctgcagataaattctgcatggaggcagccaggctttctcggagaccatcctccctcgtcttactgtaggaaagatggacagagagtctgacatctttaaaggtctgaaagaaacatttgccatctattctctctgacgcctgctacccaggaggtttcatctatatgacaagaccacctctgctagcttggcctcttcttctcttcctcccatagcctgtgttgtcacaatgcaagcctccattcttcaacctcaagatggtgtgaaagcttctgcactccatccggggcatggggttgggtaatcaccctattagtcaccctacgatgctccctgtgtgcaggatagtatatttgtttgatttttctccaactaattttgcctttcatgagttgattttccagcaaaacttcagagcaaaaatgaatgttttcccttggcctctgcaaggataatgaattcagatgtaacatgaaaaatttaggaaagattgggagaatttttttttaaagatccaggaatttatcttaggggaaaaaaaaggaatagtattggaaggaggatgcaggaagaatgagagagagagagagaaagggagattggggaaagtgaggtggaaggagggtttgtggacgtctgacatgctggagagatagtgggaatatgagcttaagaggttctagtgtgtgcctattcgagacactggtgaaacaatggaattattttttagagcttctctggatatagaagatggtttccatttgaatgggatgccaccatgttgagccaggaaataaggctttctttaaaggggcctcatagttcgccagccttttgaaaaacttgccactcaggtgaccatgctgggtctccactcaactattcaggttggctgtagtaattacttgtcttaacctaaccttcagctctttctctcccaaactgcaattatttgtccatgagttagagctgtcctcagcacctcaccttcatcccctgactcccatctcaggcagtttggctgctcaaacttattatcactgatgccaaaaggtgaagacttctcatgtcttcagcacccagggtagcaaactgcaggaccagtttaaatgttaatagcatgtctgtaatacacgcacaaccacatataccaccatctttatgaaggcttaagatgatgtattcattttccctgtcatttccataggaagctgctctttgtcactcggggaaggccccagttccctatccaaagtggcatgaaggagatgctctaacaaaaaatgaaatgcaattagggaactgctgttcctgtttgaatgcttaacatcagcctcatggctggcactatccatcccaaatactggccaatgtagcaaagtgtgtgggtgatcccagtgtctgaacccagcccagagttggctagctcatgccccctgtctattagcaattggatgtgggattacttcaccaccgtggactggccactgagaggtggcccagagccattgtgagaggcagcctgttgggttttgagaatggctcagccaattcatgcacatgtctgctggaatcgccagggcaggggctttctggctcttctcctgaccttcagcatatatagagaggtcatgaagacagaggaatgcttgatgaagctctcagggtctttttattgaaccatggccagtatcttatcttttctagctgcaaatggtattcctgctcaaacacgtgtccttttattatataaaaaagtaatgtgttgtctttttattgaaatggcaagtgaatgggaaagttatttttgctttggaacaaactgatagggaagaaaaatcatcccaatgggccgcctcaactggtgtctaactcctttgcgacctgaaagtaattggaagaaagggcttttgctatagactagagaccctcagagaccaaaatgcatatagtgttcaccccacaaatgcctttaatgcacccccccttagtttctatcacattgccatcccaattactcaacactgccagagaagatgtgctctgtagaattgtcatgaactgttggttaaaccgtgatgctttgaagtgtcaatggcaaaagtttgttgttgcaaatttgctcaaaactatgcacatgaaacttttgtgggtgggctctcaggtttatcattaatcatgtcttagtgatttattattatggatatgagtatgtcatatccatatgcgtatgtcaaaactatagctataaatgcagatgtgcacattggtgttgaggatggaaccagcaatggctgggtatgatttctgaggacattcgctggaatgttgcattcacaaaatgcctgtaatcctacctcgatttctgagacttgctgtaaactcataaaagcaagtgaaggatagactaccacctaattttcagaacaatatagtatggctgattttatgcaaaattaattacagcattacagactgaattgttctttgcccaagtggttttctcatccacctgcaaagtcatttcatcccttgccattgtcagcatccttgggctttatcagtatcattcaaaccacttcatcctcatcattaacaaactggactgtgggcaccatctcggccaggtcggtactttcctctgccttccttctgctggtactgagataaaggaggaactctgtcttctaccttaagaatccatactgaaggaagggcatggtccgaagtccacagctgttttaaccatgccaagagaagtcctgagggcaaaggtgatgcagcacatgatgatctcagagcccttctgtatgtgtttgagatgtccgagcttaccaatattgcatgaagtacatcctgtttctcaggctctggattcatgaaatagagctgggaaaatggagctctggaaatgactaagacttgatttaaaggttaaattaaaactaggagtacagcaagggtaagatttcccatggtagctacatgatgggctaaatgtatcctcaagtttcctctgtagaggttggtctcatttttaatcacaaagcgattcacaggtccagtcaataaggcgatgggagcagtcaagaccaaagcatattaggatgtgagaatcactatggagcacatgcgtatgattctggcctccactgccagaatccctgggttcaaaatttgacactgccaggaactgctcatgtgaagaattacagcaatgccctgggcttctattgctttctctctgaaatgagggtatttagagcatgctattgtttctggaacattacatataagtaaaggagggatttcctcttctggccaagaaggaataacatagactggcttaactctcgtacctgaaacaaccagaaaaacaaacaaaatatatgaaagagtggtttcatgactctggaaataaggcagtgaaggacagtgctccctgagagccaggaaactaacaaggtgaacaccatgtttgacacagctgactgccttgacagggctgtagggcacacaaaccactctggggaaagaaccatctgaaatagagaaaatagtgcatggtgctcacacagggctggaaagagtgcctgtttccaccagccagactgaaaaaaaccttgtaattcatgagccatttggctagactactcagaaaggtcttgtgtgaatagtggggaatatttagctccaggctgagtcctgctctgaatctccctaatgattcacaatagcaaggctccaatgttgccaattgtctccaggtaacttaacccaaactgagcagatcgctcaaaaatatttgcaggaatataaaaatatctggcgtcttaaaaagaagattcacagtgtttggcatccaatcaaaaatgtctaggcatgcaaagaagcaggaaaaaatgatacataatataaaaaactcatcaacagacactgactcggaatggatgcatatgtgagatcatatttttggtctcaagattttgctgtttgtttgcttctcgaagtctcgtggttttaggttttacatacaggtctatgatctatcttgagtaacattaggatgcatgtatgtttatttgtatgtattatttgtaggcataaaccaaagttcattttttttgcatatgaatatccagttgttccagcaccatttgctgaaaagactatccttttttcactgaattgttttgtacctttgccaaaatcagttgtgcatatatatgtgagtctatgctgttccattgatctacttgtctatctttatgccaataccacactctcttgattactgcagctttctaacacagcttgaaatcaaatagcatttgtctttcaactttgttctatttttcaaagttaaacatcttaacattattaagtcttccaacgtacgcccaatgtatatctccccatttatttatgtctccttttatttctctcaagaattttttgtagttctcagagtacaggtcttatacatatcttctcaaatttatttcgaaatatttcatatttctgaagctactgaaaatagtattgattcttcattgctagtatataaaatagtacatgatttttgtatattgagcttgtgtcctgtcactttgctaaactcaattaataatagttctagtagcttttttgtatattcaattggatttttgattatgttgtctaggcataaagatggctttaccacctcttttctaatctgagtgccttctgtttatttttattttattactgcactggttctgatctcttgtaaaacgttgaatagaatggtgagagttggcatttctattttgttcttaaacttaaagaaaagtattaagtttttaccattaacaagaattttagatttttagtagatgccctttatcaggttggttgaaggagttcctttcaattcttagtctgctgtagggttttaataagggctggagtttgggttttttaaaaatgctttttctacatctactaagatgatcacattgtttttttgtttttgttttttcgtcttttttagtttgacaatattcaatattgtgggtaacactgattggtcttcaaatgttttgaaacaatattatgtttcaaattactttttacttctgtgacataacctagccttctctctttttttttttttgagacagagtcttgctctgtcgcccaggctggagtgcagtggtgcgatctcagctcactgcaaggtccgccttccgggttcacgccattctcctacctcagcctcccaagtaactgggactacaggcgctcgccacctcgcccggctaacttttttttttttttttttagtagagacggggtttcaccgtgttagccaggatggtctcgatctcctgacctcgtgatctgcccaccttggcttcccaaagtgctgggattacaggcgtgagccactgcacctggccgacataacctagccttctttgtctgagtgtgtgtgcatgattaaatagatcacagtatcacattctgccaggacccacatggctgcaatgtattcttttactagcagagtagcacctgaatcttagcaacgcctcagaggtgatggaactgaacaggagtgaatctgcccaggcatgaacggctcccttacaaaacagtgtgattgcagtttgtgttctcgggtgtaattacctaggaggatttcttcagtcttccataagagaactgttgtaggtgttcttcctgcttttttaaaaactgagagctgtggccagcctgtcagagcacgtcctcttctttcgggcatattcaggatgtgcttactggtctgttcaccctgatagaagttactcttctctgtctgctatatagattaacaccactcactggaacttccatttcccaaaattccaattctgtcttaaagtcttttctaagcatggcttctctctacatatttggtgcacccttcagtgattacaaagatactccaaggtcctgccatgatactgaacaaaattcagatgtagcaaaagtgatcaaggtaggcagcaaagggttatcattgtggggatgtagtacaacctcccaactgtgaagccttgcacacatcactgcatatatctgtgcttgacttttctgaacctgaattactcggtgaacagggtaccttgcagtttgaatgaccctcaagctctcagaacttctccaactttaaagcgccctattctaagagagaactgtatttgttaaccccaagggagacaagcttgtcatttcagccttccttatttaaaaaaggtaatttgtgctgattctccagtacaaagcacttaagtcaattcatcatagaaagaccattaggtgtaaagtgataaatatactatgtcaactttgaacatttatttagcacttttcactgtaaaaacttcagatttcacaggtcagcaaagagagggttttgtttaattgttttgcatcatcagatatcaatctgcagggtaggggacatatcatttagggaaacatgaaagggaaggtaggcacacctcactttacagaaatttctgctgaagccctaaattagtgtgttggtctcccccataagccttctggcttttagagaacagagactgcttattcttatattaaactggagaaggtgttctataatgcataacctcttagaactataaatgtgtattgtttctctttatctcgaccttccaagggccccagcagcctgcccaaggcttcactatccttgcaacaatcatggcacggtagtgatgggaagaaaagctgcaggctcagtgctccttacctacagggaatagtgctgattcctgttgcaaagcagacccattatcagaggcccatcaagtcacaccattcccttccctgctgtctcttgggcctgcaatgacaaagacatggcagaaacgccactatccctgctcctctgctttggccagatgccactgatggattgttcaattcttccctgcagaatcgtgccctcagatccttctgacagtgtgccagatatccagcatcacctttgcagtttgggaagtggcacccagcatccacccagcgtgcctttcttgatcttgtccatggtgctgagattctgtgtggcccccatgcggttggtctcgctccatgggtctccatccagggtgatgcccaccctcctaccacctgtgaacatttggtaatatctagagacattgctggtttccaccattgggagtgggtgcaactggcatctagtgggaagaggccagggatgatgctgcacatcccatgttgcatagacccccctcccacagcaaagaatgatcttgttaaatgtcagtagtgctgatggtacacagacgatgtcccacagcaaagaataatctttttaaatgtcagtagcatcaaggttggggaactctcgtgtgtctgacaaggaaacctgcgattctctctcctctaggattggactctgtcccatggtgctgtccacaatgactgagattttgacacctagatcttcccttaggaagaaatctttcctcaggaaacttaattatcccgccaatgctcaccagctggagtttgacttcatatttttattggtttcctggaaacctctcattgcattccctcaggtatccacgatacccaaaccatgcacacgtgtgacacactgtgtttagcttgcacagcgtctcatgccagaaccatccccagcagattcagctcattctcccatcgcagccctgctcccctatgcccagttaccagcaggtctcccagctgagcctgctgcatcaggataaaaccgtggccacgagccaacactgaaaacttccacctgcagaagttggctcaagtgctgcctgctaacaaccgaataagtaaacctttgctgcaggacctaccatgtacgcaggtgtcttctaatatttctctgatttttctgagcttatcctaagataactttttcacacttcacttgcaaagcaggaatacatatatatgtgtgtgtgtgtgtgtgagtgtatgtatatacacatatatgagaatatagagagaatatatatatattcacacatatatgtgtgaatatatatatgagaatatatatgagatatatagagagaatatagagagaattatatatatatgagaatatagagaatatatgtaaaggagaatacatataaagagaatatataatatatatagaatatatcctatatatttagaatatatagaatatagttattctatttatatagactacattatagtctatatatagactatatatatagaatatattattttctatatatagactatatatatagaatatattattttctatatatagactatagaatatactatattctatatatagactatatatagactatatatatagaatatattattttctatatatagactatatatagactatatttttctatatagtttatatagactatatatagactatattattctatatatattttatataaagtttatatactgtctatatattgtctagactatattattctatatatagtttatatatagaatgatattgtctatatattgtcctagcaaactcatagactttattattgtttgatatatagtctagtacagatagacaatattatcattcaataaaaatatatagatatatataatagatacatagtctagactatataacaaatgataatatagtctttctgtactactatatatagtctatatattgtaaggaggaagataatggctcattttttatccagggtgagactcataaacatgtattactgagtacagatatctcaatagagacaagaaaattcaaattactggcaaggtactgtacataattgtatccaaaaaaatcgggctattttgcatcctagccaagttaccctgcccagtcacaagatcacacaggccaagtcacgtgatcactaaagctggcatgagaggccccgactcatccagggagtaagagagtgaagtcagcagtgggaatgtgggagcagctggtctgtgtaaagatgttctggggaaaaactgggtcaggcttggaagacaagggaagcggtaccagagaaataagcttgactggaacgaggcagcaacagaggcattaatgcagctcagttctagagttatgggaactaaaaggtactccgcttggccagccaccagatgaaatgggtaaaaagggctgcttgaaatgtacaaaccacgtgactgggaagatttcataagcatctatctgcatgggtttgcccggactgacataacaaagcgccacggaccgggccgcttaccacagacattgattctcttgcagtcctggaggctggaaatctgagacaaggtgtgagcggggctggttcctcctgaggcctctctcctgggcttggagatgctgtcttctccctgtgtcctcacatggtgttccctctctgtgtaggtctatgtcctcatctcctcttcttataaggacaccagacctgttggattagggcccactctagtgaccttgttttaccttaatccaatcttgtccattctgcagccctagggccacatgcagcccaggacagctttgaatgttgcccaacacaaattcgtacttttttaaaacatgagatttaaacacggacctgttttttcactcatcagctattgttagtgtattttatgtttggcccacaacaattcttcttcttccaatgtggcccagggaagccaaaagattggactccgttgccttaatcactcctttaaaggccctacctgcaaatacagtcacattctgaggtcctgggggctaggacttcaatgtatggattgggtgagggggcctcgactcagctcatgacaaaatacttctaatggtggttctcagtctttattttgaggaaagtggtcgcttaaataacgacatatggaaaagatacaatttaagtaatagagacttcccaggcaaaccccatgtagggggaggaatcgaacatatcaagggcattccccaagtccaaggtgatagaggtgagaaatgctcacttattagtgccaatttcaatctcctgatagattttcatttagtatgctgtaaaagaaaatatccctgcagacactggcacttgagggattacagtggtggggagaaattcccttatttatttgtggaattctatgaagcatttcacaggccaccttctggggataacctgttcattgccatggagtaaatcaatagccttcatttagattcttaattggcaatttaatctcattcactttacccaacactcattggctggagggatgatggagattgggagcaggctcctaaaaagggtcttgaaaatgttatttcaacaaagattaattttgaggcattgagagtttcagaaaggttcacattttttttctaaagctcttctaagccaatcttaaatgaatcctcagaggactatttctgtgggtgtgtgtctgcttgcgtgtgtgtgcatgtgtgtgtcttgccccattccaattctccatccccatgctgaggaggctggaggattcagaatgcagaatcaggtgtattttttaaaaatcattatgtcagtcctcaccaaaacactggctatttctatctttccttctcattttactctgctataggaatctaagtaaatcatctttaggaaataccaagacctaccaggggctttagattcatggcggccaacacaacctagtattgataacccatgtaaatgtttgccatccagatgacaagaataatgacaagagaaaactaacatgacctgccccatggtgtgctagatccacatctctcggggaatgttttgaagcaagttaatacaagctacttgataaaaggcttccgcgatggaatgagattggggaagctgagttaaacaaaaccagtgttctgtgttggatgcttctcaaatccttaaccatgctgaaaagcttagagtatttccaggagaatggcatagcaccccacatcccagacctgcacagcccctgctcaggtcatcttgtgggatgaacagtatgcaaaacacacatcccagaacatgcttggagacaggggaggccactctctagcctgggaacagttctggctctggcacacactgacaaggtgacactgggtgactcatttagtccctctgtaaactgcccttcctcatatgcaagaggccatggaatgttggcctctcagacgttactggctctaacattattttgccaaaaataaaataattagggtggatgtgttataggaaaggggtccagatccagaccccaagagagggttcttggatcttgccaagaaagaattcaggtcgagtccataaagtgaaagcaagtttattaagaaagtaaaggaataaaagaatggctactccatagacagagcagtcccaagggctgctgcttgcccattttatggttatttcttgacgatatgctaaacgaggggttgattattcatgcctcccctttttagtccatatagggtaacttcctgatgttgccatggcatttgtaaactgtcatggcgctggtgggaaggtagtagtgaggatgactagaggtcactcttgttgtcatcttggttttggtggagtttcactggcttctgtgcaacctgttttatcagcaaggtctttatgacctgtatcttgtgccgacctcctgtctcatcctgtgacttagaatgccttaactgtctgggaatgcagcccagtaggtctcagcctcattttactcagcctttattcaagatggagttgctcttgttcaaatgtctctgacagatgtaataggtaacgctcagacactggcatcagaggcaatgcaacctgaacagaattggctgacatgtatctctgggtataaagaaagtctcagctttcccctgagacgtaatgatgattgtccctaaagcttgcttcacccttccacgctaaactcgctccactgctccatcatctgctttaaagccacaaggacagccagttaggtctttgtcatcatcacttttaacttttgtttaacttttaacaaagattggcctttttaaaggctcaattatattttaaaaaacaaacaaacaaacaaacaaactgccacttacgcagtccattgattttaaacaaagctggcaatgcaagtcaatgggaaaataatagtctttttcaacacatggaattggaaaaactggatacctatatgtataaaaatgaactttgatcccttaccccatactctgcacaagcattaaattaagattaactgagatttgacctgaacgtaaaatctaaaattgcgaagcttttacaataaaacaaaggtagacaaagactccttctacaaatacctggcactaaacattaaaaaatcataaattgtgcttcatcaaaaatacatctgctcttcaagatagatgaaaaggcaattcactgactttgagaccaagtatttgtgttcagaatatgtaaaggaattctaaaactcaacataaaaagacaaaaataaaacaaaaacacatgcaaaaaataaaaaaacaaaaaatgagcaaattatttggacaaaaagttcccaaaaaaggaaatgcaaatagctagcaatcacatgaaaagatgctcaatattattagttatcaaggaaataaaaagtaaaaccataagatactcatacccattagaatggctacagttaaaacgactgacaatactaagttttgatgaggatgtggagcaattggaatgctcatgtattgaggtgagaatataaaatggcgcaaccacttttaataactaccctatggctcaacaattccacttatagatatacaccaaagagatatgaaagcatatattcatccacacaaagacctgtacacagatattcattgtagcattattcatgataacttcaaatggagcagaacccaaatgcttatcaaaggatgaatggataaacatactgttacatattcatataatgacatactactaacagataaaaaaaggaataactattgttacctgcaacggaaacacatataaatctcagaaatagtatgttgttaaataggccagatacaaaatagaatatgttgcatgattccatttatataaagttctagaagaggcaacatgaaagccatggtaataagaacagcagttgcctgaagttttgggggttggtgatatgaggaaattttctggagtgatggaaatattctatatctttattaggatgatgttttcacaggtgaatatatttgtgtaaactcatcagaatatataaaaagatcctacaactcaaaataaaattttaaaaaaaccacaaaaagttattgtgatggttaatattgagtgtcaacttgattggattgaaaggatgtaagtattgctcctgggtgtgtctatgagggtattgtcaaaggagattaatatttgagtcagtggactgggagaggcagcctcttcctcaatttgggtgtgcaccatctaatcagctgccagcgtggtaggataaaagcaggcagaggaacgtgaaaggactagactggtttagtctactggcctacatctttctcccagctggatgcttcctgccctcaaaaatcagactccaagttcttcaactttgggagtcagaccttggaatacagactgaaggctgcactgttggcttccctacttttgaggctttgggattggactgacttcctggatcctcagcttgcagatggcctattgtgggacctcaccttgtgaccatgtgagtcaatgctccttaataaactcccctttatatatacatctatcctactacttctgtccctctagagaaccttgagtaatgcagttatgcatttttattaaatgtaaattatgccttaattaaaaataaatatcttctcaacctccaaaaggagactttctgtctgaaacttgagaataagtctaaagttttcatttaataatgaatttgtaaaagacaggaaaattgattttggcattaatttgttcaacaaatatctgttgagcatgtcctatgtggcagtggctgagtgtagggtgtggagtgggtgaatgtaaggaacatatagttcctggctccctagagctcatggtctaggggttggagagaattggtacattgggattttaaagggggtgccaaaggtggtgatgacaaagctcagggaagaacaactggagtggagggagggcatcaacatggatgctgaaccaagccaatgtactgctaagagtgaggtggaaagtatcatgcgaaccccagagcttcaattgtcaatacatattggggtgtgaccagtagattgatagaagacagcaaagagagaggcgtaaatgccaatacagcacaatagcatgagttgtcaagagacaggacttttcaaggtgaaaggaagggagatggtactgaagcagcagtcatgtctatgacccacccaagccctaagcgatgacagataggaacagagtcagggtcctcagaggacaacctagttttaactaaggcaagaagttgaaaagaatattttaagaaacatttgaggacatattatagtttgctggctatggggtagggtagggtggaagagagagatttggaataaagggtatggatgggacaagacaaagcagggcaccagccctaccttggacctttccttaacttgagaaagctatgtccatgttgattcagccaatctgactcaggtattatgtaacttgaagttgaaccatcccaactgatataagtggtgatactgagtaacacaaatgtgctttctggattcacacatgcattttttttacatgaaaagttcaaacttctatgtggacatttttttcaacagtatcctcaagaagtattcatcatgcaactctttctaggaaaggtatttaaaaaagaagaaaaatgtcatttctggcctggaatgtcaagacatacatctcttagagatttagttctaattattattgtagagtcttgtgggtatttcttataattttaatttttacaaaaaacaaatctgttcatccatgcatctatgtatgtatgtatatatgtatgtatctatcttcatcatcatcataattatccatctatgatctatctattgtgtatctatctaataatctatctatgcagaactgcaaaatttacaggactggcccataccgccctctgctccccactttgtctaatcttcaaaatcaagtttctggacacagggctatgaaatgcaaaatgaaacagctcatgtccaatggtctgacaatctgctgctcatgaaaacctgaaacatccaactgagtttttcataaacatcagcaggtctagttctctatcttcaaagagagttatttttaattttattaggggatacattctttttttataaagaaattattaggtatcaaaacaccacaatctctttatggattcaactagattatgtgtatgggcaaagtattttcaagttaagaataacattcctgttccttgaacactattttgaaagtttggattaagggatattaacttccttaagacaaaacagactcacagttgaaaaccacccaccttctgtatagaagttgcttaattaatatcaatgatttttattgtattggaacaaaatagactataactttttatacgatatatatgggtttattactaaatattcttaaaatgaatataatgctataatattcttattttgaggtaatatatacatagtctgcaaaaattaggtttcctggtgtcattaaccacttatgcaattatttttctgaaatgaatacacatgctgtacatgcagttttgcctgatataagttttaaaacaatgtatattggaatcttggaactaaaaatgagaaaatcagtgtccccttgatgtcaatttcagtttcaactgcacttgctattttatttttaattggttacattatctctacattgtcacagttgatggtatttgttttcttctctgggaccataatttccacagatttaaccataatgcatccttaaagattacaagaaatcttttagacacagctcctctcagttgctgaggatccagcctttactcatttgttttcttcatgaatatatatttcctgagttgtatgtttgtacatagctatttgtagcctttgaagtttatggaagtttgtttggttgcattcttggggcacattttctttccctgaggactgttaaggtttggatatttgatccttccaaagctcatgttgaaatttagtccccaatattggaggctgggcctaatagaagctgtttgggtcatggggacagatccctcccattgaatagattaatgtcctctcctgatggtgaatgaattcttcctctattagttcctgcaagacctggttgttaaaagagcgggccacctccccggtttctctcttgcttcctcgctcatgtaatctctgcacatgctggcttcccctcctcttctgccatgagtgggagcaggctgtggccatcaccagacaaagatgcccaattttgaactttccagccaccagaatcataagccaaatcatcccttttcctttataaattatccagcctcaggtattctttatagcaacacaaaagggacaaggactttttatatcttgccccactgtcttctagcatttcatgtgtcacataaagaaatcttagcctcctaggtttttgttttttttgaatatccacagaattctttccataacttcaaataccaggaatttattgggatatttgttaattattcaatataaacacagccttgtaattcttgggctatttctgtctgcagattcaaatttcattgtatttcaggaatttcaccttgaattgtatctttgaaaatttgttttcatgttccattcattttttaacccatgcaaggcatttagtgttatagatatttgatctcttccctaccaccccctcccatccccctctttttctctatctctgtcttccatcttttactttttgttcttttccatctcacatgctcattttttcttctcaaaaccatccttcaaattctttcagtggtgtctcatctcctttttgctgcttctatcatgacctttgattttggtctctttttgtgtctctctctctgagattctgaggctctgcctattccgtttttattctcatttgtttctaatttgtttccaagactctgtctgctcccttttcattctcatttattagtaatttatttctgaggctttacccactcacttttcattcccgtctaacctaatgtattatcagttcttccttaaagccttatattgcttctttaaattctcatttcagagaaacaatattgtctttaattgattccttagaaataactttgttcacggtttttggctgcgttgtggtatacaatctttccggttctcatcttcataaatcatgttctgttcttcttttttcatttcagcatcattttaaaggcccccggctggctccaccctttttaagtagcactgttcctcatctttttggactagaattttgggcaaagttctggggaaaggggaagaggaatgtgctaaacaaatgggaagattggtttcagtctgttatctctgggatttttctcagctggacttggcctgtgggttatctggtccagcatagcaggacatcttccaggctcacaaggaggctgtgcattttacagaacattttaatgtgattattttaccttgacttatcttcaccaggcagctttgggcaaagatggccaggtagcttttatcttattgactcttccttctatcctatgccatgattgaaacatgatgtaggcttccaaaaccaggacatgaaccttgatcttaactttctaagcatgggataaacacatttcctttcaatgtgtgccacccaaccactttggataactatgaactgggtccactctgcctgagtcacacatagacagacaccttctcttggagttcccaaatacctccatccacttttcatacacttggctatcttcctgcatctactgtgatccagggttataggggatctgtagcttcatcaaagataacatttgtttgtttcttattctcttgtttgctttggattggtttcataaaggaaatgagacaaaaatatacttatactaccatttgaaaagaaaagataaattccttctttcaaattcattcctttttttttctttccaatgaatctcatggggtgaggggaggactgaagagaatgtctaatctactcaaatccaaaaagtcacaggtataaggcacagaaaattttaccagtataatgatggcagttttaatgctatataaggacagactatgcaaaaatgctgttaatgaggatgaggagctacagaacaaacctgatgaggaactgtaattctatgagaatgatgtatatagccatcattttttttctttaatccaaaacaattagattgcttatatagacagccacattcaattctaagctatttgattgaaatgcaccagaggatgcagatatatatatatccttttaccttaatttccattttattctttccctcccattttatctgtgctatagagtacatttttcccacttgagctcaacatgctgttgtgcagaaagccttctcttgggagttcccaaaatgttggcccagatgagtggagcagacatttggcccaggtgagcatagcacatatttacatgaaatattagggagcatccatctgggctatgtgacgtaggctggcaatacacgaaagaggattctgatttgttgtataaatcaccttcagagcccccaacagtgaacacatagggggttcttttcattttcatgatgcttaatataatccttaaaaataattaaaattaggtgaagtgtgtagatttctgagagattacagaaagacactagttttgatacctcttgcttgtagcatttgactgatgtaaacaaactaaaaggtttaaaaagaacagggattcttcccagtagtatagtgcaatgggtagggaaaaaaagctcaaaattgataaatagaccaatattattctcaaaactcataccattgtgattgggaagaaattaatacatattacttagtcacttcatgttactatatacttctattaaaacagcaaaaaggaaattataggaaaaaagtcatacatttaaaggatggaagaaaatcctaggtttactcagagctcaagatcccattgggatgaatatcgttctttcctcggattgttccttcatttcattcattcacttatgtatgcatttatttatttagagatggggtctatttctgtatttatttatttattgattgatggagtattgctctgttgcccaggctggagtatagtggcacaatcatagctcactgcagccttgaactcctgggctcaagtgatgctcctgcatcagcctcctgagtagctgggactacaggtgtttgccaccatgccccgctaatttttaagtttttttgtattgattgggtctccctatgttgcccaggctgaccttaaacttttcagctcagcgatcttctgccctggcctcccaaagtgctgggattacaggtgtgtcccttcatttctaatgaaggaaggttttcctttgaatatctcacaacagatatttttaaaagaaaggcagatttgaagcaaccatcaacaaggtttatttgaaaattaatctgatatttacaagtgcattatataacagaaatgttacagactgaattgtgccacgcctaccccaaaactcttatgttgaaatcctaacacccagtacccggaatgtgattgtatttggagatgggtcattaaggaggaaattaaagtaaaatgaggtcacatgggtgggccctaatccaataggactggtttccttacaagaagaggagatgaggacacagacacacacagagagatgaccctgtgaggatgcagggagaagacaccacctacaagcccaggagagaggcctcaggaggcaccatccctgctgacaccttgatctcagacctctagcttctagaactgtaagaacaatttcttctgtttaagcattcccatatgtgggactttgttatggctgcccaagaagcctaatgggagtgcaaagactttctttaaataatgtataacaatgttggtttggaaatgactatccagtgttgagttcaaaactttatctttataggtgctgctatgagtaagtgtctaatttgggggcataatattgacattcttcgggagaaatgcagactccaatcagtgcagaaaatggcacagaatgtttaaaaatgccctccaggccataacatggttgggttaggaggaggaatactaaccattccaatcctaaaacagaattttgggtttctttctgtgagttcaccacctctgaccttcacaggtaagggaccatcacacagacatctgccattttcatataactctctatccaaacaaaggctgaaaattcagcatggaagaactctcccagcacccgtggtcagccccttggcctgcatccccaccctgggcactggtgtgggggtgggattctttatgaacttgggccccaattctgcttcccctggaaagctggacccacacaacatcaccctcatatgcagaccctcatgtctgggcacctgtgcctacccggagctgggggtctgctctaggagctggttcaggacaggttactcccatccaatctgtgcccaccacagaaaagagccagccaagtgcctgctactgcagggctcttcacacatggaaaagctgccctggggaagtgtcccaggaaagggcagggggacaaaaaacagtcacagtgatttgcctccagacactggacactcttccctggagagtacagggatgctcctctccaaacctgatcttgctacatttgtgctgcccacagtaggggcgccactgagttttcaaagaagacagcaggccctgaattgtgcaaggaaaataagtgcttgaattttgtagaatgcatgcagcgttctacttttaagaatggtactgggctcctctgatattcaagaaaggcccccgacagctcagatggtagtttcctaatcctgtcttcccacatgcacatttacctcctccacccaagaactgagtaacagacatgagtgctcgggacatcatgctgtctactgtcatccccttcctaagaccccctctccccatctcttgacacccctgttcttagctccctctttctttctggcctgttacactcaacctctccagcgtcctaacaagtacccactcaaacctacttcctctcctgctgtgcttcttcttcaaaagtactttgcttctcatcctccccttctttccttgccctcttccctgcttccctcttcaaagcacttctcagctacaaatgagaaggaagcgatctgattaaacaggcgatgagcagagtcatgttctgaggggatttgcatttttaaaaggagattaatgacgacgtctcacaatgtcaccctggaatcttatgcagagtgacaggggagtggggatgagctccgttcagggcaggaagcgagagtttggatctgaagtacttttcaaatgctgaagtcataggagcttgcagttgcttcctgggcggggccataaacaaacatctcttctgctgagtggggtctgagaagatagagggaacggtgacccaggagctctggaattatctggctgtgttacatttgcaggactgcacaaatttaagtgaaaaaaacatgcttttcgtccacctggctggcctcttagcctgctctcctcttactgttccctcgaaggcatcattttttgaaagagaaatttaaactctgtccatctcatcccctttggaagaaagttaagattcctttctgagctctttcatcatctggagtttaaaagcttcccctcctctgtcaactctctttgaatccctcatgtcacagcaaacttcaaaagagacaaatacttttgcatgactccctgcaagctccgttttgacctgtagtgacagacccatgtcttggctttcctgattggaaaaacttctcaagctttctgcattcatgatctctgcttcttcagtgcaaccttctccagtttgtctctgatctccaatggtccctgcattaatcctgtccaagccacaggtgaccctcatatcatctcagcttctacttcccagtctctctctctctcttttttttttttttgagacaggggtctcactctgttgcccaggttggtctcaaactgttgggctcaaaagatcctccggcctcatcttcctgagtagctggtaggggtgtgagcccttctgcttggtctccagtcctttgcttttcctttttgacctgtacaacatttggtggttgacgtccatgttcatgtaattgtcttctctggtttgtcggggccaccatgcattcccttctccctcttttcatttattatcttttcatctagtaagacccatcttcccctaaagatgtatatcttcctcaaggcaaagattggcttaccttcacaaactgagtctccaatgacaacataaactgaaatgcaatataaatcatggacagaagtgagctcatcttctacttcctgtgtcctctgctggttcttctcaccaacgtcacgtattgctaagtaagcgagtgatgttaagttagaaaatggactgagtccattaattcatttggcatgctccaaagtcctcacctgagatctatctactctccaaattacacttgttagaaatacaggaagatccttttcacatgagctaattagggtgaatacaagtaagtgttggtaagaagtactagaaacactggaatttgtgagatttcattgaagaaccaacttccacccagcccttcacattgttctcttttggtagtttcttgtcatttcctccttttgttatcaatagagctgctgtgaacatgcatgtacaagtttctgggtggacatatgttttcattttttggggggggtagacatcaaagagtagaattgctgggttgtatgatgaatctgtgttctaatttttcagaaactggacttctactgcttcctgatttcaccttccatgccatttctgcagtgaggcccactccttggccttacaagacctgaattaagttaggtgcccagagccgttctgtcattgactctgttctttcccttgctagcctgtgtaataattggcaatcagacctttaagtgagcagtggtttcatatgtctccccaactatattacaagttccacgggggcagggctatgtctatctccttgacctctgtatttgcgatgcctggcagagggctgtgaacaccggccaccctccataaacagtgggagacaaacaagggagtcagtagagttagtttttgcttttttacccccagaactcttagaatatgatttgagctattccttcaagaagtcctggggcaggtgatcattcacagatgacatgagggagtgcacagcacgtgagtttacaggaaaatgcaaaacccacgttgaaatttgatccccaatgttggagatggggatttataggggggtgtttgggtcatggaggcagatccctcatgaatggcttggtgctgccctcatggtaatgagtgggttctctattcaatcctacaagagctgattgttagaaagagcctggcaccttcctctcctctttctcttgcttcttctctctcaccatgtcatctgtgcacacagcagctccccttcccgttccaccatgagtggaagctccctgaggcctcaccagaagcagatgctggtgcaatgcttcttgtacagcctgcagaactgtgagccaaataaacctctttttttaataaattatccagcctcactcaggtattcctttatagcaatgcaaaactgattaagacagggtatcaggagacctagctttgcctgaatctgagaacttcatcaggactcttggaacaatttagcccacaggtccaaggctgatttttgtcacagtgaagttcaagtagtaagaattctcactggtggctgttgagggtggtggtggtggggatgggttatatggagaattagcagtgggagacaagaaattaaagtggagaaagggaagaattaaaagtcaaaaacagtgtgagggaggaaagcaatggatataacacctcggatctttatccttgagaggccttaaaaaatctacttaataataatcagatgctattctataagaactttgagactagacatgtgatgacttttaggaacctgcactgtggctgaaaatgcatgcaaatctaactgactcagatccagtcttaactggctcataacttgcttcataaacatgactgtatgttagcaaggaaatgagagagaataacagcacatcacataggcatgaaaagtatttgcaaagcagcagttctcaaaaatgacattttgcagtgttttccagaagcagattcagaaaactgaagaccaaagtaatgagggagccgtttcatgcctagatgagcagaagcataccaaaggcttagtatttccccaagtagtaggcatctcaaacttatttaaggaaaatactcttgatgaaacagatactgcagttgaagcaggaatgtgtttggtgtgctgccttaaatagcatgggtagatgttcaaacatgttaggactcactggccctaggaaagacccgcaagtatctggtctacaccaggaaagtgacaatgaaacaccaaacaccttttctcctctaattaccaagaaaagtatttctttcccaatggttgaagacaataatgttgggaatgatgaagttttctggagtgtgaagtggatatgtcttataagtttaatccatagcttcaccacttcataagtggataatcgaattgtgccccagtttcctcagacttggggatattaagagtaccctcagtcaccacaaggtgggtaccaacataagaaaagagtgtagcaaaagcccaggggcgcatgttcttaaagtgcctagtgtgggattagaatgacaagtggtaggtgacctacttgtgcagaaatttagagttattttgtcattttcaaatgatcatcagcatatgagaatactttatactaactgtttcctgtgagttttccctatttcagcaactatctcgtctgtgcctttctttgctaggtaagcacttttctattggttggtgggcttagcagctcttggttttgccttcatgggagacaaatagcatgcacccgagtagtggtaaaggaatggtacccttcagggtgttctgtcctgggcctgacagatcccctgtggtttcgctctgtgtccccccccaaatctcatctcaaactgtaatccccacatgggattggtgggaggtgactggatcatgggggtggtttcccccatgctgttctcatgacagtgagggagttctcatgagagccaatggttttaagtctggcacttcgctctttcagtctctgtcctgctgactgtgaagaaggtacttgcttctccttccagcatgattgtaagtttcctgtggcctccccagccacacaaagctgtgagtcaattaaacctctttcctttataagttgcccagtctcaggcagtatctttttagcagtgtgaaaacagaccaatacacgctggcttttggttctctgggtttcctggatttctgccctactaacatacttgattcctggcagtgaggggttggtctccacctggctggtatctgcatgccaggcttctggtctagcttgcagtctaactctttccaggtgcatatgctcagattcaagctccccagtcgtccccttgtcctcttggctggtggcataacccatgcctgggcatgacttcctgcttatatggactgcttggagtttgctttttttctgtttggttgtgtggaagtgaccctaagagatgagcctgggcatattcgaagagataatgactgagaggtttagccatacataaaacaaagcagagccccagggaaatctaaaaagtccaaacaagatcaacacaaagtaagccacacctcaacagaccaaagatcaagagcaaaacctgaacggtagctagaaaaaaagagactgccttaaaggtgtgactgcagcaccaagagctggtttttcaatggaaaacaggagtcaggtaaaaagaaagctacatatttaaaagatgaaaaaatattgctcttaaactggaattgaatatgcagtgaaatgcagtgaaaacatccttgaaaagaaagtcaaatacagacactgtgagacaaacaactgagatgatttgccatcatcggatccatatatgtaaacactaaatgatgttattcattgactggagtttctagaagaatgataattaaaattgatagtgaaaattcttttttgtttgtattatgaactcaatttgctccacctccctccaattcctacactgaagctcattaaccaccgtaatgtgtctgtatttggagctaggacctgtaaggaggtaattaaggttaaacaaggtcattatggtggactctgatccaataggactgaactccttgtaagaagaggagatgaggacacagacacatacacagaaggacaaccatgtgaggacacagggagaagacagtgtctacaagccaaggagagaggcctgaggaggaaccagccctgcccacaccttgatctcagacttccagcttctggagtgtgaaagaataaatgtctgttgtttaaatactctagcctgaggtattttgttatggcagctggaaaagactaagacagttcatttctgacttttaaatggaatgactattttaccactatgtacagtattaactgttggtttacaaacagataggtattctttatatttatctatttattctcagtttattttgactctgaatatggaatactgccaattctttcctaaagtgaattttgaaaatacatcattttaagtgactttgcctatgtgaaggatgaattcaccatccctttcacacggttttgaaataagcagtgaatgaatatgacttcatgcttcccaagccttcatcttcgctcagagattagggaatattaaaattctcaagtagtttttaaaatacattttgtcccctagagaaataattattaacattttggtaaatatttgaaaatattttcatgaaaaaaattcatttcatataccatgttgttgaaattaacgtagaacttgaaaattatgggcattttgcaatgaagaatatccaatgctttaatacaagggtgatagttttacagtttcaaaaggactctgtgagaagcccctgccatactgttgggaaccaaggaaagggaggcaacgacttaatccttcacaaacaacttaggtcaaaagatgtacagaaaaaaatgtagttaatttgaggagcaattaaatcggaacaggtaacacaatgatctcactgcgaattccaacatttctctctgtcccttgtgttttccatggtgctggaaaaagatctcgaaaccaaccccaacatgtcatgactaaagtttaacagacaaaataccctaagttatgttcttattcagttttgtacatctacaatgactgtcatgtaagtaaacagtatttcctgaattaattctatctggataacagtttttctgatgaaaacaattacaatccatggaaatattgtgtggctaatgaaggagaaaaaaataatattgcttatgtgtacaaaatattatctattcaagagactcataaagaaccagaatattttgagccatcctgaagatctgctttcagagataacgtgtactcctcagccaacaaatattctcaccaacatcttcgtaaagcaagtctctccaaccaacaataaccaccagagaatactacagactttgaaatgatactaatatcccttgctctttaacacttcattttctctttttagaagataatagttctagagattgcttgtgagacaaagagtctcatgtgagaccaaggagctttagccgactgcttgtggagcagaagagtacagtgcagactacagaacaatgttctgcagaggcattattacagataggtgaaaactcattatttttcattataaaacttgttctaatgtgcacgttttttaaaattttgaaacaccatataaaatgtgccaaatttagcataactgccaaatgtaatcaaagaaatataaactgcagtgtctagacactgactactgttgcacagcagcatcactcctattccttagaatgccgattctttcaagtataagacaggtgtcttccagattatttttttatataaaacaccaaactccatctgaggatttatgaggtggaaaaaaagtctaataagtagtaatcagtaagttcttaagtgttgtgtatgtttcatttaagtgaaattaagatgacgttgatagcgccatctcttggatgatatcagcagtataacaggtccttcctaggggcacacaatatataagcaaacattagctgctagttacagcacacctgtatacattctactaatcactgtgtgtccctaatacgacatactttcaatgagctatgaaagtataattactctttaaacttccttggcatgtatcactctagtgtaaatttgtattaccatatctctgtgaaatccatgagctattcaatggagtaacatcactaaaatgtattgaagcaatttggctaatgtggaagaataaaaaagaacgtatgtgctttggccaagcatcagtgtgtgtcctttgtctaaaaatataagaatctggcagcagctttggttaaaaaacagtaacggacatgagatcaaatttaccctgtaggaaattcacccagatgtagatgcacatcacttagatatgcattacacccatttgtcttattcatacaaaatggcttaatgattagaaaacaccaacataaatacttgggaaggagaagatactaaatcaaagaagtaagtctttcattgaaagcctctattcaccactgcaggagcaggacggctcacttaaaatatataaatatccgtttacagttggagtactaattgggatttttaaaaaatttaattagtcacatatatattttacatttcttggaagactgtttttttctttttaaggtaaaatcatgactctcatacaaatatcaacatgtgtcaaaagattttattaaactaattcaatttgttagggaaatggtaagatgttacaactggttaagaggagcattaaaagtgcagacatatattcaggccatcaagaatgaggaaatgaatttgctaaattgatgcaacatcaatcaatagccagggcctgtcattcacagacaatcactccaccacacgcacacatacattcctacggtttgtccacaacttccagagctgaagagtagctcaaggacatcaaagggcagaggcccctaggaagggctgagccacaatgaagcagtgctccttcactcccgatttccatggctaccaccgtttttctctggcaaatcagagacgaattttaaagactgagtaaatctataaaagcgattaatcacagaagttcaatgtctgataaattattccaaaagtgttcctgggcactgagactcaccaagcatacattctgaaatcaaattctatttctatccaaaaagtgcagcccatcagtgttcttaaaggaggcaaatggttgttgtgaggtagcaaacattttccaatgcaggtaaggatgtagataccaggtaaatgttacagttgtgttcatactaacaataaactatggatgacgtggcacagagtcagtcaatgaggaaagatccagagacattctgaggtcacaaaaagaatttaaatgttagctaacaaggagtgctcatcaaaaacaggactttcccactcagactgcaaaccaggcagaactaccatctcgctttatcagttgtcattgcatgttgacatcaacactgaggagagtgatgcagacgatagatataaacatatctacatacatatgcatacataaagcatatacttatatgcatacacagtttacatttcccagccagtgttcagaaaaactagaagagagaagtgatgttccattttgtcttggaaaagtatatattttacatatacatgcatgcatatgtctacatacatatgcatgtaatgcctacctgcatattaccaaactgatacacacatgtatatatggaggtgtgtgtgtatatacatgtacattcactttatcacatactccatcagcttgacttctgagatggtaattcaagtttcatctttgttctgggcttcgtttctgtctctactgtattttttgtctcaaccgtcaagtcacattttatcaacacgttagactgggacaaaccaacatgggatggaaactccaatctcaggaggctaaaatcacagcgcaggttgggattgaagagttgctgatttcctttccctttcccccagcagtgtggaccatgagagtgggctgggggcggaagactgaggccctccctctcactcataggagggcaaaccaaacagctcgggctggaagtcctgcagggaattcagcaccagggtggcctttgttgtcagatctcggctcaagtttccgtcaggaaccatgaccacctgcatcccagctgccagggccgcctccaccccattgggagcatcttcaaagacaaggcactgtaggaagaaaaagaaagtcgagatggccttttatggaaccagacatgtggatgaagtgtttattatcgtcgtcaccattggctctgcaactgtgcagaaagagacagaattacagtgggggctccccagagtagagattgtggtgaggacagcatgctgtttcttactggctccgggggtctccccgccgtggctcctttaaaggggagaggtttctgttgcagccaaagcattgttgaaatggagcgcagctgtgtggtgaggcaagattctcagcttaaaactttattattttattgggatcataacaatctgttcaatcaataattgaacattcagagtgtgagaggcaattgcaaaactaaaaatcatgctcttaaaatataaaaccacttcagagctgctcctgttttatgtactgtggtttgaaaattaaatggttagaatcttttaagttaaaaattcagttcctgtgtgtgctagtgtgacgtgacaaatgagcacgaaaacgtagtgtgcgtgcatgctctcttttggataatcgcgaaaatccactttattattgggattacagacacaacaccatccaaaacccgtggtctcttcattcagatacccacattgaaaatggggtgtttcctactggcaactgcaaagatatggaaccaacctaagtgcccatccaccaatgagcggataaagaaaatgaggcatatatacaccatggaatactactcagacataaaaaggaatgaaataatgtcttctgcagcaacatggatggagctggaggccattattctaagtaactcaggaatggaaatccaaatatcgtatgctctcacttataagtggaatctaagctatgaggatgggaagccataagaattctatataatgcattttggggactagcggggtgaggaagaaaagactacatactgggtacagtgcacactgttcggttgacgtgtgtgctaaaatctcagaaatcactgctaaagaacttatccatgtaaccaaaagccacctgtaccctacagactattaaaataaaaattaaaattaaaaaggaaaaaaataaagtactaaaagaaaaaccaatacataaaatggggtgtttgtacactgcatttatcagtgagctcctaaaggtgccaccacattgacaatgttacagtaagtttcacatgagggctccctccaaaggagacaccccagagcctgctccatagtataaacaagcataatccacatgtgctatcttcatatcaccgaccctctcaggaagacatacacttaggaaggaagcttcttccctgcattcctagaatggcacacacttcatgtgaaaacagatgtactgatgctttttaactgagactctgcagaggcccagacatctgtaagggaagagaggtcctcgccatggcgacctatgctgaggagtctcccctgctcttctccacatgtggcctagaactccaggagttgttgaggtggggcctttcagctctccactcatctcttctttgtctcctttgtccctctgcattttctttttttttttttggtgagacagagtcttgctctctcacccaggctgaagtgcagtggtgcgatcttggctcactgcagcctctacctcccaggctcaagcaattctcatgcctcagcctcccaagcagctgggactacaggcatgcatcaccaagccggctaatttttttttgtatttttcagtagagacagggtttcaccatgttggccaggctggtctccaactcctggactcaagtgatctgcccgcctcggcctcccaaagtgctgggattacaggtgtgtgccaccacacctggccccctttgcctttcattatgaaaatgtcctcttcggctcatcaccaggtatatagcagcgactcaatgcactggtgtcctggaaagggctcacggaagcctgatgccaggtctgaaagagaagctctgcattctttggcgttttcagtagaaaacactgaaacacacacacagtcttaactactagtggtctgtgctgtagccagcacaatgacttttttctttttccctccctccctttttctttccattaccccattctttccttcaatctggggctaaaatatcatattagccaacttatcccaacagggctgaaccctggattaagtgagttaatccatgtgacaatggaatgtgaatgctaccttactttcacagagggaacttggttggcccagctgtttcggtttgcttggaactgaagggtcagctgtggggcaggatgttccgtgctacaccctggacagtcccaggcaagccacagtagtccgtcccaacacctcccttccaacagcctctgatgccccctggtttctttctcctgtgagacactggtcaccgtaggacgcgagaagaaatgactccacttagactgtccaagttggttttctctgttatctcattcagtgactacctgttcatgatatttctgcccttgcctttttaaaagttatgacttgattgtattctaaatgccctccactgtttttatctgggaccagagataggcacttaaatgtcaaatgacatttcaaaatatccgtcaccttctccggggattctgaagctttgtgcagggtccacctgtgaaatgtggactggggtagaggaagagatggattatcccctggggtaacactgcttggctaagttgtgaaagcagcttttattctctatttgcgtgaggctgcttccaaggagcaagacaggtgtgtgggacgggaaatcagtagctgactgtggctgttcccaaagagataatggaaggcacccaatacacctgcactcacctaaagggggtcatacagttttgctgtgtccctactcaaatctcatcttgaaatgtagctcccagaatccccacgtgttgtgggagggacctggtgggagacaattgaatcatgggggcagttttccccatactattctcatggtagtgaataagtctcacaagatctgatggttttataaggggaaacccctttcgcttggctcttattctctctcttgcctgctgccatgcaagacatacctttcaccttctgccatgattgtgaggcctcctcattcatgtggaactgtgagtccattaaacctctttttctttgtaatttacccagtcttgggtatgtctttatcagcagtgtgaaaatggactaatacagggggtctgcagtggagggaaatgcaggccccatggtgtcccttcacacctgagaaatcttttcaaaggcagcccctgtttaaaggcaactaagtgagggctgtgagtgaggagggaaacttgcaagtgtctgcggcactgacagcaggagcagctgacaccagctcttggagacctttttactgtttctcatggctttcacgttttgctggttcctctgtgttcaattaatctgtcctcacctatttttaagaataatccaaaatggcactgacatctggaatactacacacaacatgtaagacaaatgtcgtacataaagtaagggggactcgaataagcatgaagagtggcgaaaagtcaaggttggtaactggttgctatcacaatcaatcacaataagaaggtgacgtaggctgggcgcagtggctcacacctgtattttgggaggccgaggtacgcggatcacttgaggtcaggagttccagaccagcctggccaacatggtaaaatcacatcgctaccaaaaaattaaaaaattagccaagcatggtggcgcatgcctgtattcccagctactctggaagctaaggcaggagaatggcttgaacccaggaggtagaggttgcagtgagtcaagatcgtgccactgcattccagactgggccacagagtgagactccgtctcaaaaaaaaaaaagaaaaaaagagagaaggtgacataataagcttatgcaacagaagggccatttgaaatatgtccatgtgagtaagtaaaaccctcagtgttcaaatgattgaggggaaacctaggaagacaggccagttggcttgggttttccagcacaagacccttgcaaagttaactattctaaaaggtcaaaagtaagtacagcctctgatgtaaacagccatgggtgatctcagcccaaaacaaacagcaatgggatacatgacacccctggcacctgaaaccctcttcttcctcctctcatgtggccgctttgctaacagctgtcaggagatacctttccccgacatttgccggactcttacacttcatgtccgctaacgagaattccatttgatcaagatggaatttgaaaacggaacctgaagtttcaaaagctgatagaatagtcagctggaggtggtcgatgatggaaacgtgccaggaaaactcaacagaacaggagtggagcagaagtgagtggtttacaggaaaacagcctgtaataccaggcattgtttgcacacaaaatttaaagaaagccccagacacaggacaaagagaagacatcaaacatgagtcctgagaagaaaccccctggtgctaggcccagatggcaactgcaccacacacacagcctgcacgtgggaaatgattcggggtcatgccacagcatctggaagtttgggttttgttggtttggtttttttcccctagaaacagtagaattataaagcagaacaactactgtgtcctgaagcacctattaaaaatgtcccaaaaggtttatttattttcttttttttttgttgttttttgagacataatctggctctgtcacccaggctggagtgcaatggcaagatcttagctcactgcaacctccacctcccgggttcaagcaattctcctgcctcagcctctcgagtagctgggattacaggcatgcaccaccacactcggctaatttttttttgtatttttaatagagatggggtttcgccatgttggccaggctggtcttgaactcttgacctcaactgatccacccatctcggcctctcagagtgctgggattacaggcgtgacccaccgtgcccagccccaaaagatttttatgtcgtctttagacttcgttacacccaaagatctaatgcacttgtaaataggaccacacctacaagaaaagtacctggtatctaaaagcctaaccatttaaagaatgttcacagcatggctgtctgtctactgaaacttaaggatttaagaataaatccttaaaagctatcttggaacaactgtgtctggtaatcacaggacttaagcatcaaaaaaagaaagaagaatataagctaaatacagtttatattttgcacaaataaaattaaggaagaagtatgtttcttatcttcgaaggcagaaatatctcaacacagtttccgtctgccacacccagctacagggaaaggaggttcaccctgactgaacttggctctcatgcttccttttaagcacctggctctcatgcttccttttaagcacctggctctcatgcttccttttaagcacctcatgttttcacttagggggcagcccttcctgtcccaccatgactgaccaattacacttgacctaaaactcattcataccaccacccatacagtgaatcatggattcgtatgtttgcatctgtagaaagaaacttttctctctaagccaagggacttcagcctctgcaagtggggagtggaggcagactgacttttctctgcacggacttggtgggttgctcctttgagggtggtggccagggacagggaaggtggaagtgcccacggctcccttctcttttctagcagggctcctgcaccttcagtgaagccggagaactggggtttggtccaggggatggcgctgccacctgcacatgctcccggcaggcctgcggcctaccctgaaatctccctccttcaccccacatatcatctctgtgtcaggacatgcacatggatgtgtgtgtatgcatgcatattctatatgattttaattaattttgtgatcattttgtagtgtatttagtggaccttctaaggctgacttccacatcttcaaggaagtatctggtcaagaatattcttgacgcagcttgtacagcctacatatcggctgtaactaggcagggcccagttttcacgcaccttcccaggatgccatggcaaatcgtgagcactgatgaacgtctgctaaattagtgaagatggtggaggtgtcctgggtacaggacttagagccacaaaggggccatggaaagtcagcgctagggaatagacagagcaaatgcagcatctcctctgcttagtgcaagggaagttcagaggcaagctggaggtcatgcagtcaggcggaagacagaactcttgaatagaatccaggtctgcagaatccaatgttcttttcactctacccagctgaaggctaaaatatatctgatttccatctccaggcgaggagatgagcttaattaaactgtagcttgagggatttaatttagggagcatgacatttccaacgacaagggaggtgaagcaccttggcggcttatcacttggaggtgatgaactgacttctccaacgatgttgaagcgcagcagcgacctggggatggtctctgtccaggggacttaaaaagtccttgtactttaatttcttaaaagacaaatatcatatagcttaaaagttccattttataactagcaagttgcacataagagtatctttgtctgacagcagcagggtgtcttagtcccttcaggttactgtaagaaaataccacagactgggtggcttaaaccccagacagggatttcccataggtctggggccaggcggtgtgagatcagggagccagcgtggtctctggctccctggtctccccctaacgcattacactgggggtgaggatttcagcatctgaattgggggagggaaacagtccaaacacaagagcaatgaataaaaatggatgggattagaggaaaaactgagaagcaatagggaactggatgatacctgggatgttaagcctgatggagaagctgattctcatgtttctgatgtggtgggtcttggggccgccattttggtggcaggaaggagaggtagcttttgtgacaagttgggtttgaggccatcgtgggacacccaagtagaaggctcggggtctccatgcactgtggctgtgagctggaggtgcggtcaggtgtcatcagagcagagaagcagttgattacacagaaggaggagcgctgagaagggatcccggcagccctggcatttctgtgcggtgagcagacgaggtctatggatggagctctaggtacagtttgggcaggaagggaacacagtaggaggcagtgtcaggagctaggttaggttttcaagagggaaggagaagggcccgcggcttgtgatgctctcgtgttcctccccaggtctcacttcccggtgatgcttccacctttggctcctccctgctgcaaatcctgtccccgtggcacttgcccaccatttcttctcagcagctgggatcaacagcacgtcccatcgggaagcagacagaacagtcacagcagggaaggagccagcccctttccaatcctgcacaccgggacctcctccaggccacaggcagagtgctgcccgtgcctacttgggatcacatttcgtaaccgattttaccttttaaactatgatgtgtctgttttaaattatgtgcttcattggaactagtgagctttccaaatattactatatcatctctaaggaataaagctttcccttttgcttagtgaaatacaacatttggaaggaagtcactgaagggtactttcagggctcccagaagcggtcctggaattacatggaagcacagaaagtacagcagctgctcacaactattcatcaattataaagccatgtatgatctgaatctcatcaccaaaaccaggctttttcataggaggttttttcctatgcattaattttgtaatatgaagttcaattttcacatggtgagacatcaaaacttcaagggggccttaaactttgtttttaattttgattggcagtgctcatatctaaggtttaagttctgtttgacttcatgttccttgtcagacagtgatctgtaaataagtaccacaatgttgtcatgttggatacatatacactattagatgtttgtttaaacatgaaacttttaagtactgctgtcaaaatgactgctgaggtatgtgtgtattttgttattaattagtacttttgtttatattattcatcaatccatccatctgtccatccatccctatttatcaatctatccatccctcccttcctcctgctctcccttccttcatccaaacatccacctacctactagtaagctacatatggtgctgcattcctctaagtaatagtgctgaggtggaggtcagtatcccttgtgcaccgcagagctactgttttactgaatcgatagtgctctgaaaatcaaactataaaaccattattgatataaacatgtttataacaaaaccctttagagttacaagctaggtaaatgaatgaactacacccctaaattgattccttctcctatagagaacagcctttgaaaaagttatttaacgacttggttggggggtgggcaggaaagcttcctaacgaattctctctgtgtcattttactcaataaaagtacattacgggcactcttagcatgcatattaaagtgtatgtatgtaaattaagtggtgagcaaaagacttcaagacagctcaaaaaaccttcctgatttcctcttttaatggtacagatgccgcgtccaccaatctgtcagaaaccagtgaaaacccagcaaggccctgaaaggtgctgactgtcttaaagtcaaaaacaaaccgcaagtttctagatggtcactagaatcattttctttttccacatcctctgagtaaaacatgtgaaatcaattcatcttacgtagccttctgcatgagactcatgatccgcaagtgtgacgggaggcccctatcggttttgtgtgtttagagggacattatgacttcagacagactcgggaagattagccatgtacgggattaaaatgctctaacctgtagagcagcaagttgtgtttattttcaacagcactttcgttatggaaaaaccacatttaggtgccttagatgtgacttgcttgtggtatgcttgctgtataatatgactccacacattgtcaggacagcaaaagcacagcgatgtttgcctgcttttgagagaagctacagagggggcttccccaaacaggattatcacagcataaagagagtgcctttgctggcctgtgtgagtgatttttccatgtcatctccaaatgtgccatgtagaagaagctgccatttataatgggaactgataaacacagagaaaaaagcctaaggaattcattggacctggaggggattaaaagacttcgtgattaaatgagctggtggatgagccaatgagctgtctgtgtggtgagcacgtggcagctggcaatgcagaggcctctcttcggtcctctccttggtcctttccatactgacacccgttgtgcatggcccagcaacctactcaacaggggatgagaggcctacaaagccaatgcccttcaggatggatttattttctggttttcacagggatgccctcagttctccttcctgcaaatatagtaactgctgactcctgaaataaaagccggtgtttatagctgtggttgcaaagtcagtgtttcccaaacaaagatgtgttgcagtaccaggtgaggcttatgttgttttcactggcctcccatgcccatattaacgttcaattctaaattgtctagtagtagaatgttcatgaggtaaggggtttctagaatgttctgtgacacagcagtccagagaaattttccagaaaaaggagattcctcccattaaatgaggaactggggacctgccatgtacaattagcacagaaatgtttccagaagtgctgccatggataactgtgtagttgaaacctcactgaggcctctcaggcatggacacctatcttcagagcaaatcgatgaaggtcccgcaaagcagcactccgaggaatctattttggggacgttttcacaaagagtagctgaatgtggcatgactcacgtcaatgcaaatgcaattcatttgccttgttttcttgaactattctgaatcttacctgtaaataacgacagatgaggcagatttcaccttaaatgcctatcctcttgcaggaatggttgcttacatggcattgaggctactgcttaattcagaactgaagggaccagctctgtgagggcaccctccctaggcccctcggcaatgggctctgctgaccactcatgacaaaatggcgcccagggcacctgtgagggcaacacagggcctggtccatccctctctcctttcctttagatagagaggggcgtgagcatattctcaatcctggaaaacagaggtggaaggcatcttgccttcctttctctaacctgagatgctgatggagcctgggctagaagactgacctggctgtgggggctagagaagagcgagaatgtgctggatgtggggcctggcctgagggtggaaattactggggctactgacacagtacttgtctgatactgtgtatgactaactcagtgtttctcaaccatttcattcatgatcacccccaaaaaagcttttccagttatttttccccaacagtctatccccataacatgttataataacacagatacactatatttttctgtatgtgtattggtgcttgatacattaaaaaaaagtaaggtttcattttcacctccccaaagccaatttttataccttgggacaaaatgcatggactattctattcaattttactcagttgaacagtttttggagaacctactgaaaccactctcaaggaagggtcccactgacccaggagaagaaggcttcacagagtaggaaagtagctgaagatttcagagaaaaacactttcactacagagaagaatccccccacccccacccccgctgcctggaagatcacaaatgaactgtaaccttccaaagtcaacacacaacatttcataactatgacgtacttggggagctgttcaattgcatggaataattcatatattgaagaatgtggagaacaaacaaatgaatctctgacaaataacactattccaggtagcagtctttaaatatgccctcccaccaacttcaaattttataaatgaatgaatcaatgatatccagtgcttggcagatgggacatgctccgtcgctatcagctattattatgataatggtgatccattctgtagacgttacaaaaaattcactatgaagtttaaaattactcaagctcgtgttgggactgggactagcaccttatattctagtgactatgccactaaatatctcaattactagccaggatattgataaactgcaaattaatggcatttgtttcttcctgtttttttgtgagattcatcagaaatgcatatttatattagaagctgggctttaatcaatagctatcagcaattcaagcatgttagacatatttttaggaaattaacacctacataaagtactgtcttgggcaggcagaagacagaaagcagagcagacagctctccagcctccctggagttcatggtctccaaggcaggaaacatgcactggggaatccctgctaatacaggcccactgtggggagccctgtttgaggcacacagtcctctggagcagggacagcagtccattcaccaggatttggaaggtggatttgaaggagtgggtttagggaagatgactcagggatttctggtcagaggcaggtcatgaaagacaggcataatcgcacatgatgtatgtagccactgggaaatggaaggtgtgtgtggggtgagaaatgcaggcagagggaagagcttagcagagacagctactggctgcactccagtgtggagaggcttgtcaggatgagatggacatgcagaaaaataaacattgtactgggggcaggcagaagacaaggccccaaaaggaaaccagaagtaatgagtgaggtagggagcaaggggtcaggctgagaggtctgtgctttacgaggtgggtggggagggaagctggggagggtgagatgaggtcagagcagggcaactgggcatatcagtgttttagaaacatcaaagaagcaaaaccactgatttaccaagaaactctgaccattgttaaaggcagtgcccccctaccctagcagtattgtttatgtctagtaagattattcgagagcatgactgcttaatttttttttttttttttttttttggaaatccaaaatacaactcatccactgaaatacctggcttagtgtcaaatgttttattctgcaatggtggcttaattcagatgggttggttacatgctacctgctattaagatggcctcatgcaaactgtcattctttgaaactgctggtatgtggagattgcacaacttcatgtacaaatgcacatggaaccagagaaaccacttagcagttacactggtacaacaacaccatacaaatgaattacaaagcagccctcaagagatgttacacacgtgataacaagtagtcactgctggcctgtcattttagcaatttatagtttgcttgatatatgtgtctgtgtgtatgaatctaaagaatgagaaaaaattaattgtgtagtgattcatttatcaggagtcatacttaataaaatggaacaaaaacatcacaaacaggtaaagcatggagattctgttgggttaatggtctttgtaattgcaaaggaaaatgatgttactatcacttttgggtgttcaattcagcttatctgaaggggctggaaaaagatcaagtaattactaaccatacttgactttgaaatgcgttcacacacctatccagttgatgtggggagaagagagtgtaggaggtaccgtgcttcctgtctagggagataaagtctcccctttcattctattagctatgggaataccagataattatgttttttaaatactacaagtataatattgtttgtttgtttttgagacagggtctcactctgtcgcccaggctcgggtgcagtggtgcaatcacagctcactgcagccttgacacccccaggctcaggtgaccttcccacctttgcctcccaagtagctgggactaccgggaagcaccaccatgcccggctaatttctttttgtagtttttgtagagatggggttttgccctttgcccgggctagtcttgaactcctgggctctagcaatcaagctaccttggcctcgctaagtgctgggatttcaggtgtgagccactgcacccagctaatattgttagattatgtattcataagcctatgaactattgcatagtccacttgtaaatgacaactacaaaaatctatgaatggctgcgtaattcatcctataatcatgacgactgtttactacagtcgttattttgagcatatatataagagaaaaacagtacgtattcaacgtttctctttatgttgggatatgcactggaacttccttctcataaaaagaacagaacgtgaacagaaggctcttacaagatggaagagcccactctctagtcatggggtcacttatgggacaagtacaaagattaaaaccagcacacactgccaaaaactatcaaagataggcaagctgttgatccgcatttattggatgtctactgaataaataatgagggcattctacattccgaggtcgtgaacagcccatattcccacttgggaacacaaccagaaaccgtagttcctagtcatttcattgttcaggtgtggtttctcagtattaatacagggaggtagggaagaggaaaggaagatgtgggggtgaagggaaagattgtccccctcctcgctcctatttaggaataaatcaggtgggagatgtgcttccgtaaccagctggacagtctgtgtccctgagaggtgcccagagggtcccagtttgcaccaacctctcctgagtcatgctggaaccttctttctagagagctgtgtttggagaacggcacacagagccccttgactcctgggcctccagcatctcccaggaagacctccaacagtatgtgattaaactatagacatgcagctcaaataatactctggatgagccacagaacatgtcttcttttctacagaaaacgtattttcttaacccttgaataagctagggatacaagatccattcaaagtttaaggctcggtaatagatttgaagatacacgaggaggaaaaggttactgatagggcttcaatttccacatagcaactaactcttaagaaactatcacttgctgaattctggtgtagtaaaacagctacacacagaaatagagctaaagaaagaaaaatagttaacattatcttaaaagacttaaaatatcccttccttttcaaactaggttctatataagagacgtgatctcagctcactgcaacctcctcctcctgggttcaagtgattctcccacctcagcccccctgcccccaaaccaaaaaaagaaaaaacaaaaaacaaaaaacaaactcgggcttctcattctcattagccacttcttctggggacagctctaggggtaaagggtcccaccgttccctacctgctgggtaatcagatcccttcaaaaagatgctttcgagtttttgtccagtttttctcactgttcttaaggggagagttagcgcagcttgcttaggtcctatcaccagaaggagacttggttcgagttttacatgttaatatttgattggagtaggattcaccttagtgttggaagtaagccagagccttggggtttatgtccccctctccactggcaagacatctaccccggtattatttcctgactgatccatctgtttcacaacaatctgaaatgccaccttgatcctcgcataaatccccaaacataacgaggctgaattcactggttattctccctattctagtttgggtgagggcaagtccgagaatgtgtacacaagcattgtggaggccagatcgggtgaggaaggtacaaggaaggtacaacatgtccaggggtgggagagttcacgggctttattgcaaattagcccaggccaaacacttttaaaaagcggattcctcaactacagcaatgttatgcaatgcaaggtggggagccatacatacaaacagcactagtgctacttatgggtcacgtgttctctgtattcaatacaccattctcctccaatcgcagtgaagagaaacaatgcccaaatttgccaataatctgtggtactacattaaatgagatgctaaacatttagcaaggttttagcccaaaacatccaataattattagtaataattactagttaaaagctaaaagatattttgaaaattgacacaattgtaaaagataactggtaatgcaggaccaacgaacttgatgcactagtgtatgggggaatagtgactagattgtatttttactggctagttgtctgaaaccttgctatcaaaaagactcagtgaacacagtatcattacaaaaaatgcacagctggtcaccagccaacctaatgaaatgccccgagtagggtagtggcatttgtactaatagtggctactagttcttttaaaaagtgtttcaaggaactacgaggcatggatttttttgaggcatttgagtgacagtccagaaataaaaaaatacatgttttagagcagtggtccccagcattttggcaccaggaaccggtttcgtagaggacaatttttcctagataggtggggggtgaaaggggctggttttgggatgaaactgttccacctcagatcatcaggcattagattctcatacggagcacacaactcagatcccctgcatgtacagttcacactagggttcaggctcctgtgagaatctaatgtggcctctgatcagacaggaggcggagctcaggtggtaatgctggctcactcgccgctcacttcctgctgtgcgccctgcttcctaacgggccatggagtactggtccatggccaggggattggggactcctgttttagaggatgcaataaaacatatatggagactgcaattttttggtttacaacttcggggaagttaaagggccaaaaccagcactgctataaagattaagctattagatgttttttgctggaaagtatttccagagacatgagctttttccataacacatatcaatcacacacacataaacacacacacgtgtgcgcacatgcatgcgcacacacacacagtgctgattaaatgaagttttgttacattttccattgtcatacaagtatctgcctttaaaagggaaatagtggaccagggattcatccatcatattttctccacacaaagcacagggcacagtgccatcctggaatttctccagccaagcataaagaagatatctgaaggcaagacatatgaagagtaattatgagaggacagaacttcattctgttctgagatttgctgtttttctctagcatttagtgaaattatttcttcacttctctgcatttgacagagtgcagaagggcctcatgcctctaatttgtgttttcccagagaccctcatgccccaggaatggctcagctctggcgtaattctgcagaacagtacaggggcccgtgtgcatgcaacctgtgtcgaggtctctgcagggctgtgaactagaaatcaacactgcagtgccccaagttccccaagaatgacgagcagctctccatcaaaggaggacagattctgccgctgactgtaagccctggaaaccagtctggaggaacgcaggtggctgtgggtctgccaagaagccagaacacttactgagctgtgacctggccaaagcacagctccacctcctatcaaagctgatgatgtacccaaggggagagggagagcctgaaggtgaaaaagacagcctccccattgacatcactgcagctgtagtggcaggagatggagacaaggatcacgagactaagtgtcagtcagggtttgtgaaataacagtacagaagaggaatgccttctctatttgtggggaacaccacgggaaaagaaaaagaaggtgatatggtttggctgtgtccctacccaaatctcatcttgaattgtagctcccacaattcccacatgttatgggagggactcggtggaaggtaattgaatcaggggggtaggtctttctcatgctgttctcgtgatagtgagtaagtctcatgagatgtgatggttttgtaagggagagattccctgcataagctctctttttgcccactgccatccatgtaagacatgacttgctgctccttgccttccgccatgattgtgaggcctccccagtcatgtggaactgtgagtccgttaaacctctttcctgtataaattacccagttttgggtatgtctttattagaagcgtgaaaacagactaatatagaaggccacactatagctgggaatgtagggtttctttgccaaagtttataagaactgaaaatcaaagagcaagaaataactactaaattctaataagaaatgacattggctattattaaaactaaatgacagtgtgtgctcctaaatcactcggtattcctggcatcttgcaatctgataaaatggcacgtacacgaaaggttcaataaaagcttacagaggggaattgagtcccttggtgtgaatctgtttctttacctacagaatcagtgactggattctgtgtctattggcttctgcttccgtatatcgtgcattgatagcctctgatttgggtgtggggacaggggaggagtctgtgttctcaggctgggaatgagaccttgaagtcaacatagcagctgctacctacagcctcaattcaggaagggaagaaacgtacaaatgaggacaagggaggttttcagaagagagggcctaagaagtggatggataaaggaggttgctggctgcagacggcatgtgaggagagagaatcctcgtgcaatgagaagcttcaaggttggctgagggactccagggtgcctggagggacaggagcaggctgaaggaaaatgtgggaaaatggagtgttggccgtgttttcagaggtgctcatgacttccaggcagtgcagattcatgagcctggggctcagacaagcagcagggtccccaagagtagatttaaggtaggagaacctctattgagactcctagtaagtgtggcctggctgaacttttacataagattttcccaaggcccctttccagaccactgggcccaggactctacccatgtccagaaaccaagatttgagtcaggcacagtgacaacaagtagcagataagatcacccagggggatgggacagagtgagatgaacaccaaaacaacacctgcacacacacagatgctgacatttggggattgctgaaccgagttcctgggtgagaggaagtgcagagagaaacagtgggagcagtggatgagggcggatgggcatggtgcagccagcagagggagacgttgcagaggagcgtgggaaacggatgtctgtggtttcagcagtcaggagcggcagatgccaggatgaaatgccccccgaggcgaggtgaggaggcgaggatgcagtcagaaacagggattgtggcacctggcagctaatgtgggaacaagactgagggacaccgaggtcatctgggagagcaagatgccccaaggctagtgttctggacacggacgtaaggctactcgggctggataaaggcaggacctgagaaccaggggccgggcacctcagggttgtttagaaacaaggatgccacgtgcgctcggcaggcagagggcctcttattagtgctgggtgctgggcattcagagaagggggcaggggagtaatgatggggtgttggggagaagcagatggggcctccatggactgaggaacatgccacagtggcatgagggttattagagctgaagacagtaagcatcaagtacaggaacagaaggcttctgcactcccttccctttctaaggaaagccttccagaagaattcagccctcagccctcatacatccaatgctcaggagtttcacaaccagggaagtgtgagtcttatcaccaaagataagaagtcagcacctgtcacacctagatgagaaatcgccccaaaagatgttgttataaaactatcttatccaccatctagtctcctaacggcccacttagttttcctaaaagttttcctaaaagtttattcttctgtgtgtccttctgcctctctcccatccatgttaagatgacatacaaatccgaaattctaactgcctccttgagtcacatttttctgtgaactccttcgttgtatgtaaatacaaatctatctttactcttgatagtctgtcttttgttagtctgatttacaggcccccaatcactgcacctaagagggtagaggaaacacatttcctctgacagtgaaatttggtttaagcaagtgccctcgtgccaggaaattcagaagggacaccaagcccaaaggcaagttcaatgaaagaaaagaagtgtaaggacagtaaccgtgaaggtccttgttattacggttttttaaataacgaaagaagggagaaagggaaatgaaataataccaaggacaagtgagcagaggcatgcctattttgttcagcgatgatgggtgacaggaggaggtggccttgaggctggagcaatgaggacccaggctgtggggtcctgaggcccacagagggtggcaaacaatggcaggtgacggtcctcaccctctggagcagctccagtgtggctgtgcccgtaactcagtgttgcagggtaagaagctgattcaagaacatctaatctccccaaaaccagaggtccagcaaagctcagctggtcaccaaatattaactttttttttttttggagaaggagtcttgctctgtcacccaggctggagtgcaatggcacaatctcggctcactgcacctctgcctcccgggttcaggcgattctcctgcctcagcctcccgagtagctgggattacaggtgtgcaccaccatacttagctgatttttgtatttttagtagagatgaggtttcaccatgttggccaggcaggtctcaaactcctgacctcaagtaatccacccaccttggcctcccaaagtgctgggattacaggcgtgagccatcacgcctggcccaaatattaactttaaattggacataagtagtatacagctatttgttctctattattctcggaggaaaagaagttccagttacagaggtcagctcacactgacagcctgcctgctcctgtctgcattcttttgggacatatgcaatgtacgataaggataagttaagatgaaactttgtgtaaatgtcacatgcagttacaggtattagaaaaatacatgtatttttaactagctacatctttttttcagtttttttaaatctaggaaagagtcacagagatgcaaaaagttcttcaaatttggtacaagttgatatgaatatatgcccagcgacagttttcttaatttcactttctcctaagcctcctataacttttgacattacttatttttttctaattgaactataagttccctgaaggaaatcacattggaatcacacctggcacttcctcctcccttactgcctatttctaatctgtcacccagtactccactgagctctaaaacacagacatggccaatgtgtccttctaagaatttccagtgagctcaaatgcctattgtaccatgtgtaaacttttctgcttggtttccaaagtcctcacgattgattctgtgttggctgcactcctgttggacttgttctgttcagcactaatcccaccctctgttcttctctgtaaaaacgctgagcatttatctcaggccctgtgccatccccagttcccctatgatgctctaatttgtgcctgagtgaacttttggtctgactgtcacactaggcagagctgcctcccccaacattgcactgtagagatggtccagcgtacagcagagttgaaagaatttcacagaacacctgtatccctaagtcaccacccagaatgtactctctattttttttttttcctttgagacagagtcttgctctgtcacccaggctggagggcagtggcatgatctcggctcactgaaacttccacctcctaggctcaggtgattctcccacctcagcctcctaagtagctgagactacaggcaggcgccaccacacctggcaaatttatcatcatcatcattattatattttgtagagacacggtttcactatgtttcccaggctagtctttaactcctgagctcaagtgatcctcccaccttggactcccaaagtgctgggattacaggcatgaaccaccacctgtaagactgtattcttaacaaggtgatagcataatagtttgggctatgagtagaaatgtctaaaggctggttgaaatgagcccagtctacctatttatgtggacttagcccttattcattaagaaatatgcaggtttccacgaaaaagagtagaatctaccacgtcccttgtttattaattgtgaatattatctcacaacttcaaccctggtattatacaaaaaaagacagataccgaatatacacaaaacttaggctggcaaaatgagtctactctatctgtttatgcagtttaacatgtataactttcttgaaaatagaacagaaaaacaaaaacaaaaataatttttttaaaacctgaaattcagctcctaaaacaacactaacaagtacaagaaaactaaaacacgcaaagtagtgatggctaggctgtaaaaaattgatttccagccggaacagtggctcactcctgtaatcccagcactttgggaggccgaggtgggcagatcacctgaagtcaggaattcaagaccagcctggccaacatggtgaaaccccatctctactaaaaataaaaaaattagccgggcgtggtggcgtgtgcctgtaatcccagctacttgggaggctgagacaggagaatcacttgaacccaggagacagaggttgcagtgagccgagatcgtgccactgcactccagcctatgcaacagagcaagactgtgtctcaaaaaaaaaaaaaaaaaacaaaactgatttccgatttctggttttacttgtaataaatatcaaccctagaagtgatatgtaagcaatgccatcatttttgtttcacaacaatgatggcatttttgtggctgggaacagagagccctggggtgcctcccagcttggtcgctcaagtccccaccaagcaatgagtgtgctcacactcgcaagtctcaggacctggcgttcggcacatggaggccctctacccactgggtctctggccttcaggggatgtgttggcagatgtcgcaccctgcctggcacacagtgggcgggtgctttcactcgatgggtgctcattatcctgaaggtggtttctggggggcttctgaaggtggccttatgtttgcttgatattttttagaacaaaataatgatacatgaataacttagaaaatattctcagtgaaaacttgattctttaatgtcagctctgttggacactttctcctagtaagatgggaattaatatttaacataattaataaccctttgatcctacttgtttttgactactttcctatgactactactactactatgcctaattaacctggtgacacctatggcatgatcaattccctaaggcaattccctaagagattcagaagtctcttcagtgactgatgatttaatggaatgcccttgaactctggaggcatgctgctcctgtgagctcacacccacactgcgggcaagaagcagcagcagggcctgactgaagagctccaagatcgtccacacggcccctggccactgcctcctgtattcctgacacaaatgccaagtacaaaaccagggctgcttccctgacaggagcttgggaaaaacttcctttagtattacaatatgcacatcacaggaggaagacccacaatgtgtcactgtctctaagtaagaagcatgagaggaaacatttcatttctgcaagagaaatatatctgtaagtaaatgtagattaataataaggaaaatgtttagaactttctaaaagctaaatgacttttaaaaaatgcaactgctcatttttctttgacaagtctaaaacaaacattgtcaatgagaacaccaagatgttaaaacacaattcattccatgggcctctttgcagggtaccttgtgagagaaattcctcctcatgagggcccttgctctgtgggtttcaccataactggtcccatgcaatggcagcatgtggtttccacatacactttgcttccatatacattttaaaacatggctaattttttgtggagacagggtctggctatgttgacctggctggtctcaagctactgggctcaagcatcctcctgcctcagcatcccaaagtgctgggattacaggtgtgagctgccacacccggctgcgcatggtggtgtgtgcctatggtcccagctacttgggaggcagaggcagaaggattgctgacgcccaggaaatggaggttgcagtgaactacgattgtgctaccaccgcctatggcctggacaacaaaggggaccctatctgaaaaacaaaaggaaaacaaaaccaaaaccaaaaaaccccacatgaaacaccatgtttccattaacagagtaccttgcaaaacaaggactgcctgtacttgaaattccgtttaattgccttagctataggaacagctcatgttaacaaggcaaatatttcaccttgtctttatcagtttgtaaatacagaactgaatgcaagtgccaacatactctgatcgcttctgggacatggttatggagtgcagcaccttcacttttctagtgaacaataactcaggttaaacaacaacaacaaaaatggtgtttctgggaagaaggctttatagcctgaagctatggaataattcttccacaagggggaaattctaaggaaaaatgaacatgttgcagaggaatttgtaacagggtgccaagcatgcagacatacacatgtccagacataagaagcagatacatgttcccactgggagctgttccagccgcacctggaggctcagccttgactctctgacttactagctgggaggtctcaggcacgtcccacgttaagcaattgcagtcaagttgaattcaataatgagacttaaatcaagaatgagatttcaatcagcccaggtatgtgtgttgctaagaatgccccactgtctttcaatgactgtttatagctatggcatcataaaaactacacacctggtttttgtccccagttcatgacatggagctcctaaaacacttggaatttctgagtcattaataagccattttcaacctaataagatgcctctagtggacccaggatagctttaggacagggtctggacatcagaaagaccaaatatgcgattagaagattaggtctgggcacggtggctcacgcctgtaatcccagcactttgggaggctgaggcgggtggatcacgaggtcaggagttcaagaccagcctggccaacatgatgagaccctgtctctactaaaaatagaaaaattagccaggcgtgatggcacacgcctgtaatcccaggtactcaggagggtgaggcaggagaatcgcttgaacccgggaggtggaggttgcagtgagccgagatcatgccactgcactccaacctgggcaacagaacgagactccatctcaaaacaaacaaacaaacaaacaaacaagactggaactttcagccctccccctcatctccagggagggcaccttggcctggattgagttcaatgagcaatcgtcagtgatgtcatcactcacacctacgtaagaaagctccataaaaacctctacataaggggcctggggagctttgagtttggtgagcacatggaggtgctgggagggtcaggtgcccagagagggcaggggagcattgcaaccacccgccatacattggccaatgccttgcttccatttggctgtccctgagttttatccttcataacaaagcagcaagtgtatgaaagtgttttcctgagctctgtcagtcatgttaggggattattagacctgaagagaggattgcaggaacccccaatttgtagccaatcagaagtacaggtggcccctggaacgtgcaatgggcgtcttgtgggactggggccttaaccttcggggtctgggctaaccgtaggagtcagtgtcagaactgaactgaattgctggatgcccacttagcttcagagaatcagaggcctgtgtactgaggcacaggttccggctgcctctataggctcaaggtagtaagttgcaccctgggcaaaaaacaaaacaaaacaaaacaacaacaacaaaaaacaggtctttcaagactactccggtagctccgctttattgggaaggtttctgagtaatttccctgagctcgtgattggtgtcactggttagtaatgagaggtgaggcctgaaaaagacctctcactgaaaggctcttccccacaaaccacaaaagtcctcacatgcaggaacccaggggaagcaggcatttgcagagactccccgacggatgccctccccagctgcttacacttacatcgccagcgggagcccccctttcaagggtgacttcctgtgattctggaatctgtacctgcagatcgttcaggccaaggactccatcttggcagtcacagaacggtcagaggaatctggagccaggcccagccaccacaagcggtcggctctctaaacgctctgcccaggtcacctgaggaggagccttatttaacaagaagagggagccaggggccgtctccactgcataccctgcatggtcaagcagccgtggtgcgggacagggggtgccacggcatacaagcccaccagctgccactttccaatggagaaatggatggaagtccaaaaacttggcgataaaaacccagcgtcactacacaagcaaaaactgcagcaaccaacgagcactctataagcagttggggaggggaagtgagttttagtgatttacatctgaactgcagtgaatactcaccttaaagcctgcacctagacaataagactgttttaagccccacatcattaaaaccgccgcttccctggaaaatgtctgaataggccttgttctggcactgtaagcttctcagattgtccctgagacccagtggattctggctgagtctccctggcctggtgacttaggtgcggccacgattcctcacaaaatcttccaaccagaccatctccctgcccacatacccaagttctagggagcattgcaaagtggccttcaacagcacaaaccacaacttttcacatttagcaaacactacatggatattatttggtggaacatggttgtggaacacggcccgtgtcaccggcacccacttaccttctccatagcaggagggggagagaacctcttggcacaagctaggaagatgtccgggtctggcttgccatgctgcacttcggggtcatctcccagcacaatgtgggaaaacaagctgaagaactccttgtggcggcttgtcttcatatcgaacgacgcggaccccgagctggtggccagtgcaaaggggatgccatgtttccgcaggtggatgatgagtttctccgcccctggggaggaggagggaaggactgaggtgaggggcgaggcctccaccataagaccttcttgcagggacagtccctccagctgtgtggcagcacactctcaggctgctccttttgaggaatttctgacctaggacagattgtctaaaagcggttgtcagctccacaacatccctgctcaaataaaacaaaccaaaaaatcaaaaaagctattggcggttgagcgatacgtttcccaaaggaacagaagaagagcgcactgggaggcactgctgctttgcctgctgggcctccttatgaaacgtggagaagggcagagagcaggcccaggaggtgactggacctgggatctggccagggcaccggggaaggcccttcagcagggcctcgctgaaccatacttttttttccagagcagtaaatacacaaggactatgcttttggtgttttctgcaaaaatgctgtattctacagaaaacacttcaatcattcttcaccctgctaaggagaggaaattacacaaaggcgtccaccagatgctgaagaaggctgtggctgagggactgctgcagcgctacttaacaagggatcaggggacaaaagaaagctgctgaacacagctgatcaacagcaacgtgccatatgaaaagagcatcctcacactgtcattagccacacggattaactacagggaccacacaggtccatggaggtcatcatagagccaatcatgagaggactagttatcagaaagaatcaaaaataccaggagtccttcctacctttaacttatgcgactagcacaacaggaacatctaaatccacacaaggtgtgacggtttgcctaaaatttcattttatttttcagacagggtctcactctgttgcccaggctggagtgcaatggctgatcttggctcactgcaacctcggcctcccaggttcaagcgattctcctgcctcagcctccagagtagctgggactacaggcatgtgccaccacgcccagctaatttttgtatttttagtagagatggggtttcaccatgttggccaggctggtctcaaactcctgacctcaggtgattcgcctgcctcagcctctcaaagtactgggattacaggcatgagctaccacgcctggcctaaaattattttaaataattgtataatcatgcctattttaataatgtcatgatttaatgtccctactttgtcaattgttacacaaaacaatcaacagactcattttttccgaacacctacagtcattcaggataaggtaacagatatctggagcacctgaccctctaaagatttttaaaaggaaggcatggacagatcataatgtagttccaggacaaagttaaataaagcaaatgaaatcaagcaaaatctagcactccactgggtgtagaattcatagtgtctaacattcaatcaaaaattaccatgctgcaaagaagcaaataccacccacaatcaggagaaatagacacagaaatgatagagacagatggaattagcagatcatgaccttatgtaacggctttataagtattataaacacacctaagatagacactatcagaataaaaaagaaaaacaaaagacccaactacatgttgtctacagaaacctactttaaatataactacacagatagattgaagataaaaggatagaaaactacataccacataactattgctcaaaagagagccaggttacttacattaataacaaacaagcctttagaacaatgaatgactatcatcagggataaatagggacatttcataatgacaaatagatcagttcatcaataagacataattctaaatgtgtaaacatcaaatagcagagcttcagaatgcataaagcaaaaaccaatagaactgaatggagaaacacaaacgtagaaggaagtttaaaactcctctatcagtaattgataaaacaagtagacagaaaagaagtaaggacacagcagacttcagaaccactgtcaagcaacctgacctaattgacgtttatgtaatacttctcccaacaacagcagaaaccacattatttttaagtgcacgtggaacattcaacaagaaatatcctattataaggataaaactattctcaaaaattataaaatacttaaaatcatacagaataccttatctaacgatggtagaattaaaatagacattaataataggaatgtggaaaatcacaaatatttggatgttacacttctatgtaagacatgggtcaaagatgaaatcacaaagggaaactaggtaatattttgtagagaactaaaaactaccaaaatttctgggatgtggctaaaacattgcttcgatgaaaactgatggcattgagtgatatgttaaataataaggtctcaaataagtgatctaagttgccacattgaaaacctgaaagaaagaagttcaatgatttaagcttttaccttaagaaagtgaaggaaaagagcaaattaaacccaaaacaaataaaaggaaggaaataataaacatgagagagaaaatcaatgaaataaaagtagaatacagaaaaccaactaaatcaaaagcgagttgtttgagaagagcaattaaattagtagactcctagctaaactgatcaaaaaaataaagaagatccaaatgtactaacattagcagggaaagaggggacagacatcactacagattctaacatcgataaaatgataaaaacttaattattataggattaatggcaacacatttgaccatttagatgaaatgagataattctttgaaagatataaaactccctcaagaagacacaaataacctgaatagccttctgcctatgaaaggaattgaatttgtaattaaaaacctccttcccacatctaggatcaaatggccttgctggtaaatttaccaacttcccaagaaaaaaaggatgccaattctaaacagacttttcaggaaattggagggaacacctctcaactcattttacattttacatcagcacttccctgatcccaaaaccagacaaaagccagacaagaaaacgacagatctcatgaacatacatacacatacctccacgcataaaaacaatattcaatcagtgtagaagtactccacctaaagagcttctacagaacttgaatccattagttaaaaatactaaaatgccacactatttcattagtttgcaacaaccactgattagtatcacagaggactatatttattagctaaatttcaatttaaaccttaacctaactgatggatgagataaaaggctctaatttttttaaaaaagagacagtcacgtgtggcagtgcgtcctgtaacccgttacttgggaggcagaggcaggagaatcgcttgaacctaggaagtggaggttgcagtgagccgacatagcgccactgcactccagcctgggtgacagagccagactccatctcaaaaaaaaaaaaaaaaaattagccaatcatgaacttctgtctggatataaacagtgattaaagctgagtatcaaaacaatctgaatttaaaacaagatttttaaattgctagatcacacaattttaaaccaatattttaaaaaatggagcacacttaaacacatggctctgtaaaacacactgtataaaaattttcttaaagtactttggtgctattaattttaaaaacttaaacagattattttattattattgttttgagacaggatcttgctctgtgacccaggctggagcagagtcaaacaatcatagcagccttgacctcctgggctcaaaacgattctccagcctcagcctcccgaatagctgggactacaggtgcatgtcaccatgcctggtaaatttttttatgttttgtagagacagggtctccctatgttagctaagctagtcttgaagttctgcttcaagtaatcctcttgcctcggcctctcaaagccctgggcttagagatgtgagccactgtacccggccgattattttattttagcttatccttcttgcatttctattgctgtgaattatttctaaggtggagtagataaacaaacacacaccaatgtgtctagactggaatgcagctcaacattcttattgatggagaatgaatcaaaaacggttttggacgactgctttacaccaccacaacatactgagatctccaaaatgcttgggactcctatgaagatgaaagccaagacaagactatgaccacagtcagagattacgggacatccgtcaattatacgccctctttgggcctcaattttgtcatctgtcaaagagcaatgattaacgttcctcatggaattaattcacaagaagaacaatgcctggaaaatgacatgggtgaggaagccccagataaatgttaggtagtgtcgttatcatcagatatagctccagtgtatcatcaggaatgaacgatcctaatcacctgattcaaaactgcctgatgccttcacaaagtttttcatcttttaaagagtgcacacaaactttgtctcactcagtggctttccctgagaagtaaaagacgaaaaaatgcaaatggagttctgttctagggagaagctggttaattatgtgtataaatgaactccagttcccagctcctagaatttggtgtgcttccgtgggtttacaggaagggcagagagacagatatctaggtatctgttgctccaaacaatcagctcacaggacacatctccaggggaagaactggggaatgtggagaatcagcactgtgagtgggaagaaacgctcctgctttcctccatcctagagacccaaggtgggtgagaacagggatgtgcaattaaacaggattaaacaaaggaaagaggcagaagacaggcagctgccgcgcggtctcaggtgttcgtggcattcttttgttgggtgatctggccatcagaaccctacaagcctgaacattctctgtactacctaagacctgcagtgagcaacagaatcaagtggggggtaccgggggttgacaacgcaaagtgggagagggaaccgcttagagggccgtgcatgtcattaacgctgtgtgccgagaaccatgtcctgggcctcagtctagaagagctctatgaagtgagacatggaagacagcccgtgccactggggcagacgatgtggtcagctgatggatgccacctggctacctgtgagaagacgctgatgctatcccaggaccagacacacctgtgggattctgctgagcctccacttcctgcatgggcatcctaagggtgcctggcccgtcaccccaccccaccatggggaaggtgctttggcatgctgtctttcttaggggctacttttgcaactgcctgaacagcaggtgttatgcttcaaaagctttgtgtgactgagagcagtgggttgaacggtagcccccaaacagaagtcctcacccatggtacttctgtcttgtttagaaaaagggtctttggagatgtaattaagttaaaaatcttgagatgagctcactttgccacgtggaaacggaggcagagactgaagtgatgtggccacaagcccagggatgcctagagcccccaggagctgggaaaggcaggaaggatcctcccctagagcctacagagggagtgtggccctgagacaccttgatttcagacttccagtctccagaactgggagacagtcaacttctgttattagaagttgctgagttttcagtatcttgtggcagcagccccaggaaatgaacacacaggtgctctgttcttgaatgtgaatgagcagaacagacactgccaggtgtttgtggaagaagactcaaacaggcagaagacaggaatctgccagaaaaaaatgacaatccagagaaaagtgggcgaggaagcaacagtcatgataataattagtattcatgaagacatataagttactgagtccttaaaacaaaaacagaatgctagaaaagaacaattcccagaagaagaaagaacatatgaggattaaaataaatcaggagaggagggccgacacaggcaatgtcagctacgacaccaagctgtctgggatgcggttcaagacagttgtggggggcaggtggtggacagacggctgctctttctcgttccttagaaatatgtccggtttggctgggcatggtggctcatgcctacaatctcagcactttgggaggccgaggtgggcggattacttgaggtcaggagttgcagaccagcctgaccaacatggtgaaatcccatctctactaaaaacacaaaaattagccaggcgtggaggcacatgcttgtaatcccagctactcgagaggctgaggcaggagaatcactggaactcaagagacggaggttgcagtcagccgagatcacaccactgcactcgacagagaaagactgtctcaacaacaacaacaacaaaaaaaaaaagaaggaaaaaaaaagaaatacgtcgtgatttttaaaacattgacaatattcaaatatacacagaaagaaactgcctgattgatattgctttatttcctgtgaggcagtttcacttcctgaggactacagagaaaccctgtcaccctccggcctccatcctcttcctaagactcagaatctgagctgttacctgcatctttgcgggtgaagacatagctcatgtgctttcacttcctggaaactttaccaggcttctcacacccttgtaacccgctgggattcaccacaacacctccagcagctggctgcagttattgcggttgtatgtatgtggttagaaacttccactcaagaatgagtcacaacctctgcactcccaagaccccatgcagacatccagtgaataaactgcttatttcctgccgtctgttttcctcatcctcgtactccatcctctctgttcttaggaatggaaggcagtggtgggggcaggaatcattccttttccttgcagtacatgtgtgcagcatggaatagaaagtgatttcagatacatagtgggaaggtgagctagttttcctttgactccatccatggcttatgaagcaagctgaatgctggctgtgggggtgtgaggatggcccctgcactacacaacaatgctcagagtttctcagggtttgtgtttccaattaggaggccacgcttggctggcacatgctgggccctcaataaatatctatgaccgatattgaatggacaattaaggcaaaggtcattaaaaataacatttggctatgtgaaaatcactcagattctagattttaagtgttctccccacaaaacatgatgagaaagtgagatgatgcatgtgttcattaccttgacgcagccactccacaatgtatacatacttcaaaacacgttgtgtgtgataactatatacgatttctatttgtcaattaaaaaataaataagttaaaaaaatagcatccggttatccgagttcatggtggggagccttctcatgaagcggttagcattctcctttacacaagacagacctgttactctctaataagatgctgcctcctggaaaatgtgtacccagagagcacacacggtccagcagacgtcgctgttgtggtatagcacatggaggcaggggataagattcgatgtgattgacaggcacatttatccaagagaaaactttcaagatctgatggagtaatgcagggtttccattcttatttcttgcctacttgaagttccttgagcgagctgaaagcacttactgttgcgaggcttcctaaggaaacatcagttccaggttcttcacaaatgtcacacgtgatctcacaagggtaccatgttctgaacaacactgagctttggaatactagaattgttggcacttcacaatgcaaggacttgtctcgctctctgaaccctgggttttacgtgggcaacttggcaagtccacgagccttcggtcatcaatggacagtcaggggccacatgcaggaagctgttgctgtgtgaagagctgatgccctgagagagtgaccaagaagggagaaagatgtctgcaggtcaaacaggcacctgggattccataaaatggatgcaagttaactttaaatcataaggggtaagctgtgtaggtcaggtatttacaaaggggtccacgaaatggattttagcaaacttcctttaagtttaacatctgtttaacttttaaaaacatatgctgatgcatttatttcttgttcaagatttatcgaaggaaacataattccatgaggacacgctgctaccattgtgataaatggattggtcatgctcagtgacaaaagtgtctcctggaccagactctactcaggctgctctgagtctttttctccacaaggcccccacactggcctataaagacttgaacaagttcaacagctcaaggtcacaccgctacatgactctagcccccttaaagtacttgcctacgaaaactcaaggctgccaaaataactgattgttggttccagccactcctgcagacaagcctctgtggaagggcaggagcctgacttctatcagcaccagtgaaacccagatggcttcacactgaccaaaccctcttcctgctttctgcaattttcacttccccaactctgctgagcccctgctgacccctccctactccctgaatttccctttaaaatgcccagtcacctctgggataattgatgttgagcccagtttcacattggtctcttttctctattgcaatagtatattatggaagaaaatctgtgctgatcgctttaactactgtctggctgtgtttatccttgacactagaaaataaccaaagtcaaattccccaaagcatatagtattcacattcatatatatagttttaaaaactgtgactttaagtataaatttaaaagaaatattaactaatttaggaaatctggctaatatagattcttgattttttataagttctgtatgtttatctattaaaatggaaccatcacttacaaacactactgtgcgctttttagttccctcacaggaaacctctggtagccacagccactgtgagtgggcgtctcttaatgatttactgcagagccatgcctcaggctatccctcttctgatcttctccaagctctagggagcatgcttctttctcagacatcattgattttggcagagcacctccttcctttttctaggccttccaaatgaattctgctcttttgaaaaggtgcttgctgctagggagagggcccttggctgtgtgcagatcttcagtcctaatttactagggacccggcaccaactcaaagctaatatcagggatcgccacttatggaatttgcaccacaggatccggcttatggaattgagtgactaacctatatcctggacgtaagacagtgtggtagtgtggaaggaaaggaaacaggagaaaggaattgggttgaggggctggaagaggagcaaggctctggcaagactggctgaacctcatggaacactccagccaaacacgactgactgagtccgcgccccagctcagggccctcctggggcaacctgaacagtggcagtctgagctgggagtaggaaagtatgggtggaggtgtactggcttgacagtgctctccccacaaaattcatgttcacctaaaacgtgggaataggaccttagttggaaatagggtctttgcagatgtaatcaagttattatgaggccatactaaattaaggttggaccctaaatccaaagaaaggagagggaaatttggagacaaagacacacaggacgagggagggcgtgtgaaaatggagacagagattggggagttgaaggtacaagccaaggaaagctaagggtggccggcaactaccagcagctgaaaagaggcaggaaggatccttccctagagccttgagagggagtgcagccctgctcacaccttgacttcggacttctagccttctgaggtgtcagacagttaagtttctgctgctttaagccacggagtttgttaattaacacagcactaccaggaagctaatacagtgggttgaccctggaggagaaaacttggatagactgaggttctatctgtgagatgaccttaaaccatcttaattatctttctcaaattctggtacttgacacacaaatttgtgatacttgatggggagacagtgtgggaaacctgtgtttccttttttggcaaacattaaatactgacagaaataaagcagttatgaaaataaatataaactaactcctttcaaatcttcaaacaaacagttgcaagagtccagtttacatttatttggtctgctggtcccagggcaatacaggcgatgagcatccgactgcctttgctgttctacccacagctggctgcttgctttgtggcaataggtgctgtctaatgttctccggggtcactgaaatgtgatcggcctaaactcctccagccaaagaagcacctttctctagaatctcgttatcagtatcactgatggcacagcttgtgttctggtccaatttcatagacttatagcagaattttagattaaaatggaaagccagggagggcaattcaaaccactgatcaatgcctggtaattaaggatggatcaaataataaaaattaaaacaaaactatttttttcagccattgaaaataaaagagacaaagtaatatagagagtaatgcagaaattttatttaaggaaaattaattttgcatttctacattagtttttatgaagtaaacgtaggactacagcgtgtaattttttttttaagtagcaacaggattttaccaggctggtctcaaactcctgtcctcaagcaatctgcctaccttggcctcccacagtgctgcaactacaggtgtacaatgtgatagtgggactgaatggtctctctcattcctctgctaagcactaggactttagaagaaaagcctctccacctgatcctactgaccctaagtgcccctcctccaggcaggacttgacaccttaatgttaaaaatgactcaatatttccctgtgctgtagatttgtctctgtaacaacttaacgtgaaaatttccctctcactatagcatggtgtactgatccttgatccttgttttcccttataaagaatgactagactaggacttaaacaataaaatgccgttttattaatagcatgggatacatgtgagtgtccttgtgttccagatttgccactgtaacaatttacatacaaattgccctctgactctagcaagtagtactaacccctgatcccttttttaaatcccttgcagagaattattagactagtacttcgcagtataatgcccttttaataagcacatggaatgcatgagagtttccttgtgttctagatgtgcctctgtgacaacctgcatgcaaactgctctctgactctaacgttggctactgatccatgatccttgcttctctctccttttagaaaacggctatactaggaatgaacagcataatatcaacaaaaatgacaaccaaagtttaagttctaagcctcttgaaagggaggaacaaatatatagattacaggagtgtctggaaaggatgcatgttccccagaggacaacatttcagatgtgggttgccacaacagaagagtgggggctgagccgccaggcagattctcagtaagctacacagcaccacctgggggcacaggtgggagccttctccaaactcgaagttactacctgtagtcagtttttccatcagtgggcctcgaaatgttggtgtttaagagttgttgtcatgaggtaacttccttccccagagaagagttctccaggatcttttttggttgtgcataaaagagagtgaggtgaagggacctggtgggctcacagcgcagggtgcagggatcttttatctacgtcctccactgtgcctgatcaccggagatctgaagtctctctggctctgtgtataaacctgttttctgccccaggtggcattctgaatgcacagcttggggtggagggcccaatggctccactacttcacatccgggatttcaacctgctctgtggtgttttagctcttcgttttatcctgccttttgtttttttttgaaacacaaattcaacttactacctgtttttaaatgaaaagagtcaaaaaatatgatcttataacctgtgaaaatgagatgaagttccactttctgtgtctgtagagacagtttgactggagtgcagcaccagcacccactcacgcactgtttacagctacttgcttcttaacacagcaaagctaaaggcttcacacatataccatggggtctgtaaagctgaaaacacagagaaagcttattggcccctgatagcaaacaaatcatgtgcaggcccaagaggtgaaagaaaagagggggtaacatcaggaagacagaaaagtaagaggtaaattttgtaatgcaggaaatcagccaggcattgacacctaacccctttgcccccttgcctgtgacactaataggaagaattattgtcagttcttcaagaaattcatgcacagaccagataggaaatttacctcatgagagaactgccctcctagaaacggaatccaaaaatccccaacgagtttcttccattaaccacttaactaaatattctctacaagtgctcaaattattagagcgttattagagcaaattatcaaaacaatgttgagaatttaaagtatatatagtatctaaatattatatatactatataataactcattgaaaaacatatagcataagggtttattaatgtttattaaagtctgatgttcagttcctgtacttatgcagctaaatccaaatacagatatattttagcttaccatgcatagaatattttatgagccatagacccaccatttcaatgcaaccaaaggagcagaaatttttaaatttaaaaaaatttttcttagccctgtgaaattgaattcatataaatccctaatagacaaaaaggatgtatataaagatcaaatcaatttgatataccaacatgcttaaaatctccttattaaattgcgcttacaataggctgtgcatggtacaaagaaaactcagtaaaataagactcatacaacccagacagtatctgcattgggaatttcgtactattttctaaaatgtgggacattcaggaaatgtccacttccccctagctagctggtaagtgaccctttgatcatatgcctcacatctcatctcagtcttacagggacaggcagtttcaacaccagaagctcctgtgttgtcacaatgaagaggctggaggctaccatgtaagcgacccactagccccgacttcaccccaaccaggccagacacaatcagacacaatcttgtgctccccgccatgtgacaaaggttactaccactggcaaattctgagttcagtgtgcaaatgtgctatcagtttcagaatctgctctttgccctgaaaatcaagtaaaatgcattcttttgtattatgtaacagatgagaaggagatgactttgcagagttttacgttgatatgagaaagaagtggcactgaacacttccaaagggtcaatggtgactccatgaaaaagactttatgatcgtcaggagcctcctgtcctcacagaagctataccagcattctttctggagattatatgatctctgtagccagctgtcaatggtaaataaaaaagaaagggaaagataccgaggaacagtattttgttctgatcaggacacacttagttcaccacttgactgtggtaactcaggtctcctaggtttcactagaatgtggaaagctctggaaactcaaagggaaggcacatttaactggactttttattcgttctttttaagacagagtctcactctgtcaccaggctggagtgcagaggcatgatctcagctcactgcaatctctgcctccctagttcaagcaattctcctgcctcagcctctcaagtagctggaactacaggcgcccgccaccatgcccagctaattttttttgtatttttatacagacagggtttcaccatgttggccaggctggtctcgaactcctgacctcaagtgatccacctgccttggcctcccaaaatgctgggattacaggtgtgagccaccgcgcccggccttaaatggactttttctttcattggctttcttaagatctggagaacctgaccaactatctcaaaatactgaccatcctcagaaaaatatttgattttgtgtcttctttgatttgccagaaagctgcttacagtactaatttcatttactttgaatcacttttcgggttgctacttctaaggatctatcactacaaaataaatgtataaaacagctatttaaatagcttatgattaatagccaaaggaaaagatacaaactaggaaatgttaacataatagctcattcaattttcctgattttctactatagctctctacgtgattaaacaatgtaaattctcttacctaaacaagcacaagtattataaaacccaatctgaagaaggcatttaactcatcgtagagaatgccatacctgaggttctcaataaaagcagcctggtaatggcctacaaggccagggtcaaacttctccttctccgtttcacttctctgaacctgtatcctcacctacataatgcaaataagaacaaccctgactacgtcacaaaacaaacataaaagtgcaaatgatataaagattgggaaagagtttcagttttcaatttcttcacaaataagaggtaacagaaaagtattcttcttttaaataactcacatcaaaaatggattcattttgccttatgcattcaacaataagacaaaaataacagaatactttaagttatagtaatcccaaactaattttaaagttcttaacctaatttgtggactacttactataaaatatcatagtttcctattgtcaatttttttttgcaaatatttcatagaaatttcagttttatggctagagctttgttgtgaggagtttctgttgatggtgtctctgtcaatagtctcaaatattaaagtcttgctcttacagtctactctctaaggaatcctctagaaaggagagagtaagactttccctgtattcttgtgtctaccatgctatggagatgaaaggtcccaccgtatagaagtggtgcagaaaccacctcaagagagtaggcgtggtgcgaggtactcctgacctcactcaaacctgcccatgacactgggcccaagtccccatgacccaggtgcttggggcgtatgagagacacctgtcttccctgataagagtgtatgattctgttggggataaggagatgcacttatccacaacacttatgtgaaaaaccacatttgtgtctactcactacaggctttctacctcatctgcacaggagctttgccaaaacacaactccaaaatccttgaatggcttcttgccatttgaaaaagaataactattgttgtatgtggtaaaacacctacaatataaaatgtactgttttaatgatttctcagtgtacaattctgtggcattcagtacattcacattgttgtacagccatcaccaccatccatgtccagaacgtgttcatctccccaaggtgaaactctgtccccattaaatgctaaaacctccatccccctcccccagcccctggcaatcacaattctactttctgcctctatggatttgacaactctagggacatcatactgaagcaggagaatagggtctggaggcagggaaccgaaagctgattcatgctgacttcccagaactcaatcaaaaggaaaaccccaactttccatgcccaagtaacaaaaggactggatgctattccctttgcaagcctctcctaccttctctgtgtggcagatggaaaactgaaagtatttctcattggttgctttgtgcaaccatttctactactggcgccaggaggctgtgagcgggtgctgggactcggggcaagctggcagcgctctacacctggatgctcacctaaaagtcactgccctccccactccctcgtcctgactgcagtgtgcagagagtgctggcacctaacacccctcaaagcctgtctgtgcagctccacagtgctgtcctatgctgtgagcacacccctcccggagggacagtgacttgattcaacccattgtggtcatttatctactcatttcctctcctttgaatcgagaggtccttgaggtaaggatttctcttgttcattatcctatactcctaaagacttagaaatccacaggagaaccaccacacatttagaaacagaaactgggccaggtgtggtggcccattcctgtaatcctagcactttgggaggctgaggcaggaggatcacttgagcccaggagtttgagaccagcctgaacaatatagtagggccctgtctctacagaaaagaaagaaataattagctgggcatggtggcacacatctgaagtgtcagctacttgagaggccaaggtgggaggatcgcttgggtttggggggatcacttgagccagggaggtcaaggctgcagtgagccatgactgcaccactacactccagccttggcaatagagtgagatcctgtgtcaaacaaacaaagcaaaaaatataaattgtaattctttgagaaacatctccacatgcgcagtgaggtaatatctaggatgatcagaagcaaagatttgtatcttattctccttagtctaggatgtcttcattacaatttactaaataacaaggcaattagctgcctatgaaagtcactatattcagaaaagaggaataatgtccatatacatcattgaataagctgatttttttttttttttttttttgagacggagtctcgctccattgcccaggctggagtgcagtggcgtgatcttggctcactgcaagctccgccccgcgggttcacgcctttctcctgcctcagcctcccaagtagctgggactacaggcgcctgccaccacacccggctaattttttgtatttttagtagagacggggtttcaccgtgttagccaggatggtctcgatcgatctcctgacctcgtgatccgcccgtctcgacctcccaaagtgctgggattacaggcatgagccaccgcgcctggccaataagctgatactttaaaggaaaaggggggtaagaattttcatttacatttacatttgactggcaaatgggcttcttcctccctacgatcataaattttcctgaacatggggctaattcgatttgttaaacggaaaaggaacacagcgtaagttgaatgtgttaccatgactgtcagcgtacaattttccttttcgcttgttgtgtgtgtcctttaattgtgctgttatccaaggagtacaatctgcctaagtaaaaatccctgaggtccagctttgccagcagagcctctccagcgactgagaatcagctgagtgccccaaatcgagaccaccaccagaaacggagctggacgaggcagagtccccgagcactggggacttctccacatgggttatatatggccttaaagggctcagccctgtgacccgtgtcagaacacatcttctcccctttgtactctgatgttgtctacctcaacagaaggtcaccgccacatcatctggggcagtagagcgccgtggctaagagctatggactcttcattccccacctgggttcgaggccagcctccataatcagaggctgcaagcttttggacaagtaacttgacccctgcagtcctacctgccattccctgtgctaagagcgactgcttcttagcggcggcaggaggctgacacatacccccacgagtgaaagcactgagagcatgacatgcagtgagtcctcaatgcttgtgagccaacacgaccatagtggacaccaacaaggaaaagtggcatgaatacccttcaggtgcatgtttcctgaacatggcacagagaatgtgttctggggttcctaggcactgtccatcttaatgagactcgaagccccaacaccctgggtagatctaactggcatagccccagcaccgagctgtgaaatctggctgaggataggccaggaatgacaggcaggtggagacacagtttgtgccatgtacacaaatgggtccctcttctctgtgaggctcctgccacctaggtgttatactgcccctcaacactgaggcctgctgcccagacttagaaagtaatggattatcagagcggcctataaaccaagggctataattcttctgctggcttccttcttggcctggaagctgacctgggtgcttcctggttcctaaaggtaacagctggccctgaagccactggcacaggagacggaacaagagatgtgactgtgtcagtgtggacatatgaaaatctacaggactgtaagggtgtggacagcacaatacctccatcactaaggaggacaaaccaaagcagcacagcttgcctgctgaggtcttctggaagctgtccttgacacaagaatcatgttagcactgcatggactaatgcaaccttgtaagtgctcccaggcaggaagtgctctgagtgccttcccatcccaagggatgtccagcatttcagggatccacagtgacaattcatttaagagctaggaaaaagatgtcctcacttttgttagacctacttccaaaaaaaaaaaattgactaacaatttaattaaagcatttgggatttctgtcccattaatctataggtacttgctctggatcttggtgaattatgtcagcggcctcattccataaaggtgcatgtaggtgagtgtaggtgagcatatctctgtgtgcctgtgggtctacacacaaacacataggcatcataagacaaggggtgaaatgaggtaccttaaatagttaaacactgagtaacggttatctccagggagtaggagagtgggagttagaagggcttccaattttaatgctatacatttttgtaccgtgtgaaacaagtgtaatttgtgtaattaaagaaaaaaaaaaggcccagtgtggtggctcatgtctgtaatcccagcactttgggaggctgaggaaggaggactgcttgaggtagaacttttgagaccagactgggcaacatatcaagactctgtctctacaaagaaaaaaagaaaaaaaccttagtgggtgtggtggcatataattgcagtcctagccacgccagaagctgaggtgaaagcattgcttcagcccagcagttcgaggctgcagtgaactatgatagcaccactgcactgcagcctgggtgacagaatgagactgtgtctccaatggaaaaaaaagcatatcatgattgtggttttttttttatcctgaagggatattctccctacttaagatcatcctttcattcctctagtgacaaatttcatgatgcgaaaaatgatgtgtttcatgagacacactggaaaggaaaatctcctttactgaatccaccaattcaaatgctaatctcctccagaaaaaccctcacacacacactccaaagaatgttccgtctggacacctcatggcccagtcaaggggggtgcatgtcttttaccatcaccctggccttcctctggcccatctcttctaggctgcaggcgttgtgtgccacaaacccagaggattctccccaagtgcaggttgcattctgacacgcctccttttaaaaatcccaatggttctccctatccagaaagcaaacagatgagctggggaataagaagctcaactcatagagccacaattcctctctgaagcttgtgagccatgagaagcttggcttcatgctgtatagaagcaaactcactggctgactggaatcctccacaggtgctgttttccttttgaaatggcttctcccatctgtatctcttctgttcttgtggactcccccgaggtcaccccctaccccaggagcggccactactccaagaatatcttgctttacttaattctacatccctttggcatctctttcctgaatttctcattttgctgtgcaacaatatcctaccacgggttttcacttggatgctgcagatatgcctgtcccctctccccaaatggatgacatactccattaggaaagagacctttctcctgtgtccccccgagcactcactcagcactacatgcacgagagttcagaggaaagagaggcaagttgttagctgacttccagaggatgagtgccttcctgccagatgctcctaatggaaagggtgggggtgtatctgttaacagccaggaagacaacggtgtaagaaaataaaccaagaacaaaattaaaaagaaaaaaagtagaaggatggaaacaaccataattacctaagtcagcctgaggaggaaggcttacttacaagaggaagacacagcttggacagaaagaggactagagcccatgtcatgtgcatggtgtccatgtcatggctggtgtgtgcttttcaacgaagccgagcagggatggagaacgaccttactaactcctcaaggtgggattcagggtgaggactggatcctcctgggttaggagatgacacaagtgcctgctaggagccactcactgggccaggtgtaaccacacatgctccaaggttgtcttacagcaatgccccaggtgttagtctgtttgtgctgctataacaaaatatctgggactggacacttgtaaagaacagaaatgtatttctcacacctctggaggctgggaagtccaagatcaaggcatcagcaggtctgtctctgcagaggactgctccttgcttcaagatggtaccttgttgctgtaccctccagaggggaggaatgctgtatcctcaggtgacagaggaatggaagagcaggccttaccctctagtcctttcatgacagccctaatcccatccatgaggctccaccttcaggacttaatcacctcctgaaggccccatatcctaatcctatcacactggcaattaagtttcaacactagatttgggggacacattcagatcatagtaccccacagtgggcatgtcagtcagtactcctactgtcctaaggggactggggctggacagcaggaggagtgctccgctgcagagctgtgactggacccatcctttctaccacacaggccacacctgctccctcccctcagccacctaaggggagctctggcacccatccacgactctccagggggccagggttctagtttgctttttctgctccagatggtctgagagggggaaagtagagggcaggaagttaacaccagagagcctggtgcaggcggtaagggccaagagatgcaggggagagccggccaagagatgcaggggagagccggccaagagatgcaggggagagccggccaagagatgcaggggagagccggccaagagatgcaggggagagccggccaggctgaggagcacatctgcaaggcaggctgtcctttctactggcccagataccatgccctgggctcttcctctaggaatctcatgcttagtgaaaacacatgggaaagcagagagctgggacaacagaaaaaactcctgggggattctacacaataaaaggcaccaactttcttcttattggtctttgaatccaaattaccctcgctgagttataatgaaatgtagaatttcatctgtcccaaggaattcattactgaaaggatttgttcaagatacaatggaggtaaccagcataggctatgttttaaacaagattttctgatatcctaagtgaagattttttttaagtaatgtgacatacatttccagttgtaatacggtacctatttttaaaatccctagaaaactcacaagagatgaaccacatgcattttttcctctaaaatttgtgccacaatttaaaagtttattttcctaaaataatttaagccttggctgaccgacagtttacatggaaccatgaagccatataagaaatgcctacagaactaactgctcaaaaggatttcccactgaggacatcgtaggcccacccaccttttcatagagagggccttccagaaatgtgatgatagcaaataggcagctgatgtgcgagtgcatcagggccactctgcctcgtctttcaagtccattaggtccaccttgtcttcttagtggctagactggcccaggcaaagagccctcctataccatgaccaggcagactcacctctgcttcataatcagggcaaagatacacttctataccatgatcaagccaaagatacacctctgcaccataatcagggggctgattccttggtgactggcccaggcagacatgcccccacatcatactcaggctgatgccctggtgattggccaaggcagacacaccctgcagcataatcaggctgattccctggttattggtctaggtagacacactcccgcagcataatcaggctgattccctggtgactggccaaggcagacacccatccgtcccccacctcaccccatcccgtccccctccccggccccctaccacccacccaccaacagcataatcaggctgatcccctggtgactgaccaaggcagacacacccctgcagcataattggactgattcctcggtgattggccaagacagacacacccccaagaataatcaagctgattccctggttattggcccaggtagtcatgtccctgcagcataatcaagctgattccctggtgactggcccaagcagacaccctcctgcagcctaatcacagcacacagcccctgcagcatgatcaggggctgcttcccctggtaatctaccattcactccggcaatttaacttgctaaatacctccttgggttcggctgtcgctctgaaagcatgtgaaaaagaatgacgttgaattaaaaagccctccctacagacagctttcttttctaaagagctcaaggtcatttccacaacctaacataccctaccagaaaatacttccagaaggaaaagaaacaaagtcaagggttatattatcatctacaccttaagaacaggaacaaagtagtaagtgagcaaaatgaacacctagaagaaagactacagcagcaagtttctctgaatctagtcaccagagcaatgacgctataaggtcaccttccgaggggaattcaggtttggcgcagataaaagaggagatgggaggagtgcaaaatgaatggaaactaggtctccaagaatgttctttcaggacagaagagctattttatcttcatttttgtgactggtataatattgagcagaaaccctaaggaagaacacatttctggattggaattaggcacggcctgtctttctgctctatacattcagtccaacattgtcctcctctggcttgctttcccttcaggttaagtatgatttctaataattttgtcttatcctacacctaactcgtttcagaataccaaagcggcacatcatctgaccactgtccctgcacatcatctgagccagcatcccagcatgattttaagtttcttctctccagcattaccttgtgcatttctgtatactcttcaagtcttctgcatgctctgctctgtcaaagcacagctaattgtgtatatggcatgtagatatgatcattttcaaagagagactttcagtattgaagtccctactcgcaactgagcggctagtaaaagttaaaataagtatatgcgtgtgcacacacacgcgcacacacaaatcatatgccaaaaaacatgatttgtcaagtcaaaaaaaaaaaagttaaagaggtcaaaaagtagtaaagaaagaaaagagagccatctagataagttctataggactgaactatctttgaagaactagctcctggctggttgttcaccttctatgagtttctatgattggcaccttacttaatctgatacctgctcgcttagaaagccaaatgaagacactacgttgatgggatcaccaagtagattccataaaacagattcactagcactccagccaaactaccagactatctagataaaacatttttttctttttaagaattgcagtagaacatatttcaagtatatcttagaatatagaacaaaaagtgtagaaagaaaaccatgtgaaaggcttgggtagatatggaagaaataagacacgtgcatgcctcatacatcatgagtgctttgtaaagtcacaaaagacactcagtcacagagtaactttatggacaaaccttagctacattaactaaaaaaacaaaaaacaaaaacactcatatgactaaaatcagaaatgcaaggggcaacactacaaccaatgccacaaaaataaaggagaatactatttgttggcatatcctttgacaacaaattggataacctaaaagaaataaaagaattcctagaaacacacaacctacccaaactgaatcatgaagacagagaatccctgatgattttgagaagggggaaaaaatgaagacatagaaaatctgaacagatctgtaagtagtaaggagactgaatcagtaataaaagaaaacctccccacaaagaaaagcccaggaccagatggcttcactggagaaccctaccaaacatggaaaacactatatgaaaaacaaaatacagatcaatatccctgatgaacacaggttaaaaagtctaaataagatattagcaaacaattccacagcaaattgaaaggatcatatacatgaacaagtgaagtttattcctggaatgcaaaaatggttcaacatatgaaaccacatttacagaataaggaaccaaaaaaaaaaaaaaaaacaaaaaccgcaattgatgcagaaagaaaacgcatttgaaaagctccaacaccctttcacgattaaaaacagtcaaattaaggatagaaaaaaaaaactacctcaacatattaaaggccatatatgagaagttcacagctaatatcattctcaatgaagactaaagcttttcttctaagttcaggaacacaacaaggatacacactcttgtcactactagacagtataataatggaagtctcagccaggcaattaggcaagaaaacacaacaaaaggcatccaaactggaaaggaagaaacaaaattatctttgttcacagattacatgatcatatatatagaaatcactacaattcaacatattaaaaaaaaaaacccaattgttagaaccaataagccaattcagcaaagttgtagaatacacatcaaacaaaaatcagttgcattttaatatactaacaatgaacaagttgaacagaaaattataaacaatcccatttataatagcatcaaaagaataaaatacctagaaataagagaagtgaaggacctataaactgaaactacaaaacaaaacactactgaaagaaagacacaaataaattgaaagacatcttatgcccatggatgggaagacttaatattaagacattcatagcatgcaaagcaatcctacagattcaatgcaatccctatcaaaatcccaatggcattttgagcagaaacagagaaatacatcctaaaattcataaaaaatctcaagggatcccaaatagccataacaatcttgaaaaagaacaaaatcggaggtctcacatgtcctgatttccaaacatattacaaagctacattcatcaaaacagtgcagtactggcctacatactaatagaatagaatagatagcccagaaatacactctcacgtatttgtcaaacgatcttcaacgagccagccaagactactcaatggggaaaagataagtctcttcaacaaacagtgttgggaaaactggacatccacgtacaaaagaatgaagctagattctaattaacaccatacacaagaattaactcaatatggattaaagtcctgaatgtaagacctaaaactaaaactccaggaagaaaacataaattaaagtttcatgaaattggaattggcaatcatttcttggctatgacaccaaaagcacaggtaacaagagcaaaattagacaaatgagatgacatatgtcaaattcatctaatcaaaaacttatgcacaccaacaactaagcgaaaagggagccagaatgggagaaaatggtcataagtcatatgtctgataacagtttaacattcaaaatacataaggaactcctacaacataaaaacaaaaacacaaaaatcaaaaataagcaaaggatgtgcacagacatttcttcaaagataatacagaaatggccaacaagcaaatgaaaagattcttgccatccccaatcatcagatatgcaaatcaaaaccataaagagatatcaactcacacccattaggatgactactatcaaaaaaatccaggaaatggcaagagttgatgagaatgtggagtaattggaacccttatagatttttggtgggaatatacaatggtgtaacaactatggaaaacaatatggtggtcactcaaaaattaataataaaattaccatgggatccagcaattccacttctgggtatatcccaagagactagaaagcaggatctcaaagagatatttgtacactcatgtttatataagcattattcacaagaacagccaaggtgtggatgccacccaaatgtccctcaacaaatgaactatgaataaacaaaatgtggtctaacataccatagaatattgttcagccttaaaaaggaggaaaatcctatcacatgctctaacatggatgaaccttgagggcattatgctaagtgaaataaaccaatcaaaaaaagataaatactacataattctccttatttgaggtatggagagtagtaaaaatcttagaaacagaaagtagaatggtggctgccaggggttgagggcagggcgaaatggggacttgttcaatgagcacgaagtttcagatttgcaagatgaaaaagttctggaggtcaattgtatagcaacatgaatagacttatcactactgaactgcccactttaaaataggtaaaatggtaaattttagtgtgtgtgtctgtgtcctaccacaattaaatttgtatatagtaactgtatggatgtgtttcaccaagacttatcaaggtaacttcatgtgcaaatggtgcagaaagacactagatgcagagaactgagtatcacgatgctcgtacccatgcctgagattcacaaacactaccattttcagtggatgcagacagagtgattacaaagggtgtgtgtttgcatgtgtgtgtgtgctgcccaggaatggtcaatccacatgtttggacatatgtataaatataaataataacatacatttcaaaagtaggtatgcttcatattaatatcattttaaatccaagattactcacataactgctgttttttttctcccctagcaccaggaattctaaagacagagtattcatcctgtatatcccagaaaaatcttcaaatagtctattttcaaggtctgtaatctagaatattcttgaacaaggagcgtcaggcaagcccgttctgattgaatgtcagttaacaagcacggagggaacaaagttgtttttcctttccgaagaaaactggatacaagtaaagaaagggctgaacggcatataaacacacaggctaaaaatgaattcgactttttacttttttttttttttaattaagcgtctttggggagatttagctgcttatcaatttgttaaagtttgaatagttgctgaaatattaatcctatatctgattttgaaaagaaaaaggcaaaaccatctattaaggtaaactttgaagacattctgtcattaacataatctttatatatagtaatataaacaatactcaaatgtttttggaacccagaaatcactgaaactaacgcatattattttaagaagcttttaaagagaaaattgaatcacagcatcccacagcatcagccaaactctttcaggagcaccaggagggacttagtttagatactgaagaaaagaggacaaactaagcatgccctatgctagactttaaaggtgatttacaaaaccattgctaatagtcacaaacataaccctgcaaacagcgaggcaaccgcacctggcatgagcgcagccgtggggaacacttcctttaacttcgtttggctttcttccaccagctcctctttggacatcgggagctgcaagacgtctattataatctgtgccgcctctaatgccttcttacccataaccagggactttacatcccagctgtatttcttgtcatagcgattacatatttcttgaaacaccactgaatacagccgttcagtatctgcaggaaaaaaaaaagagatttttagagtgcatactgtatgaacagtaagtttgtatcaggtccgcataaacatacactgtgtaggtctcattccatgaacaaaggcttttgtggagacctaagtgaacaggagaaaggcttgcaggtcattctcactaaattatactatgggcagcctcctctcaaggctgctggagttatgtctggagttgtgatctggaaattcagaactcaggagagaaatgaaatctgtattattgtgttttctgtttaaatgtacgtatttgaatctaaatatatccttggaatggtcaattccattcgatagcacaaggcatcattactcggtgttcccaacaacatggaagccagcaccagctgacaaagtccactgcatggcccactagtattaaggacatttccactgcccagtgggatgaatccccaccatgcctggccaggatgctgctgtgaagctcccaggtaagaacagaacatttaatgcacaggctgtcacgggatggtgaaagctgacctgagaattaactcccggctcggcacttactcagggcacagcctcagaaacatagtgagcctgcaggtgcctgctttcctcacgcttacacaagatgaacaggaatactgctaataatagtaccagtaccactaatatacgctagattacactacatacaatataataactagtactggctcacacccatttctattcatgtgttttttctgtatgtatatttaatatatacatagtatcaattgcactcatattaccaataagaatactactgaggatgctactacagtgaaataatcctactttacagaatgaatatttcagggcacataagtaacattctagtgccagcctcctagagcatgcttgttacacactagctgtcttccccactctgtctccagtgtgggcctagaaagattactttactgaagaaccaactaactgacctgctaggaggcattatgccaaaaaaaaagaaatacttcaacacagaggaatgtctaccaagtggaatttcaaacccaggtaagctccatggagctgagtgttgcctgatgacaatccccccaaggccccagtgaaggcagaaggctatcccaaggcctgggcagagtccttgtcttccagtctgcggtggcacagaggcagtccctgaacccgagaggctggaaatagccctgttcacaactgatttaagaagaagacacacggatgcatctgacaaaaatctggattcaaattcagttaggagactgaccacctgttctagatttagcactgaaaccttcccacagggtgtggagcagcattagcaggacgtagtctaccttgaatctgtacagctggacccaacaagaagtcctgaaaagagcaggcgatctcaatggcctttaactgtcccacaatgacataaacaaatacaataatcatccctaaatactagtttttttccctgtaagatagtatctgggagacccaggacacactgagggaagtaacgtgtacgcacagagaaggctatgtgtatccaagaggcatgtaagtcttcatactcctatgtatgttcacatgcttacatgcacataggtatgcatgcttgtctgtaattgcctcgatgtgttttgaaagttggcaaggtatgaactgcgactaaaggagagttatggggcgggcgcggtggctcacgcctataatcccagcactttgggaggtcaaggcaggaggactgcccgagctcagtagttcaagaccagcctgggcaacatggcaaaaccccgtctgtattaaaaatacaaaaaactagctgggcatggtggcatgtgactgtaatcccagctactcaggaggctggggcaggagaatcacttgaacccaagaggcggaggttgcagtgagccaagatcgtgccactgcactccagcctgggcaacaagagcgaaattatgtcttcaaaaaaaagagagttagggcaggttttaactccaaaatatctgctcctcccagataggcatgcagagagctgcctgcaccacacggcaggattcgctgtgtcacacatggaggaggccgggaaggtctcttgtgagccgctgcaatggtagggccacctgtgctttgtctcctgcatctttctcacagaaggtgaatggtcatctgtgtagacacaaggcctgggcagtcaatcatatccaccacctatatgcaaaattcctgaatgaaccaagggcagagtgctgctgtcttgagaaaaagttttccgtgtggccctgtatcatgttccttcagcagcatccaaactgcatctcttgactgcacctgcagcatcggctagggctcttgccgccttatactcagaggactgggctcactgactgctttggctgccacggtgtggactttgcctctgtgcacgcttctctcctggtcccagggctcactgcacttgcctggggaactctctggctcttcctcctgggatggggctgaggctgggcccagtccaccctgtggacactggagaccaggagaggctggttattgtggactgggctcttccttgggcttttgggtggcccctgccctgcactccccatcttccttcctccccctgtgcactgaccccctctgtggccctcttccctgcagaagacccctggcttctccacctcctgatggatactctggttttgactgctaacagcaacaagaagagccctcctctgttctttctctgcttttcttggcaaatccacccacagctgcatctgcaggtgccatttcattttcagcactataatatttttctccttgcttttctaccacaagctgtatttttttcatttatttttttgtttgtagacatgggatgccttgccctgtggcccaggctggtctcaaactggtggcctcaagtgattctccagcctcggtctcccagtgttgggattaaggcatgagcctctgcgcctggccacaagctgtattttattaagtttgctgtaaaacacaccaaacaaacctcagaacctccaccgttctggatactgcagactgtgaaggcccaatccctgaatggagggctcaaagccctttaggagagtacaaaagacaggactcttagaaaagtctgggctggtttgtagaagtcgaagttcaagtaacaacctgagtaactcaaggcttcctggattccatcctgcactcggtctccctacagaagctgcagaacagaaggaagggctggcccaccctcctcctcaacagctgagtggtgaaaagcctcctctaagggagggttacccaggcatgagcgctccttttattttcttcttctctgtgagggggagaaagagccaaggctctcagggcaaggagatggacggattggcagtgaggcggcacattttacttccttgagtgtttgttctagtagttgagagaggaagattgacaaaaggaaactgcaggcatcgaacaagtgagacaccactgtcgggtttgaaaagccgagtgaaggaacagaacagagggcaggcaggacgatggaggtgctccgtggaactctgactaaggcgagtgtgcgaacaggaagaaaggagtgtggacaaaggcaggaaaacagctgtatcctctaaaaatgcttccaacagtgtttatttaaagcttaaaatgtcatggagcttttaatttaaaagacacagaactgtgggattataaatctgtaggggactgtgcagacagacacttttcctcaccatttagataaaataatcctaaatccgtggaataagaaaggatctaaacaagtaattaaactcctcagatcaaatgataactacagctgttgatgatggcacacttaaagggacagcgttgtgaaaggaaaaatgctgaaataaaataaaggagcataaaacacttgcactagggccatcagatggatattcttccctgcttactaacaagcttgcagctttaacattgcttcagggtcctttttaccaggaaaggtcatattgtttttaacatgctagggccacatacactactaccctccttaggagaattagaaaatatcccttgtgactgtgaccactcccctcctcccagctggaatctgtgtggcatgttgagagcagcttctgtagtagctgcaagggcagcatggggagggggagagcctggcagggaggtggaagctctgaagaagctacagggtgccccaggctggggcccaaagactggcgggtgttttcatcctcagaggcagcctgagttcccgggggcttatgggaggcattaaggcttaaattaattcaactgttatggaagccctgtgcctggaggaagtctaggccgatggcctctaagtttctgtctaaggcggagactgggtaattgctgcaaatcaagtaacattttataactgaaaatgtatcttaaatgctcactaagtccgcccctgaggcacagtggttgatgttttacccaacaaagatataaaaagcgagggtttctccccaactgctctctcagggagctgtacctgcttaccatgcaaatggggacctatcttcaattttataactgtgagttgcgttatttacggggaaaacaccttgagccaactgtcattaagaagcacatatggtgatacggtttggctgtgtccccacctaaatctcatctgttacatgcagccctgtgaagagaccaccaaacaggctttgtgtgagcaataaagctttttaatcacctgggtacaggcagactgagtccgaaaaaggagtcagcaaagggagataggggtgcggcagttttataggatttgggtaggtagtggaaaattacagttaaagggggttgttctcttgcgggcaggggtgggggtcacaaggtgctcagtgggggagcttctgagactcattgtccaggagaaggagtgtcacaaggtcaatcagttagggtggggcaggaacaaatcacaatggtggagtgtcatccattaaggcaggaagtggctattttcactttgtggtttttcagttgcttcaggccatctggatgtatacgtgcaggtcacaggggatatgatggcttagcttgggctcagaggcctgacaatctcgaactgtaatccccaagtgtggagggagggaggtgattggatcgttggggtggtttcccccatgctgttctcgtgatagtgagatctgaaggttttataagtgtttgcaagtgcctcctttgcccctttctcctgctgccttgccatccccttctgccatgactgtaagtttcccgaggcctccccagccatgtggaactgtgggtcaattaaacctctttcctctacagaatacccagtctcagggaagttctttatagcagtgtgagaacagagtaacattaatacacatgggaaggcctgattttgctcctaccctcatgttcatacaagacctagggctttggggacccaagagacctgcagaaaactcccagctcagctgcacgccctgggacaagtttcttagcctgtctaacatacgatgtttattggagaaatgtatttaatagccgctgacctgcagagcgggggtggccttaaagctgggggtggggtggggcggggggagatgctttaggtgtgggaggtggcaggcagcccaggcagtgaagccaggtcctctaaagcctggtggtctttcgggaaaccccaactctgcagctttctagccggaaactctggaagctagcagccttgggtaaagcacctataaaatgaggatcctattcatactgcaggtcttataagcctgctggaccttggcttgcacacctctaaaatgggatcctaatgatgtagtcatgccacacaccttctaggcggttgcgtccatggagtgaaataatctgtgttgtgctctgagcgcttggcccagaattacctctgagcatcaacatatggaatcattagggaatgcttttgttaaccgtgagttatagggaattgacaagatctgctgtctcccttaacagcaacgctccagtaagagcaaacagctattgaacttgagaaactaaagtgcctcctaccaaatattttgcttaaaaaaaaaaaaaagcaaacaaaactatcaattatttggaattcaccaatacatcacacctgctaggcacattaaaccagcttcacaaacacttcttaattgccggggctgcagaggaacaaacacagcctctgttcccaattccataacccaaaagcttctgaaaacactgcaaaatctgtactgggctagcatgaggtggttttaatggtccacatttatcatacttagtgcgactcttcaagcacttccctatagaaatactaatggatttgattacgggtgctgcctgagaacgttctgtgtcatggaacatatgaattctaataccttttaaaaataacctatatttaaatacatctggctccatagattttgggtaacggattatgaacccgagtttgtgaccgcttacttatgaagttacactttgtgcatcttgcacaactgaatctacttaatgctttttttctccaaaactaatcttgatgtatcttgagcataatttttattcccaattacaaaaaagagaaaaaacttaaagccagtgttttgtgttagataggctagttccttaaagacacaaaataaactacaagaaaggctgatcttgagttagaatcaaattgtcacaatctgacagttatgaagatgttagctgactgtgtgtgtgcacgttttaagagttcagcttttctttttgagacaaggtctcacctgagtatagtagggtgatcacatcccactgcagccctgaccccccgggctcaagtgatcctcccgcctcagcctcccaagtagctggggctacaggtgtgcgccaccacaccaggctgatttttaattttttttgtagagacacggtctccctatgttgcccaggctagtcttgaactcctggcctggagtgatcctcccactatggactcccaaagtgctgggattacaggtgtgagccacggtgcccagccaagagttcagcttttcactgatcatgttacaaaagaggtttcttcaaaaagattaaagcccgtgtcctaagtagatccctcagatgcttctttccttgcttgcacttccttctgctcagctggggcagcagtggaggggcaggactgcctacaggtacaggtccagcagcccccatgctgctgcagaggaggttcccaatgttgactctggctggggaaatggtacaggggcagaactgcctgtaggtacaggtccaccagcccccatgctaccaaaaaggctcccgatgttgacactggccaggcccttgcaaacaggtcaggcccaaaagtttcaccatttacactagctgctttaatgagggcgacggtcttatgtgatggtcaccacactgcactgtagaatgagggccgagtagatgcaagtgagctcaaacaaagatggaggccatggtgtgggcgagtgcggggctggtgccaccgggcagggtgctagtcacccaatgagtgacagcttcacaaggccttagcttcctcggaagggctaagcaccttaatggcagctgaggaaagagggtcagcagtgttttgaatgtgtgtaaaaccacattttaaagtgaagttgctttaattaaaaaacccaacatccagtacattttgatagaagtggtggtgtcatttttctgaaccattttgacagtacatagtagctaatcagtaattgttcaatttatttaaaatgtacaccactagtattgttcatctaagatattctactgcttgtttcctaaacaccttgattctcgaaatgaggtccccggaccagcagcatcagtatgaagtgagatgctgtccaactacatattcttggactctgtcttattccattttctgctgcttattaacagaatgcctaaaacgtggtaatgtatgaagacattcatttcttacagttatggggactgagaagtccaacgtcgaggggacacattttgggagggccttcttgctggtggggactccatggagtcccgaggcagcacagagcatcacatcttgagggggctgagtatgctagctcaggtctctctctctctctctctttttctttttttcttttttctctctttgagacggagtctcgcactgtagccagggctggagtgcaaaggcgtgatctcagctcactgaaacctctgcatcccaggttcatgcaattctcctgcctcagcctcccgagtagctgggattacaagtgcacaccaccatgcctggctaattttttgtagagatggggtttagtagagatggggtttcactatgttggccaggctggtcccaaactcctgacctcatgatccacctgcctcggcctcccaaagtcctgggattacaggtgtgagccacagtgcccagcctcctcctcttcttacaaagccagcagtcccactcctttgataacgcattcatccaacaactcactaatctattaatccatgaacgaaagggtccattcatgagggcagagccttcatgacccaacacctcttagagaccccacacctctcaatactgccacattggggattaagtttcaacatgagtttcagagagaacaaacgttcaaaccacacagcaggccctaccccagatctacagaatcagaagctggggtgggacctagcaatgtgtgttttacagagccctctcagtgatttgaatgtgtgctcaagtggagggccactgacctggcattatgttttcatgtaagacttgtgctctataaagttgtgattttaaaaatatatcaatcttaactaagaagtgcttaattgtacatatacaaatgtacaaattagtacaaattaaagaataaacaatctatgatgatattcatcccagtacttactttcctttatattgtaccccattatggtttagttacatttattttcctatttccttctgtcacccccaaatcagacttatgttaatgtgtttgtaatgaaagagagatttaaaaataaggacccttaaacatgccccattctttctcaagttaactgcagcaaatgattccaataaattggagttctcagttaataatagttaattaggcctgcatcaaatgagatgtagaattcaatgaaagttatgcacagcattctcacggacatggccagggtaaagtgcttatgaagacatgccctaataagctagctcttttaaagaaacatgcatcttggaataaaaacactgacaacttaatggaacataccatatgcaaggattagttaattggctcaactctcttaaatggaaatcaagaaaaaaacattttctaggctggaatcattacatatgaaatcacagttgtccttggtgaccttcttttgagagtaactactgaaacttttacatcgctatatatatatgttctaacataagatcctccttttcttctagtgaaagcatttccagctttatgaaagatattggaaaataagggtcaatttccaaaaaccaactttcggtcagtaagtagcacagcaatcctaaaaactgagctttgaactacataagctaggaaatccagcccttcacagcagaaaggtttcagccttctgaaatggctagttcagacagctggggttgccttgggctttttttgaccttcttaaccagccaagcttacttagtaatccctagaaccctaacagcaaaaactgttctgaaaggtcactgtgggcaacagctgtttcacattgctctctatgctcctggcacacagcacagagcccagatcctgtcggcagcgctatttcacttcactcccagagtcacgtccacgcacgtggctgcaagggggagctggcctaagcctgcagtgaggagtgaggccaaaccacaccacctctttgcatggactggaagagtctatctgctcaaagcatcctagtgtcataggaaggcattattacatttgcgggaagacaagagaagcccacgaaaagaccagattctggtaaatgaggaggcactgagttaagttataaagataactgtccatgtgtgaaggtaaatgaaaatctcttcaaatgagaacgagcagaggctattcattcagagattgcatagcaagaaagttggacaccagcacttgcctttggcagaagctcaaatgcaggttggggagctgggaaagctttacagttggaaaagggaggcttcaggtgggccctgactggaggctgttgtgggggctgggggtggctcactagaagtgaggcatctcatgggattggcttgggaaacattttggctctctggctggcggtggaaactctgtaggcatgcctgagacaatcaagtcccttaaaggagataagtcattgagctggccaaggaccctgggctgccgactagactcatgggatgagtgtggctgccctcctaccctggcctgcctcctggtttcttcccagccaccttggccatccgttagcaaacccctagcatgttcccaggtggatggtgggccaggcacttctctctgggccctgggacccctgccctgctcagcctcattcaccattctatattccacaggcactcctgcatcccttaccacatgcccttgcccagcctttggtaatgaccaatcagaatgaactaatctccatgccccctctacgccaaaaagaccctgcatcaggtcagtgtttatgaggagaaactgcattggtcagtaatagagtttatatatttattccctcccaaatctcatgctgaattgtagccctcaatgttggaggcagggcttggtgggaggtatactgatcatgggggcagatccttcgcttgggccatcctccacttggtgatcagtgagctcttgctctgagttcacatgagagctggtggtttaaaagtgcatggtacctccccccaactctctctctggctcatgcttttgccatgttacatgcctgctcctgcttacccgtccaccgtgattgtaagcctcttgaggactcccccgaagcagctgccactatgcttcctgtataacctgcagaaatgtgagccaattaaaccgttgttcttctaaattatctagactcagccatttctttaaggcaatgcaagcacggcctaatacagaaaattggtaccagaagtggcgtgttgctacaaggatacctgaaaatatggaagtgactttggaattgggtaacaggcagaggttggaagagtttggagggctcagaagaacacaggaagatgagagaaaagttgcagcttcctagagaacagttaaatggttgtgatcaaaatgctgatagtgatatggatggtgaagtccaggccaacaaggtctcacatggaaatgagaaactgagaactggaggaaaggtcacacatgttatttcttagcaaagaacttggctgcattctgttcatgccctagggttctgtggaagttagaacttcagggtaatcctttaggttatctagcagaacaaatttctaagcagcaaagcatgctatgtgtaacctggcttcttctaacagactacgctcagatgcagaagcaaagaaatgacaaagttggaagttatatttaaagggaaggtagagcaaaaaagtttaggaaatatgctgcctggccatgtggcagagaacgaaaaagctttttcaggagaggaattcaagcaggctgtggagcaaccacttgccagagaaatttgcatatctaaaaaggagggaagtgctgacaccaaaacagtgggggaaaggtctcacaggtatttcagaagtctccaaggcagcctctctcatcacaggcccaggggcctagaagagaagggtggtttcctgagccacgcccagggcccagctgcctcaggacactgctcccctcatccccactgctcctgcttcagccagggctcaaagggagctcatcctggtgctctgtaggcacacaagccacacgccttagtggcttgctttctgtatagcctacagaattgtgagccatttaaacccattttcttacaaattacgtggactcaggcatttctttatagcaatacaatatgtcctaatacaatcaggaaactttaacacagtctggagaactgtcacacttatgtgggcttggatgctgacatatttgggttttaccctttgctctattctcaaggcctgccattaccagatctaattcatgtatatattttcttatcccaatgtatagcagaaagacactgtgatttgcaggaaacactccaaaactatagaacagtgaggctgagtgtgagcaaaaatcagaggtaagtatgtcacaggaaaaggaaatcaaagttagtgctgttaaagtccaaaaacacaaaatatattcctctcttttaggttttctgcaatctccatccaacttgccttccatgaataaatacctgtctataaactaggagaaaacccaaacctacctggttcaaaatttaacggtatggtttgcttgttttggttaagtactgtactgcacccgtatgactggctcactgctccttgctgctatatgtgttatttcatttacactgtggaaactgaagaacaaaactgtaatgctatgaactagaatccaaacgaacctaaaattgactttccccttaaattaaaattcagtccaggtttccagtgactgagcacagagccccttctgagacaaatatttctaagttgggaccatcctgtgtcacacaagtaaacataacatgtaatattgattcaaatcatagatgaaaaatctcgagaagccagatatcccgggtatgcagaaatggcacatgctcagaatacaatcagtttaattaaacaaatgttgactgggtacctactttgtgctaggcaccaagaaaaatgtgacaactgacatggagacagtccttacaaggttaaataaatcagtaatcagaaatgataagttcattaatatattttgaaacaaatactgacaaagagaaaccttgcaaaaacagtgattaagaatacatcactatgtaaatcagaatgtttttctcacctgaagacctatccatatgtcaccttcagctaactaatttcaatgacctattatctaagaaatgtcctctcagacccgaaaacagaagtcaggtagaagcaatgttacaagccaagcacaaattcctagcagtatgagaagggagaagacacggtgatgagaacatcaaatgatgagaagtgcaatcatctgttcttcaacaaatgttgcaagttgttaacacgctgtgagcactaccgcgcttttccctacaaccactaacgtattttgtgctttatatatacaggatagaaacttccacagcaccgtgctgtcactgtttcacctttacaaatgagcctgcatgtaaatgctagtgctttctcgtgtttaggaatttaaaggactgaaatgaataattaagcataaaattaagagtctcagtaatattgcctcaaatgagaagcttgctctagtgggcttagaaaaaagtatttaagtatttgatatatcgcttcctgtagctgtaagctatcatttttgaactgtagagaaaaaataataaatatgattgcttaaaatagagatctgtaaagataattgagtgatcatctgcaaagtaaaactcttgattagcatgtggcataattcacaggcattagcaattctatttaataggtatgggaattggtctaagaatttttttctcatccatatttaaatttaaaaaatcacttaaaaaatgaactggttcaaaaggtgttgctagaccatacctatctgtatgaaaacatatctgtattggggaaaaatattgatccctaggatcataaacctctgtaaagaaaacaggagaaaaattcttggaggcttggattatgtgaaggttttatacatagaacgcaaagagcaagggtcgtacgagaacatatggataaaggggctttcttcaaaattaaaaggcacatacacataagaaagcaaaaggcaagctacagactgagggaaaatatttacaatacatacatacacacatgcacacacagacacccaaaggactcgtatccagaatacgtaaggaactgaactttacaactcagtgatgacgcaatctgcagtagagagaataattgtcccccaaagatgtccaagtcctaattcccagaacctgtgaatgttaaattccatggcaacagggaatttgcaaaagtaattaagaatcttgaggtggggaggtgaccctggattatccaggtggactcaatataatcacaaggtccttataagaggcggccaggagggagagagagaaggtatgaagaggagcggtagtcagagcccaggaatggcggccactctaggagctggagaggcaaggaaacagccaataccccacagcctccagaaaggaacacagccctgccaataccttgattttaccaactgagaccaattctggtgtccagaactgtaagacaatacatttgtgttgttttaagccactgtttgtgacaactggttacagcagtaataaaaggctaacatagcaactctttgggcagtttctttaaaagttaactataaatttaccatacaatcctcaggaaggaatcagtccagtcctacatgtttactcaagaaagaaaagcctatgtttacacaaagacttaggcacagatatttatggcagtttcatttgtaacagctaaaaactggaaagaagccaagactgtcaataggtcaatggatattcagcctgtggtgcagccacacaactgaataaaaggcataaaaactactggtacacacaatgacatgagttcccaaaattatgctcaatgagagaagccagattaaaaaaagaacatatactgtgtggttctatatacaattctaggaaatctttaatttcagaagcagaccagtggttcctttggcatggggtcagagagaggcaggggttgcagtgggcacgtgaaacttctgggagttgtgggaagatttgtcatctgggtgtgggaactgtgtcacggtaactgcatgccaaaactggtcacacagtatactttatgtgcagtttattgtactccaattaaacctccataaagttgttttaaaaagaaaaacttattaggttgggaaaaaatgaacagttacaatgttaatagaagtagccctgaatgacaaaaaatacccaccgaccatcacaacactcataaatgacccctggaatccaatgtgaggaaatcttcctgggacttctcaactccccttcataaaatgtgctttctttattgatggaatccctgaaggggaccctctgttgagccttcttagggaggaggggatgcccatgttttggggctcttgtccccagtgccatcctttctggggcactggtgagcgcacaaagtatggcgccattccttccctggagcttcagggtgccttccctccacgcccacacactgcaggctaaaagcaggtcccactactgttttaactttaattatggtggaggtgggattgaagggataatttaagagcaaggtaccctagttgacagaaggtgacagcctgtcccaaacacagagaacaaggaggctcccagagagaaaagatccacaggtaggtggccaaagggtacaggcatatagggaggagcctggggtcagtgtgagggctttctaactagcatgcagtgtgccagggaaccccctgcgaccataaggagggtgggtccctagcttgggagaataaataactgttgatttggatttataaattcaggagagctctaccatatctttaagttgagctatccaacagagagagtcttaaatcctgtagatattggggttaaagaatatgttagctgggggctgtggctcatgcctgtaatcccaggcacctgggaagctgtggcaaggaggattgcttgagaccaagagttcgagaccagcctggacaatacagcgagaccctgtctctacaaaaaacatttaaaaattagctgggtgtggtagcatgtgcctctggtcccagctactcggggagctgaggtaagagaatcggttgagcccaggagttcgaggctacagtcagctatggttgcaccactgcactgcactctatctagcctgtgcaacagagtaagaccctgtctcaaaaaaaaaaacccatatatgtgtgtgtgtgtgtgtgtgtgtgtgtgtttacattcatttgcacacaaatctgataaccataatgaagaggaaaaagcccaggatactgaataatactgctatgtacatgcatattgttctctctcccatttaaaagcacatatttggcagtagatgaccagtgcaaaaagaacttttaatttttctggtcacagagatgaattggctctcccttcctgtgtacttcctttccttctcgcttttcctacatggattttttcaaagcagaatctcagaccctgtagatgctgatcaaagaatgctttcctgtttcctttaagaaggcagcaggtatgtgatgaaataacagattgatatgctttgtaaccaccccctgcccccgttttgaatctgggctccaccagcaagagtcaagcttttttccagggcaaacagctatcccgcgcaattgctctgagtgttagggatgacttataaagactgtgtggatacagctggctcaaattcagattctcatcacccgattacatgcacctttctctgaacagaccttctccccaggtcaaactcacttgagattattactagagttacgttatgagtttgtatatattttccttctcaacatactttcagtatttgaataaagattaatgaatcaaagttctaacttgaagtatttataccaaaaattgttataaagttttactttattttttgttctggaaactatcaagccagatttggaaacacttaaaaatggaacattttttatccagggttttttggggtctcattatccaataaccaattaaaaaaacgtctctggtgttctttctaaatcgtgctaagttaccttaaaatgagataaaggacaagaatgctgtaacacttattttttatactttaaggcaatggctcacaactgggctttgcttttgccccttgggagatattaaagacagtataaacgttatgttttgtttgtaaatcaaattttgtgtgaagtaaattataagtgttgatgggcaaacaaggtataaacatgtaatttgtatgacaacagcaacagaaataagagagtcggaaacggaactacataggagcagaggtttgtgaactacttaaaataagtggttaagatgtttatcatagtccacagagcaatcactaagaaatacagtaaaggacagaataattaaaatggcacgctaaaaaatatctaaagttaaaaaaggcagtaataaagaaataaggtaacaagaagacttaacacagaaaacagcagcatgccgcacgtaaatcctgtcttaccaataatcgcattgtatgtaaatagattaaaaacgccaattaaaaggtagagattgaagaatggatttaaaaaagacatgatctaactatatgatatctacaatagagatacaatttagaccaaatggtacaaaagcattgaaagtaaaatgatggaaatgagattccttgcaaacaacagcccaaagagagctgaagtagctatagtaatatcagacaaagtagacttaggacaaaccatttcactaaaaaaaaccaaacaattttaatggaaacattttatagtgataaaggtcaccccatcaagaagatgcaacaattataaacatatatgaacctaaccacagagccccaaaatacaagcagcaaaaactgtcaaaactgaaaggggatatagctgattccaataatagtagctggagatttcaatgccacacttgacaatggacagaacaactagacggaagacaaatacaagacttgatttaatccacttacacactgtaaaccattaaaacttgacagacatctatacaaaactgacccaataataacagaatatacattattcttaagtgcacatggaaaattatccagaataggccatatgctgggtcataagtctcaataagtttacaaagaagtgaaatcatatattttcccaatcaacaatgaaattagaaatcagtaactgaagaaaacttgggaaattcacaaataatgtggaaattaaacaacatactcctaaaaatttgtgggtcaaagatgaaattatgagagaaattaaaagatactttgagaagaataaaaatggaaacacaacataccaaaacttatgggatgcagcaaaagcactgcgtggagggaaattatggctacaaacgtctgcactaaaaaagtatgttcaaagaggtgaaacagtgctagctttgaagatgagtcaagacgtgtgggtggcctctaatagctggaaaaggcaagaaaacattccccattagagcctccagaaacaaacagagccttgccaacacccgattttaccaagagattggtaaaatcaggcctcagtttgtggtaatttgttacagcagcaatagaaatagaaggcatttaagaaactttggctatcttgttgccaagtgcggtggctcacgcctgtaatcccagcactttgggaggccgaggcgggtggatcacgaggtcaggagatcgagaccatcctggctaacacggtgaaaccctgtctctactaaaaaatacaaaaaaattagccaggcgtggtggcgggcacctgtagtcccagctactcgggaggctgaggcaggagaatggcgtgaacccaggaggcggagcttgcagtgagcggagatggcgccactgcactccagcctgggcgacagagtgagactctgtctcaaaaaaaaagtaactttggctatctttttgtttttccctcatcgggctactgtacaatgactttcaaacatattaaaaaaaaacataaaaaaaacataaaaataaacttttaaacgtttcattcacaacctaaagtcaatgaaagctacaggcagagtttacagaactatgtgtgacaatttatctgaggcagttcaccagtttactaaaaaacagcacagtatagtcctcacaaaatgaaaacaaaccccagcatgctaggccttcgttattgctacagaataacacatatgtataaatactattaatcattttttttcccatttcctattgatgcaccatgatgcttccatttagctaatggcaataatctaaattctttttgaattttaagagctaaatatacaaacatagagctctagatggatgtcactttgcctaaacccttctcagagctagttttccagtgtctgaggcattatagattaatgccaaacccacatatccctaggccttttgaattaatgaaaaccagcaactgtcctccacaacatgcacaaaggctttatttaaagatcatctttcctaccaaaactcaatcacttctattctttttcagtgaaggtgacaggccctccgctacccttccatttctatctgtatcagtcattttcaggctgctgataaagacatacctgagaatgggtaatttataaagaaaaagaggcttaatggactcacagttccacgtggctggggaggcctcacaatcatggcagaagatgaaaggcacatctcacttggcggcagacgtgacagcgagcttgtgcaggaaaactccttttcataaaaccaccagatctcatgagacttattcactatcacgagaacagcacgggaaagacctgcccccatgattcaattacctcccaccaggtccctcccacaatacacaggaattgtgggagctacaattcaagatgagatttgggtggggacacagccaaaccatatcactatccttactcttagcattccctatcaatggcctgttaggaattaccaccagggatatatgcatatatatgaagataatgccaaaattacatttttaaaaaatttagggcaatgtaaatcatcatgaaatgtaagaaaaacattaagaatataaacagcaatacacagtacaaagtgcttctctcctaaagacacatgagtgaccatgtcacaggaatatttctttagctgttatgcttttggttcacttatttttgtgtgctggtgggggtggaggaatgtcagaaaattcagctgtaaaaagatgataggagctgagaatggagaaacttctctggtgatcctctaactgaacagacctgggccatttgctgcccaccttcctggaaaggtctgcccagaaattcaggaaaacattggtccagatggcttgatccttcacacaatcaaaaatcttagattcttgggactgtaagtttgctagggccgccatcacaaaataacacaaaatgggtggcttacatagaaattaattttcttgcaattctggaggctggaagtctaagatcagagtcagtcagcagggttggtctcttctgagacctctctccttggttagtagatgctgtcctctccctgtgtcctcacgtggttgtccgtagtgtgtctgtgtcctaatcgcctcttataaggacaccagtcccattggattaggacattgtttagccctttaaagacctatctccaaatatagtcacattctgaggtcctggggttaggcctccaccacgtaagtttgagggggacatgactcagcccgtaacactgggttattcatcttcatctacttggtttttttaatttttatttttttatataaaaggcaagagcagtttgttaatggaaggtgctatcttaacatggggaagggatgaagaagatcactaagaaataaggatcaagatccttttttaaagaatacatatttgcatatgtataaattggttcgagtatctcagattttatgtatctaattctacctaggatttctcaaaagaaccaaaaagcatagggtatggttcctgctatgcagagtgtacctctggtacccaaagtagcaaagtgggaattatattgacaaaaggaggcatagcttggtaactgcaggcacagctcaatttaccaagccttccacacatgggggcactgaaggatgaggagtcagaaatgctcactcacattctcaaagagcaactgacctttattccacagctccaattaccagggaaggacagctggtaagagaccgccttttctttgaacagctaggggcttggcagacacataactaaggctagcacaatgttctaactatgtcagtaatgtggccctatgaggtgttactgtcagtcaaactacatgaaagatatccagaattcaatcagatatccttttaatagctgtacctacgacttgtactgacctgagaagcataaaagaatggagaattcctcccaagttcaaagattactggagttaggtggaaagatatttacttattttaagaaatgaaaactctaatcacctgcatgggaatgtaaagtacctgggagggaactgttttccttaatgaacagacatctctcaactcccaaatcatttagagggatgcttaaaagcagcaagaccactgaatacattttccatgttacttattattttattacttgtactttttaattgaatttggcctatgagaacaataatgctaataaataaccatttaaatgcatacctgaattatttacatttgcaatttaaggcatgatcagaatgatgttgaaatattaagaattttaggttcatcatttttataaacttattatgtttaagatgattattgactaaaagagtttcattctttaattcagacaactgaagtactcaacaaagaaataaaatatattagagttttgtaagtgtgagttaacagtataaaggtgaagtttatgaaaaaattgtaaaggttgagactcaaacactgttatggcctctgaacagtgactgttaacatttactagattttttgtttttggtaacagagtctcactctgttgcccaggctggagtgcagtggtatgatcttggctcactgcaacctctgccttccaggttcaagcgattctcatgcctcagcctcccgagtagctgggattataggcgtgcaccaccacacccagctgatttttgtattttttgtagagacagggtttcgccatgttgcccaggctagtcttgaactcctgggctcaagtgatccacatgcctcggcctcccaaagtgctgggattacagatgtgtgccaccacgcccggccaacatttactaatttataagcagaataagcagaaagtaaaagcttagggaaaagaaagttttgaatctaacttcaatagtttataaatgtttagaattaaagggtagtggtgaactcaggacacaagaagtcctacagcaatactaagcacccacagtacaccatgcctgtgtgtgtaagctcatcagaaagcagagcatgaaaaagggctagggacccaatggcacgggcggcagtcgctgccctggagaattacactcctggcattccaagctggtacccaaacactttcccataagaaataagagatggtcagggacattcggaacctcctcaggtgcataaaggttgtgtgaatatgggagtgaataacctctagttttaatgtttctatctggggaaatgtgttctaactatccaagtactgcacaacaaatttatcttacattctgtgtttacattctagtgtagatactaatgaatgattttgcggataaaaatcaggcagccatcagatgaaacagcgggggcccaaggtgctcaacccataaataagcaagaattcgtattttttatatgagattataaatctccagcccaaacccccacgatgtctcttttctgttattagtcactatgaataaagtataattgcactcaaatgcagctggtttgtgagctcctgcaggtgaaattacaagctaaaacatagtcctcatgggggaggaaaggaccgagtacccttagccttcgggcaaccattgctttgaacataattagagaatgcaagtatatgggaaagaggtgctaggatataattagttataccacagcatttcattaccaacatttaataacatttaaagatcatagagcacatacaaaatgatatgccttcttcctttccattttatattctcatactggctgcactatatagaaaatgaggtgtggagagaaggggatctaatatattggctccatctagtccctgctctgtcatgtaacatgtgcccattcattcaaggacataaaaattacctgaagcttctctgtcaatacacatgccatgttggacccgtgttctgaatgttgagactccagcagtcaacagaacaggcctagagcctgacctccatggaggacatgttgtagagcccaaggttgctcagcattttgctgccagccccaacagtgtgacgtacagctcttctctgtctttgagccctgagcattctcatacctgaggggatattccctgaaggcaagaggaatgggatgcaacaacagtgaccagtgaccatcgcctctcagggaagtgccatttactaatttattattttattgtataactctctgaacttttatcttagaatatgatttcattccttattcaaaaacactgaccttttaaagatctcacatctgggcaagagaactttaatgaaggcaaaggaaagagccatcctaaccttccttactactagaaatgtcatactcagacagcacacagcatgcagggcaccgtcccgctctaacaaaaatcgaaagggtaagggcaatggctgggtataaaactacatactagaatatgtgacacggagcaccgcccaacaaatggttattttccatgtttatccccggcatggtgcgtggagtccaaaggttattccaaagcacttttcttttcactcccttctctggaaaatcaactgtgtttggaaatcatggtgcatcccatggttaaataatctccctaccccaggaaggaggactgggccctctacttctccctgacatttacaacccagctgggatgagaaaaggagaagggagtagaataaaaggacttcaaagttgtgagttcggcacccttacgtgtcaacaaagattaagcctgaagtggcaggctttcacacagggttggggggattcaggttttgatgcagggttagggggaattcggaggctgattggagaatgactagggatccagagctgctccctttgtatcagagatgcacatactacacacacacacacacacacacaaaaggaggaggaggacaaaacatggtgggcatatggctaaatttccagacccttcctaggctaattatccaactgtgtgtgtgcatgtattctctctgaggaaggggacttagaaataagtttaaaatggcttccaggggccaggcacagtggctcatacctgtaatcccagcactttaggaggccgaggcaggtggatcacttgagtccaggagtttgagaccagcttgggcaacatggcaaaaccccatctctactaaaaatacaaaaattagccgggtgcacggctcgagaccagcctgggcaacatggcaaaaccccgtctctactaaaaatacagcaattagccgggtgcagtggtgcacaccagtagtcccagctacttgggaggctgaggcaggaggatcacttgagcctgggaggcagaggttgcaatgagctgagattgtgccattgcattctagcctggacaacagaatgagactctgtctcaaaaaataataataataaaagtaaaaactaaaatggcttctaggtactgtagctgttcaaagacgagtgtaggtcgatggccacctatgtcagttttcttcatgggttaacggcaccaagagttttgtttgtcttaaatgggaaatcatggttgtttccatcaatgctgtcaacctaagaggtgcccagtctttcagtttcctgaaactcaacatgtccaaatgcctaaaatggaactcatccctattttcaggcctcacagcttcctctaatttcgacttcaggacaagtcactgctattcacctgccttctccctcccatccctctatgcccagctgtcagctgaacggcctctgaatcagccacttttcttcctttcattccaaccctgtgggtccttgtagtcagttgaagggtggctcccaaaaatatatgtccacgtcctaatccctagggcccgagaatcggaccttatttggaaaaaagacctttgcagatgtgattaagtgaaggatctggagatgtggcactctgtattatcccggtgggccctacatccaatggcaggggtccttatttataagagacaaaaggagagaagagaaggccacgtggagagaagctgagaccggagcgatgcagctacaagccaaggaaaaacgcagccctgctgatatcctgacttccaacttcttgtctccagagctgagataaagtaatctcctgttgttttaggccccccagtttgtggaaaactcatgcagtccttctatcgttcatctggacaatggcaacagccttctaccagtctccagtgtctaagcgccaacagtccacatcatcagaagcaccacccttctagacatcgtgtgctcgccaggctgtatgatggctacgagataaaatgtgaattccttagcctggcacagggctcgccgccatctgcccttggcaggcctttttacctgtgctccgcctctcaccgagtcctcttggcctgaaataccctcagcccttcctcctccacctcagtgactccccaacccttccggtggctcatttgggatgcgtttgctctgctgtgaggcacatccgactggccaacttccttttcctggctcccaagaaaatcgagttgtctctagcagatgaatgatgataatatagaagaacagatcatgtccacccccgcccccgtacaaattacagcacccctgcctgcagtcccctgaagaacagggatgctgttgtattcatttgactcagttgtctcagtatctggcaactggtggtcctgctgtgaaaagtcagtcgggttcatgaatcgaaggaacaccctgaacatctcaatctctcctccagagccctcatagatccaacttaggcttttcttaaattccttttgaacttaaagctctctcctcaaattctccacaacagaaagtgccacctgccttccgccatctgaatggagccacctaaatgctgggaatgttaagccatttattgtaaccacctctactgcttggctacctgtattgctcaatgacttgaagtgggcaactttacaggcttttatcaggttgctgtcagagaagcaaggtcagcacaactggtttaacaagatgagggctgagataaggctagagcttccagaaaggaacaagtcatggagccacacccaggaataactcacatatttgcattaagaatgcagaagcaatgcccaggagagggcagcactgacaacgcacacaaagtctaaggtcattgtgatccacatgaacaaggcttctcttagaaagtacttaagggccagtttatgaccaaattcctttgacaaaggaatctaggaaaatacactaggagaaaaacctccaaaaacatcctggtgaaggctatgctctcaccaaagccacctcatgcaaatacacctgggccccagaactctgcgatttcaccctcatgagcatcaaaaccccacagccaccactgatctcactgcaggtaaccaacagaactgcatgtggtaaaggttctcagtaaatattgctattagatcagaaaaaagcctgaaagcctgaagcaggaaatggcagctggaatgacacagaagtggctttgaaatatttataaatcaggaggtgcctggaaggtgtgggtggggatggcaaggaattgaagactggaagataactcccagccatctgctgtggggctttcggggtttgctgcctggtgtggaatgcaggaaaagagcagatctggcagagaactagaggccccgtttaaaatacaatgcttcagagctgcctcttggccacgcgggtaggaagagcctgtggtcactgggaaacgtagacaggaactcaaaagaggtgaggcccagccagggaggtcaaggggtcatcagagcagaagcatgtgccgaagccatgagctcagaagaggtttccacaagaggacagggcccataacaaagccatagggacgccaaacaggcaccaggaggaaaagaaagctatggggaagccagaagaggaactatccgtgaagccaaagagaaagatttccaaggagggtgcagaagcggcaaaggaagccggaagttctggcaatttaagaaaagggtgccctctgcacctagcagcacggacatcactgctacctctgtcagaacaatttctgtgagtggtagggccaaaaagccagctcatagcgagggaaggaaaatgggggagtgagttcggcaaacacagcccactttagcaagacacttggctgagaagagaggcagaaagacagacaagccagtttcaaaacacgtccttaaaatcgggacactcactagtcccagccagcagaagcaataaacacagcaacaggtacatggcatttattattctgtattatagatgtgatcatataaagatgttaatttcttcaggctacttcacagaagtcccgtcccctccctatgagaggatatgattttacttgatctcagcataaaccctaatggtataaggggatgcataacatgtgcagatggttacatctctgttgcaaaatcatgttaaacagtgcaatggggccgtaggtcagatatgaactgaacatgttctttaatctgattatattttggtaggcatgcaatatcctggaagatgtcacacattgcctgtgatatgctgcaaaccatactcggggacacagaggatgggtaattttactaaatcagtacagtaagtaagttgtcaatgagatgggccaggcttcagttaccaacgcagctcatgtttcacctaagctaaagtggttttgggctatcagtagagcctctcaatcatcaatgagataaaattaaatcagctggtaaattagatgtcagctggtgagagtttcagtatctacaattgtacctgtacctgtgagggctggcaaaactatgaacaaatggtaccaagactgctggtaactctaagtgatgaagcgcccaggagtagaagttagaagtgctggattttcactgggattttcctactattcatagctccccaggttgtcctgcctcagtttcactgtagacaggacaagtcgcctcaattctaaatctcaaatctgattatgatttcactttaaagagcttgtcacgtaagcacaccgtatcaaaagctgatgagcagtcagcaaaatgccagtactaaacacagggtagcaaatggcaaaaagtaagctagacctttatgtctacaggtattgtaatggcaaaaaccgtcattactttagcaccaacctaaataggagtcatacaaaaagaaaaagcagatataaggatctacttaaccaaaggaaatgctttatgttaagataaacgaggcaaataagagatgcaaaaagaaaataagaatacactaaagcactgtattaaaatcagcaaaatgtttagtatttaatgaaatccatgattatttgaggccagaacagaaatatgtgtaacactttgctgcacaaaatgtttctacgataaccaaataattttccttttaaaaagcaagagttaaaaggttgccaagctactgcaattgaggtaaataagggaaagagaagtctgcgtatgaacaggtaacctccagggaatggcagggatacaactgggtccaagagaacatacatgagatgtgggcagcacttcaggaagtcttttcctcccatcactcagttcaagctccaacctccagtttcctaagaccttggtagcctcagagtaaaaagggatgacacagacccagtaggcagaagtcagctgagaggtgcagtgagagcccagtcacagtagctcctcaggatcagctataaggctacttaggagcattttctgtcatgtctcatcagcatatgatgtgacacacaggtaccagtggctactctttgaagaattttagaaagcttttattccttttataagcatcatgccctgacaaactatcggattccaattaagacatcaacaaaagacaattttcctgacatctgtctaaatcctgtagacatttgtctacaaatctcctgcactatgagagagacgaggaactgaaaaatgagcactaggaaatgggactcttccttcagaatgttttctgctataatacacattgcaatgaatgcattgccactgtaatgttcgagagagctgaaggttctgaaactatttcttccatatctccaacatcaattttctaaagatgcatgctttacattcttgtctcttaaacagaattaactgactactacttaatactgcttttggggttgtttttagtggttcatgcttaagacttaatcttccctttcctattttaacttttcaagtatacagaagagtcaatagtaggataggaaacatctacataccctatacctgcacgcaacacacctgaaaacatgcagatgccctaactcttcattcctctagctctctgcacgtttctcctcagaataacactctcctacacagccataataccactgccaaacccaggcaaatcagcaatatttcatagtaccccctaaatagcacacatcacacctctccaattgtcacaaaaatgtcttttatagatttttttccccaatctaaggtccactgaatttgactatgtccctttagcctctttaaaagtggaaaagccagcccctattttttccccatgatagtcaacattttcaaggacccagtccaggtacctggtggaacatcctacattcaggatttgtcttgctgtttccacatgacaccccctcccgtgttcctctacccctctgaaactgctagaggtccagatggattcaggttaaccatttctgaggtcacttcagaaagcacacgtgacgtgacatgctgctttctggatggcaaagctacatcagttgggccacagggtcaattgtggcccccagagctgcccgctctgaaggcccgtttgcctctgttatcagtcagtgacttctgacatggcactgcgggcaccttcgtctcctgcatgattactctatgattttggcttccactgacaatgcttgtgggaaccacttacagtcgggatcccaaaatggtgacctggctaattctcccattctgtccatatttattaactggcattcttctgtaaaagagctcacccccagccacccttttactcttttgagaatcataacacagagacttaaaaaatatatagacagagtattatactctcttctggtcattattcttttgattacaaatggttcatattgtgccagtgggacccccccccccaaccccgcccactgcatcctggcatgagaaagtgctctgtgctcatgttgtattttactggtcccggtccctagaatcagccacatctccttagggcctgtgttcctttcactgggcatgatgtttccaaatgaaggatttaatcttttttaagccctcctgagtatcactgtatcactttgggtgaagtagatttacaaactgtgcagaacataggaccccaatgacaaatacacctcagtctgaaacattaagtttacttttcaaaagcagacaaagcgtaggcaactgcatttgattttaataactctgtgctgaggtcaggagttcgagacctgcctgaccaacatggtgaaaccccatctctactaaaaatacaaaaaattagctgggtgtggtggcaggcacctgtaatcccagctactagggaggctagggcaggagaattgcttgaacccgggaggtggagattgcagtgagccaagatcgcgccattgcactccagcctgggtgacaagagcgagactccatctcaaaaaaaaaaaataaaactaaggccgggtgtggtggttcacctgtaatcccagcactttgggaggccgaggcagatggatcatgaggtcaggagatcgagaccatcctggctaacatggtgaaaccctgtctctactaaaaaaaaaatacaaaaaattagctgggtgtggtggcgggcacctgcagtcccagcttctcgggaggctgaggcaggagaaaggcgtgaacctgggaggcggagcttgcagtgagccgagatcgcaccactgcactccagcctgggcgacagtgcgagattctgtctcaaaaacaaacacacaaacaaacaaaaaacctctgtgctttctcaggcatcttgtgacaaagccatgagtgtccttcaatctcatgagcaaacatcaaagagactgtggtgtgtgctccgacacagtgagaaaacagctgcatggctgctctttctttcctgtatcccactgcatggaacagaggaacccatacacgtgaaacctatttaggttcctgtgagtaccttctcttcgaagggtgcacagcatggcacacctctgtccccggcagcctcctcttcctgcctaagggttccggctgtccacacacacaggcattatagccagtacttctaacttgtatctcaggctctgaacttctcactaaaaagttccatgtaccactatgggagaggagtcagttcaccagctttcctgaggacaactctactctgcagggctggggctagcatgaaggtactgaccctatatagactgaatacaaacatctccccaaaaaggtgacgaaggggcacagcattattcttgccagaggcagctgacctgtgtccaactgaagcactaggcataatttctagattagaggaaatacaggggacagaggaacaagtaaggtggtatcatgtggaaacaatcagacaaatccagaatgtaggctggtgtctcgataaccatcctagactcttctgaaagtcatagggggaaaacccaggatgtgtgcttgcaggatggggtgagattttcactttaaaataggctaaagggatattaccaatgggcacccagtttaagaaatactaatcttagcctgacagagattaatctagtatttttttttttttttgagacagaatctagctctactgcccaggctggagtgcagtggcgtgatctcagctcactacaacctccgcctcccaggctcaagtgattctcgtgtctcagcctcccaagtagctgggattacaggcacgcatcaccatgccagactaatttttgtatttttagtagagatggggtttcgccatgttggccggggtggtctcgaactcttggcctcaagcgatcgacttgcctcggcctcccaaagtgctgggatgataggcgtgaaccactgtccccagccccagtctcgtatttctcaatgaaacattagagatttctaatctctacctgccagacattgctcaaaagagatgtgaagaggagctacacaggtgctccagctatgcaaacccaaggggaaaacaaagtcttccttcttgtgttcttacacaggagaaatgcatgtgttaggattattatgttttcaaatctcttctcacctccacacttcaatgtaatcattagcaagatcttttttaatacagtctttgcttgataaaaacaacaacaacaaaaaacgactctcttctatgctttagtaaagatgcctatggcttggccatttctcctggtctggaatatccatttttcttcttggctcctatctatccttgacagtatgctaccccaaatgtgatttcagttcaaaatcctgcactgttgctaacacattcttattgtgtatatcattagcaattattcacagattttaccaatcatgttttagattccagcaggactctaagatccttaaaggaagagactaattttgaagcctttgtaacacccagcagagtattttctaaatagattaaggatgagtgaatgcattcctctagagttgtgctgtccactctatattttgtgtctctatgttacgttttggcaattagtcattgggggctatttaaataacacgagaaattcaggtcctcagttgcatgagtcacatctcatgaacccagtttccagctgtggctcccatcggatgcagtatagttacagaacatttccatcctggcaggaagatttgctggatacacagtgctgggctagagagcagacaggcgcacagtgctcaaggaccatgtgcttctcttccatgtgcatggcagctgacacaagtgggagagggttggtgcttattttggcttttgtctgaaggctcagataagcttcgatgtgccaactatgaccatttgctcttacttcatagacacatggaacagtctattgggagtcaaagagcaaactttggtttgctccttgctctgtccttgaacagctatgtcatctgcagtgttttttaaataaggcaccatcaatcacaaaagggcacatcattcggcccagctcccagagctcagagagagaagagtcaagggccccaccaagcgccacaagcaatgccatgaaactgcctgccaggcatggctgtgaagaggtgaccatcctcctctcatacgcaggcaccttgccacgtggccagctgcaccagggtccttagctgctactcactgttggcatcacagcaaaggacacaagggagacagaggataaaggaggatcaggaaaggtggtgatctatctgccagacattgctgaaaagggatgtgaagagaagccacatggatggcccagctatgaaaagccatggggaaaagtcttcctttttgtgctcttacacagtagaaatgcatgtgttaggattactatgtcttcaaaaaaatgctctttaagcaccaacaaggcaattttaaactgcaaatatctgcaacacaaaatcaaggttgcccccttccaccattttaacactattgaaggaagctcttaatatattaaatgctgcatttattaatcactaaaattcccttatagccgatggtaggagcattattttcaagcgtaatgtattccagaataacactattgtgctttctacctacagactgcctatcaatcacttttcaaacatctcatcagaaggtctgaccagtcgcctgagcatctatataaggagtgctttcaggggacatttcttaggagatatcatttaccttgctcctttacattgctttaagtctccatctactcctgaaaaatgacagaaaatagtatataaattatagcagtttaaaaaaaaagaaatagaatcagagtaaggagtgaataatcgcaaagataaaaaggaccaaataatctctaatatatagcttttcaaggagaaaaatagattctggctcaaaaaacaaaacaaaacaaaacgatgcactgctgtcccatattatacaggcatatcttattttattgtgcttcatagattgtagtttttacaaattcaaggtttttggcaaccctgcgtcgagaaagtctatcaacaccattttcctaacagcatgtctcacgtgacgtgtctgtgtcacgttttggtaattcttgcaatatgtcaaatcgtttcattattacatctgttacgtcaatctgtgatgagtgatctttgatgttaccattgtcattgttttagggcaccatgaaccgcacccatataagtcagagaacttaagggataaatgttgtgtgtgttctgattgctccatagacccccatctctcttcctctcctccaggcctccctagtccctgaatcacactaatattgaaatcaggctaattaataaccctacaatggcctctaagagttcaagagaaaagaagagtcacacatctctcactttaaattaaaagctagaaatggttaagcttagtgaggaacacatgtcagaagctgataggctgaaagctaggtctcttgcacccaattagccaagttgtgaatgcaaaggaaaagttcttgaaggaaattaaacgtgctaccccagtgaacacgtgaatgatgagagtgaaacagccttattgctgacatagaggaagttttaatgatctgggtagaagaccaaaccagcacaacattcccttaagccaaagcctaacctagagcaaggctctaactctcttcacttctatggggactgaggcatgtgagaaagctgcagaagaaaagtctgaatctagcagaagttcatgaggtttaaggaaagaattgctccttgctctgtccttgaacagctccttgaagcagcaagtgctgatggagaggccgcagcaagttatccaggagagctagctaagatcaccgatgaaagtggctacactaaacagattttcaatgtagacaaaacagccttctattggaagaaaatgccacccatgacgttcatagctagagaggagaagtcagtgtctggcttgaaagctttaaaggacaggcggacttttgtgttagtggctaatgcagatggtgactttaacttgaagccagtgctcatttacaattctgaaaatcctagtgctcttaaaaatgatgctgaatcttctcttcctgggctttgtaaatggaacagcaaagcttggatgacagcacatctgtttacagcatggtttaccgaatattttaagcccactattaagaattactgctcaaaaacaaatatttctttcaaaatatttctgcccactgacaacgtacctggtcacccaagagctctgatggagatgtacaaggagattcgtgttattttcaggcctgctaacacgacatctactctgcagcccatggattgaggagtaacttcaactttcaagtcttattacttaggatatgcatttcctaaggttatagatgccatagatagtgattcctctgatgcatctaggcaaagtaaatggaaaaccttcaggaaaggatttagcattccagatgccattcacaacattcatgatccatgggaaaagatgaaaatatcaatgttaacaggagtttgtaaggagttgattccaatcctcatggatgactttgaggggttcaagacttcagcagaggaagtaactgcagaatgtgatggaaataccaagagaactagaattagaagtgaagcctgaagatttgactgagttgctgcaatctcaggatgaaacctgaactgaatagacactgcttcttagggacgcgaaaagaaagtggtttctggagataaaaatctatttctggtgaagatgttgttgaacattgttgaagtgacaacaaaggattcactatattaacataaacttagttggtaaagcagcagcagcagagtttgagaggactccaatttttttttttttttttttttgagacagagtcttactctgtcgtccaggctggagtgcagtggtgggatctcggctcactgcaacctcagcctcccgggttcaagtgattctcgggcctcagcctcctgagtagctgggactacatgtgtgcaccatcatgcctggctaatttttgtgtgtgtatttttggtagagatggggttttgccatgttggccagactggtctcgaactcctgacctcaagtgatctgcctgcctctgcctcccaaagtgctgggattataggcatgagccaccatgcctcgccaaaagagaatttttttgtaaaagaaagaatcaagtgatgtggcaaacttcattgctgttttattttttaaaattgccacagccaccccaaccttcagcaaccactactctggtcaacagtcaatatcaagacaacaccttccaccagcaaaagaattacaactcactgaaggatgacatgatccctagcacttttttttttaaagcaataaaatgtatttaaggttatgtacattttttagacataatgctattgtacacctaatagaatacagtatagtataaacctaaccttatgtgtactgggaaaccaaaaacttcatgtgactaattttattgcgatgtttgctttactgtgatggtctggaactgaacccacaatagttctcacacatgcctgtatccagtttacttaaagattctaaataaaaccatattgcttttatttgaaagagagagctagaaaaaagaaaaggatattttacacctgcatgcctagaatctgctgaatatttgtgttgccagctggacaaaactcttattatttatctgcagaattttgcaatttaagttttacccccttctcaattattctagaaacagaaacagctgcagtggacaaccaaccacttactacaagaacttaaggttggcatggttcaggtcaattagaaaacagaaccaaacggagctaaatctataatctgatgctgtttctccaacatacaatatagcatcttactctaaatctcttcggacccttaataggaacacacgtgtcttgtgctttctatattccagaagccttttcagtttccagaaacaacagattactcattgatcaccctgtagtgaaaggccaatcatggcccctgagataagggttcatctctgtcccaagccctcacactggcctccaccctcagccatctcctttgcaaacgtggaagagaacctacatttcacctagcaagggtaaaacccaagggtacactgtcagcctccagggaagacagggcaaagaaagaatgtgaacctaccaccagagttgctttgacatccagagcaagacccattacaaatgatggaaggaggggagattgtgattacgatctcattccaactaggatcactgcacgttctggggttaaacaataaccacctatggaagcatgcagaatgatccttcactttgctccaccttcctcagaaatgtgccaaaactcttagaaatcccacttggaatgaatgacttgataacatcaagtagtaagaaccgactgaggctgaaaagcttgtcagctgcacttttaaacctcagacgtatttcatggggtcaaatgacaacatacatagattcttctgacaatccacctagggcatgcgctaatattacgtaagaaaaatctatttttgtcatcagctatatagatgttctggtgtctaaagaaacagcctacatgaagttaacaaagaatgacagcgcaaaacacactcacgctatgtctgtggaattttggccacacagtggacatgactgtcaactgtctcaggcagcccacaatcccatcagtactgggcttggtaatccccacagagaccctacctccatgaccttttagggtctcctgggccccagacagtgaggcaggcacttatagtctcaagtgctattatttggcaaggaggaagctacgggagtgcaaaaaggcacagaagaggtcttcattttactaaaggtgaagtagaagtcactcattaaaatcctgcaatctggatttataaagatatggtatattatggtcaacactgcaaatgttcttattacccttcgcagatctaccttattattttacgatatttaagaaactggaaataagcttattttcctttgattttaaaaggattttaaataattctgtattagactccaagaaaacacattttacacataccacattttacatacaccaaaactcctaattctgaatattcttaacacccaccctctgcctgaccctcccagcatagccattatcaacagacatcttgggttgctccacaaagacctagacccatgctgtccaagccagtagccacccaccaaatgaggctacagagtgcctgaaatgaggctagttcaaactaagatgtgttgtatgtataaaacacacacagattttgaggacctagtatcaaaattaatgtcaaacacttcaaagattttcttatactgactttgtattaaataatatttttgatacattaggttacataacatacatcatccaaatcaatgtcatctgtatctttttacttattaaaaattgctccccaaaatttttacctggctcaattctatgagacagaactgctctggacaacaaactgtcttctcttttaaagaaattgggaccatcttttgtgttcctaatttcagttatttacaaacagaataatcttccctgtccagctgctgagatactgtttaataattgtcatcttcttatttcaaaatcatcccagtttttaactaatcccactcccctactctctttctctgaatggcatttgagagccaaaattattaatattacctaaatcataactgactcttaccttggtcatgagaaacagaaaccgaagtgtatttttttttttttttaaaggacaactaacagcatcgtgcatgtcaaaagcatgggaaagtgtcctggctttcttcctggtcaacatttcctctaaaatctccatttacttcctcattctcctctgattaaacaatcttctcctctaatgttaacaatcctccatgaaactattcgttttcaattttacttccccaagtatgcaagtattggggctacatagacaaacagaacttcctagaaaaatgcattcaaaattcccgaaaaacagacctattgtaaaataactcattataaattgatagtatattgttatgcaaacaacagatacactgaagtgaggtgctaaagaatgacagcaggcataatctggtagattaaattaaagtggcacatcttggaaagctgtgttttatatttacacatttggtgaaagaatgggataaacaaaggtatatttccaagaaagttttgcaaggccttaccacctcaaagaagaggtagggcaggaaaggaggaaatgggcagaaaatgaggggggggaataaaaagaagcagggcttatttttccaaatagcactaattcttggttatctgactagatcagaggattgggtaacaatgtgaggtcaatgcttgtaatgccatttaagtcacattcatcacttcagggcatggctatgtgtgaatctagaatcagaattaggcaccaagctcatttagaagtttaataaatttaattttaatgagacatcttgtttggtattaaaattcatgagactcccagaacaggttctctggacctttattagaggataagaaatttatttgacaatttaactttttgaccaccggagtaggaaaattcatgtctacaaactatacctatgtatcccacaagctttctgaaattgagtcatttcaaatttagtagctgcatacaccgttggctccaattagtgacctctacggggattttttttttcctttggaattcatcagtttacacctctgtgttcataaaatgaagagaatggtttctgcatgcctttttaaaaggaaacactgctagggaattacccagcaatatgatgagcagaaacaaggtcacattcacaatttaagatgagctcaacatcatttatatttagaactggatcaatccagaatcgtttctcagcttggcttattagctgtgtgaccttgggcaagtagctttacctctctgagctgcagggttttttttttttttttttttttaattagtgacatgcaaatacttcctcctaacttgcagggttttgaaatgaaggaatgatatacgtaaccaagcaggtcagctgtctacaaagagtatgcagacatgtttatagatatatgaagcctcctggtgattatgtgtcatagtgttaactgtgtcaaggctttcggtagagctcagcatagttctgtcttgagttaaaaacagggttttattctttgaattctacttgaattcctcttggctggtgaagttcacatgtgctaagactgactaccttagtacactgccaagggtttcttaatgcctcggattgatagagcagctgttctcaaacgttcacgcgcttaaaatgcagattctgattgggcaggggtagggtggggccccagcttctacatttacaagtagcccacaggtgatgtccccggtgctggtcaccctaggcagccaggccacttgacggaccttctgtgcctctacactgttgacggcgcgggataattccttatggttgcatagggcactcctgtgcactgcgggaagtttaacagtatcactggtctggactccactagatgccagtgaccccatcactcctcgccagctgtgacagccaaaatgtctcctgacatcgccattgccagatgccctcagggctgcaaaaccgccaggtagagaaccgctaccatgcaggatgctaccatcaaagtgcgcccacagcagcaaccttggagcaggcaggcaagtatcctccaggctactttgcagacggggaagctgaggctgggcaccgctcaaggtcgcacgcatgcgtaaccgaaaagagagcgcggaggtcccgccgcgcctcgctctgaggagaggacgcggagccgcgcgcccgcccggtggaccccagggactgctcccacgtgctccggccccacgcgcgggccgccgaccggaagcgggtgctggggccgcgtagacgccgcggccacgcgcgcccgccagcccggacatgggcccgcgggcgctcctggccgccgcccgacttcggggccagccgggggcagagcgcgcgggagcccgagcgtccctgcatgaacaccgccccgccgcggcccccaggccgtgacgtaccccgcgccgaccgtccccacgcccacacaagaccgcccttactggaggcggcggctgcacactacccacccagaagaagtccgtccatgtcaaagatgaggtgggtgacgggctgcgggggcgccgccatggtggcgccttctgggtctgggtgggggcgaggaggaagtgcgcgcgcacccgcccgccccgcgcacgcgcactgaggaccttctcgcgcgcccggggtcgctctgcgcacgcgccttccgcggcccctcgcccggctccgagcccgcgcgtcctgggctgcctagtggcgctccgcgcacgcgcaccttgggctttcgccgcagctgtagctgcagacccgggatgcggcgcgggccggcgctgtatgtttacccgcatcaattcctcctcacttcacacccggaatcgggccaagctactcagccagcggccgcgcagagccgaggccctcgtctggggacaaattcagtgcttgagtttggatcaggggtgtgaatgaggaaggagggacagtacaaggggctgtagagtggggaaaggggattgaagatgctcagggtggtatcacttctagccatcaggttgcagacaaatggccttggtcaggaggtccctgggtgggttcgcccgagcccccagtccctggaccgtgggtgggtttttctcagtttcgcttgcccgcctccttgcggtcctggaccgcgacttgaaccggcagccgcgcatgcgcagtgtgcggagaggctgcacaacctccgtgcctgcatctctgagcatcccaggctggtgcattgtcccagagcaaagccaagctgctcaaggaggatgctgaaataatactaacagtcaacatgtcttgctggttgtgccttcttaggtatcatctgtcttttgggctgctctgagttttctttcttttttaacttttcaaatgccacctaaacagctttcttttttttttttcccgtttgccatcgtcaaaaaaatacttttttgtccctgtttctatttcgtgttcgtttatgtggtatattcacgtttaaggaaaaggattggaccttttgagaagcggaaataggagaatttcaagactttaaaaacgtgagggtgtgctgggcgcagtggcccacacctgtaatcccagtacttagggaggcagaagtgggagttgggggaatagtttgagcccagaagtttaagaactgcctgggcaatatagcgagaccctgttctccacaaaaggggaaaaagacaaaaaaaaaaaggtgtaaacatgagagtgtatttctagtttagtgcagacatagtggacaggggcatgcctggattcagcaagaattattatctatgatagacaaagtgcacctgtgtctgtttcctcctgggtaaaatggaggtgataaaggaggtgaggcaggccaagcccttagtaccagtgcataatatatagtcaataaaattatgtgttcttagaggtggtactataagagagcttcccccatttaatgcaatcgtgatttccctttgaggacacgggatttcagagaaggcaatttatgagcaaattaggtagggacttgcgcctcaaatacagtcgttcgtggtttctgtattagtttactacagctgccatagtaatataccacagactaagtaacctaaacagcagatgtgtattgtgtcacagatctggaggccagaagtcctagatcaagatgtcagcagtcttaattccttctgagggctgtgaggaaaggacctattccaggtctttctcctcagcttgaacctgctttcctttccctgtatcttgtcctatcgtcttccctctgtgtgtgtctctgtgtccaaattttctccttttataagaacacgattcttattggactaaggaccaccctaataactacattttaatttgattacctctgacaaaatcctgtttccaaataaggtcacattctgaggtagcggggatgaggactccaacatatatttttgggaacacaattccataatagatgcattgcacacacatagctgtggtacctacagtaagtatgacagtatttcccacctggagtctgtagaattctccctcccagtttccttccattctctggaaacaaatggatgcacacatgtcagagttactgttatttttttggtattgtaaccacctcacatttctgtttagtcattaaattaaaaaagagtatttttcttttttctttcttcttttatgagacagagtctcactctgtcacccaggctggagcacggtggcgcaatctctgctcactgcagcctcagcctcctgggttcaagtgattctcctgcctcagcctcccaagtagctgggattacaggcgccagccaccacacccagctaatttttgtattttttagtagagatggggttttaccatgttggccaggctggtcttgaactcctgacctagtgatctgcccacctcggcttcccaaagtgctggaattacagacgtgagccaccgcccccggccaaaaaagagtatttttcaaaggaaaaaaggccccaatgccattttgacgaaatggcaaagcctcacagcgattgtggaagagacagattgggaaatcgtaggtacttcagctctccacagatgtgaaaacatgcttcacattatgtttttatcagtcttattttctacacttttcagtaacatcacttctatgcataagatggaagactcctctttgcttaaaaaaaaaaaaacaaactgaatggtgaatgcttctctgtcacaagctagattggaaaagaatgaaattttgttctagcaatgtggtttgtacacatataacaagttagtttttagcttttcataattctccaacagccaaagatgggcagtttctatgctgatggggatgcatttccttccatgaattacagtttacttttgtacagttgtgttctccccatgggacaataacttacttttcctgacaattttaagacacaatagaaatgatccagtaaactacagtacgatggcatcaaaagcacattatcaatgggacaaataaacagatgctcttctttcacacaacatgtaaacttaaacatgccatttattgtgtgtatatatatgccatcctgtagggagtcttagcttatttcaacttccttagtttgttgtcctggttcctgtgtctctgtgcttttgttatctgttgtatttggtttccagtctgctgtatctgttttctgtgagcccactttgccctgttattctctttacttttctaggggtacaaatcttgcccagcgtagatggagggtaacaggttggactagggaccatctttctcagtggctgtacacagtctacttttcttgatgatgctgagagaccagaaagctctgacttcatctgatggggcctgaatttgagctcctcattgcagacttacctgccttcttcccctagatagctggctttgcaacgctgacttaggaagtctcttgcttcagaggcactgaatattctcaccccttcccgctgctgctttcctccaagcccagtgagctctggaagggagcctgacatagatggctgaattcgccactcctggctttgtactctcggacatatctggtatttttgtgtggggagggtcattgtttttgaaccccttcaccatcagagtgcaaactggctctgagcgagaggtccagtttgcttctctgcagtgttggataacagatgtggtcggaactggcagtgccagcatcccctgggagctcactagaaatgcagaatcccagctgccacccccagactgaccaactcagcatctgcctttcaaccagggcatccaatggtctagaccattgaccccctcctggggtataccagctacttcattgtggggagggggcttaggattattattattatcgttattttatttattcgtttattttttgagatggagtctcactctttcgcccaggctggagtacagtggcacgatcttggctcactgcaagctccgcctctcgggttcacgccgttctcctgcctcagcctcccaagtagctgggactacaggcacccgccactatgcctggctagttttttgtatttttagtagagacggggtttcaccatgttagccaggatggtctcgatttcctgaccttgcgatccgcccccctcagcctcccaaagtgctgggattacaggcgtgagccaccacgcccggccaggattattattttaatgtaaagaagtagcaaatgtgttaagtttaccaagatttatttttattttattttattttattttttgagacaggatctcactgtgttgcccagggtggagtgcagtggcgtgaagtcggctcactgcaactcccctccttccgggttcaagcgatcctgtcacctcagcctcccaggtagctgggactacaggtgcccaccaccatgcctagctaacttgtgtattttttagtggagacggggtttcaccatgttggccaggctagtctcaaactcctgacctcaagtaatccgcccgccttggccttccaaagtgctggaagtacaggcaggagccatggcacccagccctaacatttaatatttgtgtgaacactggcgaatgttcttgtgtcctggtcttttctccaggtatccttgcagggaggaggggagacatcattgctctcaaccattttatttgatttcagcataatgcaatgtacatattaaggtaaagtgtatttatggcttatattatttaatttttaaatcaactgtcaaaaaatggacagagggattaaagacatgcctatgaaaataataaaatgtagcttccagttaataacaagaaagtagaaattccagcatcagctttatagccttcactaatgattacagatcatgtttcgtaatatccgtaatgttagtgcctaagtagacacacactattctaaaatagcacatgtgaagggaggatgtgtgctccaaaaatgtggagaagtgaagcatgtggtcagaccttaccatgcattcgaatttcctctgtcctgccaggattctcactgactagacatgactggacatctgagagaggggctcaggcttcatcacaccccaccctttatcatctcattgttctgagatttagggctcctgactccaaacagttccctccttgcttgcccctctctccctttctccttccctccctttctttcctccttctctctttccctgtcttccttcctgtcctcctcttcgactccttccctctctccttccctcccttcctttcctccttctctcttttcctgtcttccttccagttctcctcctccactctctccctctctcattccttcccttcctttcctcctgtcttcctcctgtcctcctccttgactccttccctctctccttccctcccttcctttcctcctccttctctctttctgttttccttcctgttcttctcctccactctctccttccttcccttcctttcctccttctctcttttcctgtcttccttcctgtcctcctccgtgactccctcactctctgcttccttctcttcctttcctccttctctcttttcctgtcttccttcctgtcctcctcaactccctccctctctccttccctcccttcctttcctccttctctcttttcctgtctttcttcctgtcctcctcctcctcgactccttccctctctccttccctcccttcctttcctccttctctctttttctgtcttccttcctgtcctcctcctcaactccctccctctctgcttccttcccttcctttcctccttctctcttttcctgtcttccttccttcctgtcctcctgctcaactccctccctctctgcttccttcccttcctttctttcttctctcttttcctgtcttcctgttctcctcctaaactccctccccctctcctgccctctctccctcttttccttttttctttccctcctgacatttcctctggcgtagctccctctctccaggacctgtgaggggtttgtgcacccataatggatacaaatggggatgtcagcaacttgggcctttgctgtgtcttgtaccacattcacaaagaggggtacccactggccctgcctgctgaagcctctctccttgaatggaatcacagctggagctcaccacgcagagagctgaatgccatctctaatgtgcgccttgcgtcgtctctgcttctgaataaaccacatgcccacctgcaaggctctgagttcctgtcacatcttatgcaagttgcttagtgcactggtcacttctccgaagtgtttataaaggccacatgctgagagtctgagatgaaagagtgattcgtttatggttaaagttggctcattgtttcatagcaactgttgtaatagccaccagccctcaaataattatgatgtacttacaactttataaatgatctgttacttcattgactcggcaactttgcaaggtaaacaatggaattcttcttcttatagaaataaagaaatggagcttgaggaaagtcaggtagcttgccacaagtcatatacctgaaaacgatcagggtggagagttcaacctctgttggtcttccttcctcaaaaagagccaaaaggcaaaaactatctattaatatgtttcctatatgttttcaaaatttcttatgttgtatgtaagcaatcaggaccacaacgtgaatagataatatcaaaatcaaacacaggagtgaatgtgcaaataaagggaaaaaaagtattctagaaaacaccagcaaaaaaaaataaggaaaaggaagcttcaaaaaataaacaaggaacatttgttttcttcaattatgatgtcagtatggcatgtcagcgataacgtggtccaaccagtcatttctaggattgaaatttttctcctttattttacttgcacccaactcctgtgctgcttggtgcaagctaacatctggagggaacagaaagctggttgcacagcctctcccttcagcttccccatgatcacataagcctggaaaatgtgctgaatgagtccttgcctcctcaattcacagccatgtgttcacttgaaactctcccatttctgtggtcaacgatggtcttcccatttttttttttaacacaacagttcccaaacttactcaacagggaccatcacatatgctctttaaaaagaacataatatctccttcaaacacactttagaaataccagactactgttcagcatagggtccattctgacttacattctgcctcaccaccaactttcttgaagcaatcattcagtaaggctgtgggattttgccaagtcagcgtgacaccaaacacattggaaaagcagactaaatttacagagtaaaattcagagaatgagaatcttaggtacctcaaatagttaagattttaagaatcttaaagggaacagattatgtttatatgtatatatgtataccatgcatatgttatataatctatataaataatatattggtgtgcatgatttttataaacttgaggaaatgcctttatatataacttaaatatatttagtttgtatatattcacaaatgtatatgttaaatattatattacaaacaatgcaactgcatggctttaagaaagttaagaagaaaggtgattacagtaggttctcacttgttggtaggtttttggaaactgtgactttaagcaaagccacatataacaaaaccaatttttttctcatcaactttataacaaaatgatgttgaatgaaataacctgctatatatcgttcctcttaaagttgcaatttccgagaatcagccaggtatggaggctcacgcctataatctcagcgctttgggaggctgaggcaggtggaatgcttgagctcaggagttcaagaccagcctgggcaacatggtgaaaccccatctctacaaaaaaaatacaaaaattagctgggtgtgatggcatgcacctgttgtcccagctacttggggggactgagatgggaggattgcttaagcctgggaggtcgaggctgcagtgagctctgatcatgccactgcactccagcctgggtgtcatagtgagaacctatctcaaaaaaaaaaaaaattctgagaatctattgacattgttaagtgaggagttattgtatatatgatttaaatttattacatatatacacacatatagatgcatgcatgtgtgggtttttttatttttggctggctcttgcttctctttggatgtatgtgtggttttaacaatcttcaggtgaaaggtctttatatataatatatgtgtgtatatatatttatatataattgcacaggtttgagagttgtttaataggctaagtgaagtaggtgggtcaaacaggtacaacacatgtattttcttctcttgtgggcacatttcaattgaatatgtttattggctgctgttgtattagtgcgtaaacaataacatttggaagcatctatttcaagtcaatttcctagggccatttaaaccactctgaaagaatcttagaggcaataaatttccatgactccttcctcctggtgtaaactaggatgccagttaaagaaaggtagtttactaggacttgggttttggtttaataataaagctataacttgaaacatggaaatgcagtggctgtgattaaatctgctcctgcaaaatgggaagcgaatgataattaaaaaccacaaatatgcaaaaatacctagaaactattcatgattttttgtgttccttctttgatctgcccccaaccatgttccatgtaacacacataggaggaattctggggttttccacatgtttttgccctttcctgtgccataccctttactttaatagacaaggagggggtccccaaaccagagatttgagagcacttttggtgttttaatgtttctagactttatgaagctggcaaatggcttggaggagaatatttgagcccactgaatgtatacagagctcactgctatttgtcttgtgcagtagtggatgatgcaatagggagactataagctggattctggggctccaggtctcttccttctgcatggctaagaggagaacccttctgtgagcaccgtgttgctctcatcccacttgcccaatttgcattgagatgcttgttccttgattcagggccctaattatcaagcctcgatctttgctcatgtgactgctgcctgtcgagtctttgagagtaagtgttcccttgctcatctctgattgcatgtgcccttcttctgtgggactccaggatttcccaccaacagtctctcttatgggttctttctgggtagaggcccaagtatgaagacatgcccagtgttagcttgagggttcctgtgcaatgccactgatggttggcacagttataggaatgtcaaacatcaggtaggttcaactctgaacaatttcattaagcatctacgtggattcatataccaaagtctgtgcttttcatgatcttaaagcacagtaattttcatagctcgtaaagtaaaatcttttcacttctgtcttctcaaaattgccaaaaaggatcatccatttcttttggccaggcaccatgccctgggacattatatctaatcaataaagggttattgattagaggggcctgagatgtatgcttctgcctgccttactggtgagaaagctggtgccccaagtgattaagcactttttggaggtcatacagctagtgggtgctggaatcagaatgccatgtctgtctgactccaaagtcctccatccacatatcaagacaaattattctgggaaatatttattgtaacaggatactcatttgacagcatcatgaaatgagatggaaaaaaatggcattctgtaggaattttccatgtagataaccaggaaccctatggatctctggcctcacagcaaggagagaagtgggggcttatgaagaggtttctgtggcattatagccctgcctcctccccagtggagttaggctttcttttttcttgtttcctaaatgaaataaaaacaaatgacatggcatgcatctctcttagcctcagtccaatgttgaggcttcagcgacactcctcagagaggttgatatttgattgtgcatctcttgggggacctaggtgggtggcacctgatccctgcctgatctgctctagagacttctgatctcgaggactagggggagttgatttaggttgcacttccagagtccctcaaacaaatatgcataaccagataaccttaatgatttggacttttgccccacaaaatctgctgggatgaggaggaaactccagcagagaggcgccacttgaaaaccagttggaggaagagacaacatcgcccgcatctcaggagttgcaaatgggggtgatccagctgtcctggcttccaagaacttaagaaaatgcccttcagctttgcctgaaatcttcacatgacaggaccagtgagagaagaacaaaccttctgctccttttcgccttcctttcctgctactctccaggtggagggatcagtaaccacagcagggggaatgagggaggatgacaattgagaaagccagaagcttccccgtgtgtgccctctgtttcaggaccatgaaaagcatgccttagctgggggtagggtggggagaaagggaagtcttactctggaattaaagctgcagagatttagcctttcattcgacatttaactttgatcttgaaagcattcagtgaccagaaacatcatgtgatgtgctggaattttgaccactagctggtataagacatttctgcaatgagtaagttttacagagaccctgggagacaaaacatggccttttggtaaaatccgagtcgtatttattcatgttaaaatacttttcaggtttcagcatgcccaaatccttagttattattaagactagaaaatgggctaacactgctactttatatattatttgagtgcctactgagagccagaggcacacaaaataattagaaataagcaattttttatttatagaagcaaagactcagattaggcttttttttttctttctccctttcctttttccctaaatgctgtaaaaacaaacaacacgaggaaactaataaaagagaaacactggaggttatttttcctggggtgtgattttcccccaaggtgtgtggtcagaagactgcctgctgtttcatcagcgttgatgggacacctccctgctgagtggtagccctgctcattgcccaaccctgtggtattgacacagagaatgaattccttggggctcttggcactgtgttgtatgtgtaactcacgtaacaaacaggctggcaaggcttaggcacatcaggctctccacagatcattaaaaacaaaacccttgctcttctcatcctaaaaccacgtcctatgttgttcatcgaaaaaataatcatcactgtttgtctgtcccaccccaccattatatagcctccctcttcttcctcaacacatgctccctttccttgctgcgcaccatgcaatgcaaaattcagtgcctacaggaagtgctctcagtgaactcctgattgttttccaggttagggagtcaataggtgaataagaattgcagttaagtattcagggctggcacccaaagctcctccaaagtgatgagttggtgaaggaagtccagcttccctctgagtgatgttaaaaatgtgtggggcactgggggagaggaaggccaggtggagaaatacatgcagttaaataacttttttatgatagattcgctgattactcagtgatgactttattgccaatgatgctccaatataactgcccaggctgtcaaatgattattcacacacgatgagcgttcggctgggatacttgtccaatgtgatggtatgaaaagctgtttgagatccttgaaggagacgtacaaagtgtcttgagtcttccagtaaagagccctctctgaaagccttgtaagaactggtgagttacatttttaatatgattattattttttcttctctgctgctaagatgttgggatacgtgatgacagaaaattgcttacggggaatatttactttagttgcactgcttcaaaggaagtctaaaggtttctatttatttcccttcctggaatagcccaagagcagcatgttaagagttaattgaataagtagaagagccaagtctttgctctgggaggcggagttttaaattctcttctgtgggactgatcaaagtttatacattttttatctgtagtgttacattaaagaaaatatctgtaaaaccacctacaacaatttatctaatatgttttcatttgctcatttgccctgaaacaaggctgtctataaggagaagaaagtaattgccaaatagtttgtctttgtggattagagtggtagtttgaaaacacaagcttggtataaagaatactggagtttagaggaaagaatcctaaaaggaaatgagcaaaggaagtggtggattttgtgctatagtttacacaaaagagaaattaaatcaattaacctcatatatgaaaatactgcacccactgcttctgagttagatacgatgtctatgcgggagatgtctttgccatccaatgcattccctgaaagattggcatgattttaagctttcaacttactgcttttctaaaggatgaatttgagaaggaattaacagttgtttcactctttttcattttaaatatacagattcaatatctgtaatgttaatatgtatgtatcctaaagagtggaaatacgtatcctaaagagtggaaaaagaacatacatgcctacttctagaggggcatacacgtagatctctcagtttatcctcaggaccatgcatgaagtcaaatgtttctttttgttttttcttttttttgagatggagtctcgacctgtctcccaggctagagtgcagtggtgcgatctcagcttaccacaacctccacctcctgggttccagcaattcttctgcctcagcctcccgagtagctaggattacaggcatgtgccactatgcctggctaattttttttttttttttgtatttttagtagagatggggttttgccatgttggccaggctggtctcgaactcctgacctcaagtggtctgcctgcctaggcctcccaaagtgttgggattacatgcatgagccactgcatccggctgaagccaaatgtttcttaacaggctatgttggttttaagatgtggtgtttattactgcactttttacagtatacttgtgtatgtaagatcatctctataaaagaactaggttaactgaagaatgggtatgtagttcagagatcagttagtgttttctgaaaatttatattaattgcagaaaatgaacatccaaaaacaatttaacttttgcaatgcatgctgtacataatctagtaattatgaaccaaccaaatggatgattttttccccaaagagagatgctaagaaattcctttgatctctttcaagtaaactctctgttatcttatgagcaattataatgaattaagatgtccagttcatgcttactttacttcttatcagagtatcaacatatttcatgtacacatcagttttgtcttctgtgccaacccgagcagattgagttggaggaatgttagaaataattttcactgaaaataatatcactaaaagtgttaaaattattttacagaaagtttgctccatttcgtgtcatttactgtaggtactctttgtctcaaggaacacatgacaatgctttactgagtaccctgtgagttggtatctatagtgacattactatttgccaactgagaaattgccccatattcatttataatgagattatcacatcacagctgatatcaggagacagaaatctaaaagctttcagtgcatgaaaaaaagataataatgactcctctttgcattaaaaacctaaatagtagatgttgagcatcccttaaaagcttgaataaaataagcattaagagtttatggccaaaagtcctaagccatgctttctagaccaggttctgtcaccattgttttgtttccatcttgtcttctccttaaaattcgagccttggttggaaattaacccctgtcaaacttggccactgagtcaacaagcacttccccagtgccccagggacacaggtaacagaggatgtggcaatgatgaagcagaagtccagtctcacctcaggtgttttctgtgaaggaaaacaagcagtataaatactgcaagtaccaatgtcaataataattaaatgcttattatgagaaggaagtgcagggcagagacttggcacagggctaattaggagaagcaccttcaactgtgaggtctgggagaaagcccagggggatggaacagagatggcttagggtcccgggttcctcttggcggttccaagactgggagatttttagtttagagatagagactgggacgttctctttcacaatgaatttgtctatccagcgattccccacggaggcactgttggtacgtggggctgggtgattccttgctgtaggggctatccagtgcgtggtaggatgcagcaacccacaatatctccagatgttgccaaatgtctcctggtaggtaaaatcatcctcccggatgacaatctctggcctgaaataagcatttaaaatgtgtaagactggccgggcgcagtggctcacgcctgtaatcccagcactttgggaggcggaggcaggtggatcacgaggtcaggagtttgagaccagctgggccagcatggtgaaaccccgtctatactaaaaaaaaaaaaaaaaaaaaaaaaattagctgggcctggtggcgcgcgcctgtaatctcggctactcaggaggctgaggcaggagaattgcttgaacccgggatgcagacgttgcagtgagccgagatcacaccactgcactccagcctgggcgacagagcaagactccgtctcaaaaaaaaaaaaaaaaaaaaatgcatgagacagagcttacttagagcagggtttttcaacctcagcactgcagacatttggggctgggtcactctctggtggtggctgtcctgtgcaccatagggtgctgagcattatccctgggctccacccagcagatgccagcagcacctcccacccactgctaagttataacatccaagcttgtctccagatatcaccagatgtttcttgggttgcaaaactgtctcttgtgtagaatcaccaaattggaaacagataagaaccggcatctgggatcacagaagaggtgtggagatcactgttttgagtctgttctcagctctttttccagctggccaggcagctctgtgtttttgctagagcttgtcacagctggtttgacctgggtcattgggcaagcattccctgggtctcaacttgtcacctcttctgcctatgaggaaactctggagctatccacatccaagtgacttggccaaggttctgttcagcataggtggcttttccagtacctgacttctcagcccacaggactttaccacttcttttcaaatcttgccttcagaaatgtaggtttgcaatcctttgtccataaccaaaaatagaaaagaaaaacattgaaaacccagagtttttctaacatacttggcagtgacaccagctcgaaccaactaacataaaactaacataaagtgaaaagtcttcattcatcccacagattgtgggtattcattttgtttcactgcagaactttttttagatagggtctcattctgtcaccaggatgaagtgcagtggctcgatctcagctcactgcaatctctgcctccttggttcaaacaattctcccacctcagcctccccagtatctgggactacaggtgcccaccatcatgctcagctaatttttttttgtattttttggtagagacggggttttaccatgttggccaggctggtcttaaactcctgacctcaggtgatctgctcacctctgcctcccaaagtgctgggattacaggcgtcagctactgtgcccagcctcactgcaaaactgttaacatgggtgaccacaggctgctgtccaagacttcgcttgagctattatatatgacatgagatattcaccattaccttataaaacccaaaacattctgcattctgacacacaccttttctcaaaagtttccatctcaagactatgggcctgagaatgtaattgcaagtggaaaagggttcattcttaacttcttgtgaccttgaccacccgatggtgctgttgttttttggtttatggtatcatcatgtgcttctgtgtgtcctcggatgcagcttccattatgtaaaacctccttccttttctgtactctttaagctttagaataacctgagaacactcaggaactgaaattgagccagaaaagctgggcagaatagctgtgtcatttggttctgggcccacttgtaagtagctcccagcccccacttcccagccaattacctaagatgcaaagaaccatttacacgaatctgggggacagagtgaccagacctggggactctatggcttgcggctattaaaccaaaagacacttcttcattgttgaaaggctaaattccattaaaaaaaaaagaaaacaaaagtacaagcatggtggctctcacgcctggaatcccagcacttcaggaggctgaggtgggtggattgcttgagtctaggaattcaagagtggcctgggcaacatggcaaaaccccatctttacaaaaaaaaaaaacacacacacacacaaaaagaagagtcaggtgtggtgtcacatgcctgtagtcccagctacctgggaggctgaggtgggaggacagcttgagtctggcaggttgaggctgcagtgagcactgattgtaccattgcactctagcctgggcaacagagcaagaccctctctcaacaatgaaaaataaacaaacaaaaacaactaccaagtccttatttggtttgttaaaaagaaagaaaaattgttctttattgaagtatgggtacatctgggacagaatttctcatcctctgcacactagatatttggggcaggataattcccttttgtgggatggactgtcctatgcagtgtggggtgttagtggctttgctggactgtgatggccaatatctaccttccagctgtgacagccagaaatgactccagacattgtccaacattccctggaatgcacaatcacccctggttgagaaccactggtctagaaaaagcattttaaaaggagtaacaggctgggcatggtggctcacatctatagtcacaatgtgttgggaggccaaggagggcgaggagattgacaccaggagttcgaggccagcctggacaactctgtttctacaaaaagtaaaaaaataaaatatcagccaggtgtggtggctcacacctgtagtcccagcgacttgggaggctgaagtaggaggatcccttgagcctaggagtttgaggttgccatgagctgtgatcacaccactgcactccagctgggtaacagagtgagatcctgtctctaaaaataaaataataataaaataaaaatagtaatgcaaagcttcgacttaatcaggattctctgccttgatactattgacatttgaggccagatcattctctgttgtcaggaactgttctgtccacacttagtagcatctctggcctctgctcactggatgacaatagcactgtccataagttgtaacaaccaaaaatatcttcagacattgccaatgtcccccgggggtcaaattgggccctggcaagaaccactggtctaggctagtgccgtagtctacagagtcacattactttaactttgtgtggtgcctcatattttacagaaagcattttctctttctctctgtcgctgtctttttttttttttttttttaattgagacagggtcttgctctgtcatccaggctgtagtgcagtggcgtgattacggctcgctgcaccctcaacctcccaggctcaatcgacccgcccatctcagccttctaagtagctagggctacaggtgcataccaccacacctgactaatttttgtattctttgtagaatcggggtctcatcacgttgcccaggctgatcttgaactcctaggctcaagtgacccacctgccttggcctcccaaagtgctgggattacaggcataagccatcctgtctggctgcattatcttatattttgcttcatttaatacttttctctttcaaccctgtgaggtatttttgagtcccatttttgtcggtgggaaaactaaccccagcaatctatacagtgtgtcacagagttttgtttgtaccctgccatgttgccagatatcacatggatgactgaagtatggggatatgcaaagccatttgtcttaattggcagacaggatcatataaaataatttacatgatactaagtagacaccacagttagcaatatgaaatggattccaggaacttccaattgcaaattagctcatgtaactgatgaattacttaatctaggaggttatagctgcaggtgcctagagcttgcaggttgcatgactcagaagatttttagttggacatgatggagacccagtgcaaccttgctccaacctagaaagagatttttcagttgcatatgtgggaagttcatagaatcaaagagaaaaccactaaccaggaacggttgtcttcaagaccagctgaaaattctttgtaagcctgtttgacatgacccatagctactacctatggctccagatagaagccatcactgtatttgaaaacacttggttttacattctggttaagttgtatagtgttggtactattttatgtatatttgggattagatactgtagtcattatttatcactgcagagcaaattaccacaaacttaaagacttaaaacaaatacccattgaggatcttacaatgactgtgggccaggagtctaggcatagcttagcagggttctctgctcagagtctcacgagattgccatcaaggtgctgtccaggtgttggctgtgttctcacccagagcgtggggtcctctttcaagctcaatatcaagttgttgataaaaaatttatttatttatttatttatttagagacagagtcttgctctgtcgcccaggctggagtgcagtggcaggattgaggctcactgcaacctctgcctcccgggttccagcaactcttctgtctcagactcccaagtagctgggactacaggcgtgtgccaccacgcccagctaatttttgtatttttagtagagatgaggtttcgccatgttggtcaggctggtctcgaactcctgacctcaagtaatctgcctgcctcggccttccaaagtgctgggattacatgtgtgagccaccgcgcccagcccaagttgttgatagagttttgttccttcttgtaggatggaagctctcagcttctaaagactactcttcatgagaggcatcttacaacagagctgtctattttaccaaggccagcaggagaaggcctcttgtgcttggattctgctttcaaggccttgccctattagggcaggctcacctaggatcatttttttgtttggtttttgttctgagacaaggtcttactctgttgcttggatcatggctcactgcaaccccaacctcctgcattcaagccatcctcctggctcagcctcccaagtagctgggactacaagtactcaccaccatgcctggctaattttttttttttaagtttttgtagatacagggtcttgctatgttgtccagactggtctcaaactcctggcctgaagtgatcctctcatctcagcctcccaaaatgctgggattacaggcatgagccaccatgcctggtcctcatctgccttttgattagcacaaagtcagctgattaggcaccttaatgacacatacaaacatccctttacttttgccatactttattgattagaagcaagtcatcatttccaccctcactcaagagaaggtgtattgttgtattgtactcacaacaatacaaagttgtgagtaccaggggctggaaacccagaaggcgatcttagaactctgcttcccacgagtgcctttgtgtgagtgcacctgggaactgaattataatgtagggaaaaatgtgttctgagaaccagataacctaatggcaaacagatgtctgggggaaacggatatgtaagattggctttggttgccagtcctgactctagttagccaatttcaatgtcattgatttatatttgatgataataaaatcatgaaaaatcccctacataattgaatattttattcttgtcatgacaaagtctcctgcaatgcatcacagtaattttttccagttgctcaggaatgtgtctaggggctgtggctcctctgaaaacaggatcagagggcatccctcataatgtgtgggcaggtttctgggaatggctcatgcctccctgcacacagggaatcccatcaaaattcttcctctgctgccctgggtggtggatgagctgtgcccctcctttccctgcacccaggccttgcagtgggatatcatctctcagtgattgggaattcttcctcgagcaccttcaagttgccttcctctctgtccttacccaggatgttccttagaagaacagcacagatgcctgggtctggtgccaggctggcttggttgaattgctcaccaactgggcagtgagggtcctccttccactcacagtagggtttatttgtccaaatttcattttggggatgtcatatcatgctagtgatatcagaaggctttatggtattaacaaaatagcttcagctttgatcatctcttttctgaattgtttttattgagatgaaattcttataaaattaaccattgtaaaatatacaattctgacatattgagtacattgaccacattaaaccaccatctgtctggttctacaacattttcatcaccaccgaaaacaaccctataccctttaacagcgattccacattcctcccatacccccacccctgggaaaccatcagtctgctttctgtctctatgaatttgcctattttagacatttcatacaagtagaattatacaccctgtggccagatgaaaacagggtctctgggggctcagtgctctccaagaggagggatctctgacctttcttttcccatctgccctttctcttctctcttcttttactgagcatggtgtttaaggtccatccatgttgtagcatgtatcagaatttcattccttttcattgctgaataatattctattgtgtggatataccacattcggcttatccctttgtctttcaccttttcgctattgtgaataatactgctgtgaacattgatgtacaaatacctgagttcctattttcagtaattttgggtgtatacctcacagtaggatttctgggtcatatggtaattcaactttttaaggaaccaccatactgttatccacagcaagttttactatctcttagttttaaagtcctcacattacagacaattctcacctttgattgaacatccagcaattatagtatctcctgccagaacttgtgttgaggagaaaataggtttggcttaggaaggtgcacttggcaaagcctccctttacttatcagcatttctgagactcgtttgtttgccctgcagcctgttggaaaaggcagtgtcaaaagcagctctgattaagtctagaaaaactcattataacacatgggtggcatgtttgttggtggggggggctggggggtgggtgcggttcccagaaacggcaccacagagggtgagctgacttagtgctcaagcatataagaggcaggccttgtaaacagtgaagagaatgggaatttacagaacatataggttttatttctctattcccgagcaatttagttctgggtgctttgaggatactgattaaatggtcatataaagcaatcacagattatagggtcttgttgtagaataatacaatctgatgattgtcaccaccccagaagacaatagggcaataatcacatactgcaggttccaagaaatatgatgagacctagaaaaacgtgacttcttaaaaatatatacaggcaggaggtaggaatagtgatttacagcagtgggaatggaggatctcactagggtgaagtgttccagaactgatgttgggggaggggtacggggggtgtcgaacaatatggtaatttaatcaaaacattcaattgtacaactgggtgaattcaatgcaatgtaaaatggatctcaaaaaagtaaacatgtttttcatcaaaattattattttgagacagggtttcactctgtcacccagactgaattgcagtggtgtgatctcagctcactgcagccttaaagtcctgggctcaagcagtcctcccaccttagcctcccaagtagttgagatttcagatgtgccccaccatgcccatttaatttacattaaattaaattttaaatttatattttaaaaaatttaaaaatttttttaattttttgtagaaatggggtctcactatgttgctcatgctggtctcaactcctgggctcaaatgttcctcctgcctcagcctcccaaagcactgggattatacgtgtgagccactgtaccaggcataaattatttttaaaaataaaatgtcctagagtcgctgggaatgtatggaatttctttaactatttaacaaaggcctccaagagtcactgtattgataactccaatggatctaatcaaacacgtaattagatgccacatatattccacaaacaccattgtactaggggatgcttcatttcctattaatggctgggcagtctctgcccatcccctggtacaatgggccagtcatgggatatgcagggtcatatgattgcaaggtcatgaaatgactcagaggcctctgcaaaaccaggtccagaggaaccctccaaatccatcctggagtggctgcagtttgtcgccacctgttggtagctctctgctcaaagcataaaaatctataggggcagttcggcctcctggggctggctggcttccagaatcctggcagtaattccaagactctctgagttggtgagctgaatctgctcctcagcctcaacctggaggtagggccagaagaaaataggatctatgaggactcagcgttttccaggaggggtctctgacttttccattgccacctgccctctctcagctctctacccccagcttctccccaaaaatgtcaaccccagtcttagcctgccctggtcttgggacagaaatgggcagaggatggaaccaatggccaatcagcttctgcatattcaaattccaattatttgaggagctgttatccttgggtttactggactaacttatatccagtggaaagagcctctcttgcaatcccacgtcctcaccatcaacaaacacaattgcacccagccgataaatgatgagatttgggattttattagccataatagcatagaagtggcttgagtgactaattgcgaattattttccagcaaaaagtactcctgacgactgcccagacattaataggaaatgaagcatcacccggtacaatagtgtctgtggaatatatgtggcacttgtatattcgattagatccattggagggatcagtatagtgactcttagaggccttcttgaaataattaaagaaattccatacattcccagctactctagaaccatttcttttctttaaataatattgatgaaaatcatgtttacaagttttttgaggtttattttacattgcatttaattcaccgagttgtacaattcaatggtttttattaaattaccaagttgcgcgatcatcaccataaatgagtttgggaatattctcatcacccaagtgagattcttcaagcccactgctgtgagtccctatccccacatcccacctgaatacatttttaggaagtcacatttttctgggcctcatcatatttgtttgaacacaggtcatgtgaattttggcctctggagtgttgatgatcatcagattgtatcactctgcagtatgaccctataatcagtaattgtattataggactgtagaagcagcatccttaagggacccagaatgaaattgctcaggcatggggaaataacatccatgtgttctggaagcccccacgcccctcactgttcgtgatgcctgcctgttttccgcttgagcactgtcagcttgcccctcttctgccatttagcctggcttctcttcccacttctaattacagtcattttctacaaatcgcctatggaattcattcctgtacttagccccttaagactgatttctcttataggcaagtcaacacctgtcgttgcttgtgtatctcaggctgctgtcatttggagatgtgcataattatttcgaagacacagctaatagaaaagagtaagggaaacatactgaatgttggcacattacacagttgtaccaaaaaaagagcaaatcacaaagctttaacttagacatggaagcatgtggggtatgcttgagtaagtatttttaaaagagagaagaaatccaaagcagtataatttgggaatatgcaataaaccaccaggcctggtccagacggtgaataatgagttcttacctacaaataacaaaattggtaagaggcttgatctgttggtgatgtgggacttgacaagtgggatacctgttggaagtcttgcccagctaaaaacttaatatctgatcagctcttttcttttttctcagtcagtgttattcactttgttttattttattctggggcacatgtgtaggatgtgcaggtttgttacataggtaaacatgtgccatggtggtttgctgcacagatcaacccatcaccaaggtattaagcctggcatgcattaggtcattttcctggtgctctacccccagcctatcctccccacacaggccccagtgtgtgttgtttccctccctgtaggcatgtgttctcattgttcaactcccccttataaatgagaatatgtggtgtttggttttctgttcctgcattagtttgctgaggataatggcttccactctcatccatgtccctgcaaaggacatgatctcattctttttttatggctgcatagtattccatctggtatatgtaccacattttctttatccagtctgtcattgatgggcatttaggttgattccatatctttactattgtgaatagtgctgcagtgaacatacacgtgcatgtatctttataatagagtgatttatattcctttgggtatatacccaataatgggattgctgggtcaaatggtatttctggttctaaatctttgaggaatcaccacactgtcttccacaatgattgaactaatttacattccgaccaacagtgtaaaagtgttcctacatctccgcaaccttgccagcatctgttgtttcttgactttttaataattgccattctgactggcatgaggtgatatctcattgtggttttgatttgcatttctctaatgatctgtgatgttgagctttttgtcatatgtttcctggccacattaatgtcttcttttgacaaatgtgcattcatgtcccttgcttactttttaatggggttgtgatcaactcttttctttttggaaactttatcctgcagatcaaatattgctctgaaatggactgtaatgaacaaggacagattggttgttgaagtgagagtggtagaatctttgggagaaagtggccatacagttttagaatctataatggtaaatgaccaacatagcttggcatgtgcattggggtttgggaaaacagagtttagcattgttcagataaaaatatagatattatctcctggccagggactctgagaaagaaatggatcaagtgctaggatgtactcaaacatgaaatatctgcacatacaatcacaaaaccataaagcatccaacagagaagggaaaaaaagaagcattgaaagaaagcaatgcggccctatagggtttctctttaatgaacctagactttgaaagagaatatttgagaagttggagaagggctagaggaatggcttacttttctatatataatgttaagaagaccaaaatcccaaagatactgataagactgatgagaaaaagactcacttcattccctcatttgtaggtctaccctgattcaatctcctcgccctttcaccagccagcatacctgctgcatgaaaactaacccatcacgctcaccctccatttaaactgcatgcaacttctgaaactgtaataacagacatatttactcaccaagaattggcaggcgataacattttgccatattttgggtcgaaccctaaagagtggtagtgaggttctttgagacaattgcatggaagtgctcacctgattcattccaaagtgctgactgacagcctcacctgcattttggggattccttgtcagattgatcttctcgtaaggtgtaagcctctttttgcgttcttcagcatcccaaatttatccctctcctggaatcccaaacatcacagttgctcctctcacatttactaggaaattttgctctaaaaactctgaacaaacaagcaaacaaactgacaggcaccaaatgggtgtcatcagatctgcctccctaacttgtactcagtccttagatgggccctgattgtaagctgctgtgatgattccccacctggcttcacaaagccaccttccttctcaaaacgtttgatctcatcaggcccacatccaagtcttcatgtctactgacatctaactggcgttggcgtcttctggaacttcttttcgaaggtcagaattgatcttttcattgtcaaacccagtcaatacctttgtgatgattaacacttctagttatcccctttgtttcagtatccatggagacagtgttcatatcacggtgatggtggggacaattccagaatcagaaaacctagatccaaattctatctttttcacatagaatctgagctggtaaaaaaaaaaaaaaaaaaaaaaaaagccagatgcagtgactcatgtctgcaatcccagcactttgggagactaaggcaggaggatcccttgagcccaggagttcaagactagcctaggaaatgtggcgaaaccctggctctacaaaattttttaaaatacaaaaatcagccagacatggtggtacgtgcttgtagttctacttacttgggaggctgaagtaggaagataacctgaggccagaaggttgaggctgcagtgagccatgatcatgccactggactccagcctaggagacagagtgagacctggtctcaacaaaacaaaacaaaacaaaaccccacctctgtacatatcagcttctctactccacctataaaatgggaaggaataaatgacatgattacaggttatagtatctgcagaatgaagataacacccagcatattgttagcccttagtacacgataatggcagtgaccttgtctgtttcctccagcatgagctacaaatattttccaaactcaatatgattaaaataaattctttagtgtctcttttctagattgactgtgccttcagtacttcctcgctcaatcagtggggtcctccattatccagttcatgagctagaaccatttattctccatgctcttatccacttagtcatctgtttggctgagtttccaaaatacctcttgaatttacctccactctgtctccatcattactgcctttcagcctcatccttaggactttaacaataatacactatttggacatctgagcaccacctccctttttgtggtaaaagtctgtgattttctttccatgttcctaccttgcctctccactcaccctcagcttctgtgcttacccggttccttgctagtcccttagtttatctcctttccattcagaatattccttgaacgtgggttttgtattggcactttggaacagtttccattgttttccaataactccctgatcagcctagctctaaagtcactcttcggtaatttggccaatatcccatgaataccaagatttcacaggatcacgggggtaaagactttgacagccaagggtgatatccatggtaacagccagtgagaggaatgccttttgtgcaaagtagaagaaagttgattaggaaaggggtgggcttggaaaaccgactaatactgagatagccggcatactccagcagctgggttttagagcagagcacacatggatgtgaaagatctggaaattgatttccttagagcatcccaaccctttacaccccatcagcatgtctttgtgtatctctacaagtaggtgtattagtccattctcacactgctgtgaagaaatacccaagactgggtaatttataaagaaaagaggtttaattgactcatagttccacatggctggggaggcctcaggaaacttacaatcatggcagaaggggaagcaacatgtccttcacatgacagcaggagacagaagaatgagaaccgagtgaaggaggaagccccttataaaaccatcagatcttgtgagaacttactcgctaacacaagaatagcatggggaaaccacccccatgattcaagtacctcccaccaggttactcccacaacatgaagggattatgggaactataattcaagatgagatttgggtggggacacagccaaaccatatcaataggtgagccccagtctgaagactagtggcttagattattgtatttggcttggcactggtgtcattttctgcaaacctctgttagatctacagtctacccattttgcctctatgaaaataattttcccacagcgtgtatcatttttctttaaaaacttacctcatcatactggcaaaactcttgctcctggctctctgagataatccaggatcatctccacatccccaaacccttaatataatcacatctacaaactcccttttgccatggaaggaaacattctcaggatcagggtactagaatgtggacacctttgggggttgtgattctgtctacccaacttggtttccattgatgtagtttgtaaagatggaccttgatcaaaatcttttgtgggtgagccatttatatgtttaggagttcattaataatgcgtagcattgtttgtgaaaataaaatcatagttatataaatagtagtgttgatttgttcataaacaagtaatgtgaacatgaactttttctgtgtcatcatgtcaattttatacaacatataattttaatttaaaatatatatatattatatatgtatatatatatatttttttttggagttgggacagggtgtcactttgtcacccagactgtcatcctctcactggctgttaccatggatatcactctgtcacccaggcatgatctcagctcactgcaacctctgcctcctgggttcaagtgattctcgtgcctcagcttcccaagtaggtggaattacaagcacatgccaccacacccggctaatttttgtatttttttggtagagacagggtttcaccatgttggccaggctggtctcgaactcctgacctcaagtgatccaccccacctcggcaaagtgctgggatcacagatgtgagccaccatgcccagccttaaatatatatatatttttaaaggcaaggtctcactctgttgcccaggctcaattgtggctcactgtagcctcaaactcttgggctcaagtgattctttcacttcagcctcccaagtagctgggaccataggcacatgccgccatttctagctaattttttggagagacagggtctcgctatgttggctaggctggtcttgaacccctggcaaggaatccttccaccttggtctcccaaagagctgagattacaagtgtgagccaccatgcccacaatagagatttttaattctgactggtatatttgagccagttcagggatatctgatggatatagagagacaaaaggttttttgtacagtaaattaattctgttaagacaaagcacataaacaaatcagaatgttcttcagcataatcagacatgtgcaaaagtttaaagtaagttttgccctttcccttgattgttcgattgctacccgagcttcagtgctgagatgcgctacctctctgttcaatgatgctacctttggtgtttgttgaacaatttttcatcgaacctaatttagaggaaaagatgtttagctgtagatacaatgaagggaattttagctccttctggcttcatatactcccgctgccgcatcgtgggcagcaggggtatcgcctgcatcgactgagttcatctgttttcccctcactgttgcctttgattttgtccttttgcttgggttcctctctccactccgaaaacattctcaagggctgagctcctgcaaaatcctttcaattctaaatgccctcaagtaaaacattattctttcctttcctaacaaacttctcatgaaagtggttaactagctttctctagtccttctcctgaaagtgataactagctttctctagtccttctcatgaaagtggtaacttgctttctctagtcctcatgaaagtgataatgggctctctctgtccttctctctctgtccttctcatgaaagtggtaactggctttctctagtccttctcatgaaagtggtaactggccttctctagtcctcatgaaagtggtaactggctttctctagtccttctcatgaaagtggtaactcgctttctctagtcctcatgaaagtgataatgggctctctctgtccttctctctctgtccttctcatgaaagtggtaactggctttctctgtccttctcatgaaagtggtaaatggctttctctagtcctcatgaaagtagtaactggctttctctagtccttctcatgaaagtggtgacttactttctctagtccttcttgtgaaagtggtaactggctttctctagtccttctcatgaaagtggtaactggccttctctagtcctcatgaaagtggtaactggctttctctagtccttctcgtgaaaatgataactagctttctctatcccttctcctgaaagtgataactcgctttctctagtccttctcatgaagtggtaaccatctttctctagtccttctcatgaaagtggtaaccatctttctctagtccttctcatgaaagtgataatgagctctctctgtccttctcatgaaagtggtaactggctttctctagtcctcataaaagtggtaactggctttctctagtcctcctcatgaaagtggtaactagctttctctagtacttctcctctgatttctttcatattcataggatctcctgcatggtacatgtattcacacccaaggctctgatttcaaaaccaaccggcagtgaacagcaggaaacatcaatgttcccacttgttaaaaagtcatttcttgacaactgttaggcatctgagattagtcacccatctgctgtcaatgaatgagtgtatctaaaaggttcaaaatactgactctaagaactcatagaaacaacagtacaatggcagttaccaggggcagagggtgcgggtggaagaatggggagatgttggtgaaagggtacaaagttccagttagacagcagaaataaattcaggacatccattgtacaacatggtgactgtggttaatggtaatgtattgtatacttgaaatttggtaagggagcagagctttaatgttcttaatcacaaaaactgagaagtatataaggtgctggatatgttaattgacttgataataatcattctacattgtatgcatatgaagcatagtcttcagattataattcctagagagtgttcctcatactctacggcagtggtccccaacctttgggaccagttttgtcaaagacaatttctccctggacctggggtgaggggggatggttttggaatgattcaagtgcattacatttattgtgcactttatttctattattattacattataatacgtaataaaataattatacaactcaccataatgtagctgagcttgttttcctgcaactagacgatcccatcggggggtgatgggagacagtgatagatcatcaagcattagattctcaaaaggagcacacaacctagatccctcacatgcacagttcaaaatagggttcacactcctatgagaatctaatgcagccacggatctgacaggaggcggagctcaggtggtaatgcaagggatggagagtggctgtaaatacaggtgaaacttcactcattcgcctgttgcccacctcctgctgtgcagccaggttcttaacaggccatggaccagtaccagtctgtggctctggggttggggacccctgctccacagagtcagcatacaggtggaaacagccttgactctcacattctccaaagctcgcaggcaaaaattggacattgatgtcctgaggttacttctgcctgtaaaactaggtgttaatttaatgaatgttactgtagtgtgggggagtggaaatcaactattaggtaattcatagaagtcgtcagctgagagagctgataagctccataaattcccccagctacccaagattaataattttatactgaaagcaagtaattatgaatttgcctctaaatcacttttttaaaatccacactcaaaagttgacaaactgtcctcataagtcagacaccacttatcaacctgttcacagcatggaaaactcagagctgcctctccttgatggcatgcttctaaatgcagtaactcaatcctgctgtcttaaggaaggcaatgtttaatgcccattaaaggaacccttcttgttttggtaggcagggccgctatgtctgctcaccagggaatatggatgctattcgatggtaaagtgacaaacacagtagtccttaaccacttacacttttaaagttctacacacatttatgaattcaataaagtgtcatttttcaatggaattgttagaaccccaaatctcagtgttacacaatatactcgtgtaacaaacctgtacatgtatccacttaatctaaaatttaaaaagaaaagaagaaactattgttttttagcctcaaatgttaaaaatacaaataccagtctgctaactttcagatcctggagacatcaaatcaaaactcatttgtcgaagctgtcattatgaacacctgggttaataaaggaagtgcagggcaagacacatgaagagtgaagaataacaagtactgttttagagcctcctgtgaaggtaactgtaaggtgtcaggagaaacaccctcagagcatcggaagtgactctgcaaaggactcctggagtgtgctggtccaggtctcacagtgaactggcctttggactgtgaacctgggcatccccaccagacacctatcacagcccatgtcatgccaacatcacctagaggcagtgggtttctggttgtttactgacttagctctggccttgaaaacttggcagcagtttcaggagtctcctgtttgaggctgagatgaagcttctttgttctatgggtagatattgcagggatgcctttgaaaaacaaaaaacaaaaagacaatgatcaagctgggtgtggtggctcatgcctataatcccagcactttgggaggctaaggtgggtggatcccttgagcccaggagttagagaccagcctgggcaatatgatgaaacaaacaaacaaaaaaatatacaaatcggtggcacacacctgtagtcccagctacttgggaggctaagatgggaggattgattgagcctggtaggcaaaggtggcagcatgctgagattgcatcactgcactccagctaggtcaacacagtgagtccccctgtctcaaacaaaaaaacaaaaaaacctcaaaacaaccaatgatgattatttttgtcataccttcattctgttttccaagcatcccgcgatattggctttatctatcaatcatagagcaggcacttactaattcatcccacagtggttgccagaaagagttgggtctagctgaagaggagagaggtaaagctattgcacatgtgcatgctgtaggggtgggctcagtactgatagtgtgtcctcacgtgcagggtgctggcttcttcttgagcgaattctgttcccctggcctcagctggcagatactccttatcatggggtggctgtaacttgcatcaaggcctcctggagagcttttggggccgggtacctaactacaagcagaaatggactctagcattcccactgacctttcaccactctggtccttgtgcctatagtgtcttttcataaatacaacctgttattggagcgattggtggaatattggataggaaagtgctttgaacaacagtaagtgcgcatggattgtataaggtccctgggtttgatttatgggtgctgctttgaggaatgatagaaatgaggaaatttataacaattctcagatatgacaaaagacagtgagctccaaatcagccttgccttccctgtctacctctctagactctgcggggggtggtaatctggagacctccatcagttcttacagatgggaccttacagaagggaccttatatcagttcctccatcaattctgcttgcaatgagctgaatagtccccccaaaatcatgtgattcccacgacctcagaatgtgaccttttttggaaatagagttatggtggatgtaattagccaagttaagatgaggtcatgctggagtagggtgggccccatccaatatgattggcgtccttatcaaaaaagaagacactcgcggaggcatgatgtgaagacacgcagcacaaatgccctatttccacagaggcagagattcaggtgatagatctataagccaaggagtgccagcagtcaaataaatgctttatattttgcttgattttttttcacatttacagttttcatccaggttgatatttataagatgtacttttgcacaggtcttcatgtccaatttggtgttaatcttaaaccctaagactattcatagttccccaggagaaaccttcagaactcattgtacaatttaagcaataaatccagcaaatgtttagtaagacctccctctgtctgctgctggacacaacctcgtggacaatggaaataaaaagaagatgtggcttccattgggagaattacacagtggattcagggagacaagatgtaaatgccccccaaactaagatgcaaaagggcaaaatcacttgcccaagatcacacaagtaatgactcactgaactagaatttgagcctcactgtgcctggtccacagctaaggtttttactgtttcctaacgcacacagagtttgttacagtggatattaatcacatcaccaatgtaatcttgcaaaagaagacatttccattatgtagagcataggaatgagaatagtcaaatgattccgaatgccttccattctttttgagatttcaaatcaccaattagctctttcaaaattgtaataccggccgggcatagtggctcatgcctaatcccagcactctgggaggccgaggtgggtagatcacctgaggtcaagagttcaagaccagcctggccaacatggcgaaacctcatctctactaaaaatacgaaaattagccatgtgtggtggcaggcgtctgtaatcccagctactcaggaggctgaggcaggagagtcacttgaacccaggaggtggaggttgcagtgagctgagatcatgccactgcattctagcctgggcaacaagagtgaaactccatctcaaataaaaataaaaaaaaaaatggcaatacccttagcataaatggaagactagcaattctcccaccatgaacaagccaaaaagtggcttgagtaactttgcaaaacacaaatcaaattcattggccagtttgaaactatccccaatgcacaacaaggaagcaacagaagaaaattctgcagttgaaattcttctcccttattgggtcaacattattatgtttagctgatttagggaattagcttcatcataaattcaaatctggttctattttaggcatcaatgccattttatagttaggctcaactaccaaaaattctagcaatttccatcgtggtcttgaaataaacccagactccctgcagcatgactgagtttccaccatgcaaaatgaagaaataattgcctggaatttttaaaaaatcattttgcattgccaattaaaaatttactcctgcaagacaggggcttctgtaaatcagggatgtgagggatttggtctgataattccaggtgttcttcatgtatagagtgacactttgacatccgctttgattaaattcagggtatttccacagtcttgggtgacacatgctgaatattgatacacatcccaaatatctcatctgaagccctgagagccaggtgttttctggaattcagttacgcatattttaggaagataatatatgcctttactttacctcccaagacactctcagcaggtgagggcaacattcaataatcaaacacattaatatttttgcagaaaaatgtatgactattcctcccagtgggatgcaggaagaccacaagtggtataatatagtgcatttttatagtaatgcactggtaaattaaattgtgtgatgacagaccatcagtaccctgggcacttctgatttctaagtaaaacatcagagagagtcaattcagaataagttaaatacctttacacatacttgcaatatacatctgtgacctctggttgcttcggctttttgagaagaggttgcatcagggctgtcataggtctctcactgagtctgagttggccacgtgttgttggccagagaacaagaatgatcagggaacatcttctccaaggatgaaatggcaatgtgaaaaatgaccctttaaaagacttctcccattgccgtctgtcatgtgaacctggcattctctcagagcatttttgctagttgaatgaactgtcttacccactcattctcaaggccaacaatgaacagatcacacattctaaccctatcatctaggtcaggggttgcaaacattttctgtataggactgcatagtaaatattttcagccttgtggaggatacagtcagctctgcaattgtatttcaaaagtaggtgtataaaggaatgggcatggtgtatttcaataaatctttatttagaaatacaggtggtaagctgggtttggcccatggccatacttagctgacccctgttgcatggcttttttttcactgtggttcacaattccattattattattactattattctcatgcttatcagtatatggcaaacataaagttaaaatgcacatcttctcttgatggaatacaaaattccttggccataagtttatattaaatacatttcatattgaggaaaagagcagtacctaaaacatttcatttttaatgaagtctgaaggagggaggacacttcagaaactatattattttatgctttttctgttagccccgattgtctgctactggtatgcttgttattagattactcaaaaaatgtttctcaggaaattcctatttgcatgatgatgaataggtaaattgagttaacatttccatcattgtggatgttggctttttccagtcactgacaactttactttgtgtttgcctttgagtgttaacacaaccaaggactgtcaatccaagcttgcagacctccctcctgttggcttttgttaggtgttgtgaatggcacaagatcggacaacaaggtctgcacatatttgtgtctttccacgaggttggacttgtgaaaatgtttattcagtcgtaaaagccacaagagccaattctccttagtgctaagcactccttattacttcttagtacttcccattcacttggtagccagagccagggacacacaggctcaagccagtttacaacagtcaatattgcaaaccaaacatggcagtatacttaatcaatatataaatgttctagattaaacattccataacacatgttaacatgtgttgtaacatttaacatccatataaaggggataggaaaaggagttaatgaaccagtccatggagagtgacatggacaaggagagtgttctgggctgatctggatgatagcccacatcttgtaaagaagaggccttgatttgggcagagggttcagcagtgggtacatggaggagaccacgagtgttagcaagacggggtctagtgaggtggtcatgttgaactggtgaagtcctgctaatatccccctgagtcctctggtgaggggtgacagtaaagggttacaacctcatctgattgggtgcagtctgtattgattgggcgaacatctggtcctattgggaagatgccttctgaaaagcaagatgtaatcttctcctaagatggagtcacttatgtcaagagtgctcctatacattagagtttctctaggattatagcttagtagcaaggtgggctatttgatcagcaagatgaggctatttgatcagcattgtaaatatttccgggaataaactgtttctttaaaatcagatatcatcttaggtcaagtcatgggaaatagactctgaggtgctcaggagattttttgtggggagtgtattcttggggtcaacacttgcaggggagtgaggaaaggaaattgaggccaagggaggagttgagcagcacagctgttgcaacaaagacctcagctcatttcagagggagctctggagccaggaaggtccctcagaggtttcccaccttgaggcaaggagatgccatccccttggaaaaggcagttctctttgaccgaggccagtttccagagacagactttgctaagtgtgtcagccatcaaaactatcagcagcagctgggggaggaagacttgggtcttcccttgacatctaagttgctaccacagcacccacaaaggacgttctctgtgcaaattctcggcaccatactctatgtcttcctcttcaaaatacactttttcaccctggattaccatttacccttgtaaattccttcaatcaatctctagaatattcacagtggttttcagtgcttacttctacatggaatgttctggaagctttcacgagaaagtaggataaatgactcatcctagcttgcctgagactgtcccagtttgaaaactggacctcatcagtcctagacacactgggatgtggttcaccctatggcaaatcaatcagtcaaatttcaacaactaacctttccactttgtatactacagtcagtcttctttaataactacacggcctgggctatggctaaggagaaatgcattctcttcttcttctcactgttgaacataggatgcctttaactctttttgacattttcacagtcaaaattaaacccgtgccattaaacctgaagtcacaacaaagtaacacaatactaatgaacagcagaagctggtaggctgagacaagactgatgcctcaagttggttcagtctgggttttgatgctcaatacaacaaaatgggcattacaaaaatcatttggttttcagggctttttgtgtctcagaattatggacaacggatggcaaaccccaatggcattcttagatcattatcattttcagacttgtacaactggaatttcatttggagggggcatgcaaatgagaaaaatggccaagcaaatggcagttgtgaggattatagataaacagagactcaaggggataaagatgcatacttattatctttgaacacacaaatcagaatgtaggttcctcataataaaacaggcttaaccaatcttcttgctctgtgactacagtttggattatatattttatcagaagagacttattttcatataacttgtgatagtaacagaggaatcaccatagttactaggtgcgattgtttgagtcagctgggtaccattccccttcacccctaaaacctatttgcctgtgcttgtagccacacccactttaatgagcattggatgagtgatctagcacagcattcctaaaccttggcactgttgacacttgggagaagaccatgctttgttgattgagggcgggcactgggctggatagttctttgtcttgggggctgccttgtgcattgtaagatatttaccagaattcctgccctctgcctactggataccattactgtcccccaaattgcaacaaccaaacctgtttctacatatcaccttctgttcctggtggggtaaaattactcctgggtgagaacccatctcatactaatttgaaaaatgtcctcggaacgtgggcctttagattttccattgtgctgtttcattctgtaagtataggctcttcgtggcagtaccactgtgataagcattgtgacttaatcccttcagatatgttctttgtcttcatttctcactggggggttggtaagcactgagtatcaagtgtgggtcaaagagcttccatgctgataccttaaaatctattttctgtaaataaaaggtggggacaaaaaaaggaaaataatgacctttcttatctcgcaaggagagacgcccaattgttcaaacccacatccatgcaatcttagtcttgcctgatgatgtcatggtgaatgagcagaaggggagaccctgcccagtggttttgtcattcctgcagtgggaggttaaggatcaatgttgacagcacactattccatttcaacaagaatctaacatgaaaagccatgctggaagattgattacagtttcaaatgccatctctggggggaaaaaataacatttctgagattctgattgaacctcagaaattgttgctagaagcctaactttaataaagcaaaatccacatttataaaaatctatatggaatggtaatttttctctgatgtgatattctcttgtgaatatttttttttaccaagtgggattatgcttcatatttcaaagcataaacaatagatttatatattaataaatagttcaagacatatactagatttttggtctaaatgtcaacaagttaaaagaaaagtcttcaataggttcaaagctatcttcttggctttcttttgagacccattttctattcatttctaggactttgtatcagaggtcaaaaaactgtttctgtaaagggttagatagtaaataaatatttccagctttgagggacaaatagtatctatcacaactactcaactctgatattgtagcacaaaagcattaagggagtggaggcagctgtgttctgatacactttgtattacagacaccgaaatttgagtcttacgtacttttcacatatcccaaaataatatccttttttcaaccatttaaacatgtaaacattctatgaaaacaggtgtcaggacagatttttcttgtgggccattgtttgtgcaaacccagccctattcagaaaacatctattgagtgtttgctgtggtgaacaaatgagatgtggtctctgccttcttgatccttagagctgtggaaaggacagctgtcacatgaataaatcaggaaataaatgaatctattatacaagtagtaataattgctatctgggggaaaagaggtgctataatagtcaacagtgggggagcctgcttcatacagggtaatgaaggagggcttccttgtggcagtggtgtaagccaagaggtgaggatgggtaggagttaggcagagagtgggaagaagaaaagtggggagagaaatcctctagaccagcagtccccaacctttttggcatgagggaccatttttgtggaagacagtttttgcatggacagggagggggatggttttgggatgattcaagtgtgtcacatttattgtgtactttatttctattattattacattgtaatatataatgaagtaattatacaactcaccataatgtggaatcattgggagccctgagcttgttctcctgcaactagatggtcccatctggaggtgatgggagacagtgacagatcatcaggcattagattctcatgaggagtgtgcaacctagatctctcgcatttgcagttcacaataggttttgtgctcctatcagaatctaatgccatggctgatctgacaggaggtggcgctcaggcagtaatgtgagtgatggagaatggctgtaaatacagatgaagcttggctcacctgttgtttacttcctgctgtgcagtgtgattcctaagaggcctaggggttgggaacccctgctgcagtaaagaaagagcttaagaggctgggcacagtggctcacacctataatcccaacactttgtcaggctgaggctctgtttagcccaggagtttaagaccagcctggacaacatagtgggaacctgtctctaccaaaattacaaaaattagccagctgtggtggtacacctgtagtcccagctacttgggaggctgaggtgggaggattacttgagcctgggaggtcaaggctgcagtgagccatgatcatgctgctgtctgggcaataaagtgagaccctctctcaaaaaaaaaaatactaataataaataaataaataaaagagcacatgtcatttaagtatgtcaatatatgattacccagcgtgtgattattcatcttttgaatgaattcacaggaagagcccgatgcccttggtttgactctactaagagcccctcagttgctgaacctgcacacagtcatctcagtaagttaagatcttcctgaggacaatggcgcaagatcgtcttcagctgttcatagcgtaagtatgagaggtgcatatgtttgtatcttcgccctgaaactcaagtgtttgactcacccagaccatgttgtctaagtcaaatagtggtatgcagtgatcttgataatggtattgaggacattctgttattgcagggatgacatacacatggtgctattgcagctatctttcattcagaaagaactttccatcaaaaggtcaaaggggagcatctgtggggcaaatatatttttatagagaaagactgtcctgggccaatgggggcagcgtgcataatctgatgagcataagcaagtggcctattatgtggcaagtctagaggaatataggtatgggggcttacaaatgatttaatgcatcctctggacccttgaggtggctctactctagttgaatcagcaaaggtacagaaacatggcacagtgggaaggctcacagtacacctgttctcagctgatcagctgcagcaatacctgagggacagaatggggtccctcctctcaggaagagctcctccgcctggtggaggtgagggctgaggtcatacccaggtctctccctgcaggaagagctcctttccctggtggagttgaaggttgagggtatatccaggtccctccctgcaggaagagctcttccccctggtggaggtggggtctgagggcataaccaggtctctccccgcaggaagtgctttttcccctggtggagttgaaggttgagggcatacccaggttcatccctgcaggaggagctctttcccctgatggaggtgagggcatacccaggtccctccctgcaggaagagctcctccccctggtggaagtgagggctgaggggcagagcatggtccctgcctgcaggaagagctcttttcgctgatgggaggtgagtgtgcatggtgcaagtctttagggtggatgagggaaacatagttttaaaagcccctgcagggaagaatccctgttattttacacctgttcttggacatgtctggaccactatggcactatgctatcagaacaccagggggcacaatatttggccattcagagcatttatggtcccccatagcagctggctcaaagaaatgggcaggaagatacttttggaggagatatttggttcaaataagtgtgaagagactcccaaagtcagagaccctggggctggggattccatcccaccccatgctggcagtgtgttcccaggagaacgtttcacctcttcctgccttagtttcctcctttgtaaaaagcgacttaaagatgctgggcccggtggctcaggcctgtaatcgcggcactttgggaggccgaggcgggcagatcgcctgaggtcaggagtttgggaccagcctggccaacatggtaaaaccccatttctactaaaaatacaaagattagcccggcattgtgccatgcacctgtagtaccagctacttgggaggctgaggcaggataatcgcttgaaccccgggggcagaggttgcagtgagctgagattgtgccactgcactccagcctgggctacagagcaagactccatctcaaaaaaaaaaaaaaatagatgaacggcagtttcatagggtgcttatgaaacgtaaaagatgacctctgttttgggaaaaatgtggtgaagacctggatgatcctgccagccagggagatgggagctgaaagcgggcttgcagggtgatttaatgattttcagaaggcagcttcgggggttacggatggtagtagttatgtgtcagggtagactttgcccttcagagagaatttggtaaagtttggagacatttttggtcgtcagaactttggagtggggtgcatgtagtgggtggaggccaggcgtgccgctaaccatcccacggtgcacccacagttcctcacaaatccgaaatgtcgtgctgagggcgacaaaccctgctcactgcaacaagaggctttaacttaatcttctctttcttcctagaatagtcaatggtcttttactttgagggatatgagtcagaataagaattaaagagaacaaaaggacaatgaccttttaggatttttctttctattaaatttaaaccccataacagaggattctccgtctgaaagcaacatccgtggaggcttaaagcctcagcttatattcattcctaacacttagcagcttaacagattcattttccattgtgatttctgtaatttgttctttaaaaggattgtgtgttcctttttctgtttcagaaacaaactttttgggcattttcaagaataatttattttctaaagttattgataatacacgggctggcatgaatttctgacctcgctttcaaagtctttagcaccagctaagtagggttttttgttgttgttgttgttgttgtttatttaatttctttggaaactgtacattttgcagggaaatgctttaagtaccttttttttttttcggtcattttagtctacgggagagattgacattccctagatccagctagaagggctctgaaaaaaatgacagatgcagtagctaattaaaaatatgcagctgaaagggttcatgattaattcatgataaacgaatacagcattcattatcctttcctaatgttctcagataaagtgggagtgttgcagtgggggttaaaatatttgttctaaatatctagtaacagtgtccattctatcttactagcataaagccatcctcatagaggtattttaatgtgcttcacaattcagaattcagggttcttacatacagagtattaaactctctccctcccataaatggatgaagactttggggattgtcaggagaacacttatattgtctgtagttttcctgatttgttctcctccaaggaaaaggtttagtaataggaaaatattattattattttttttgagacagactctcactctgtcgtccaggctggaagtgcagtggcacaatctcagctcactgcaacctccacctcccgggtccaagtgattcttctgcctcagcctcctgagtagctgggactacaggcaagcgccaccacgcccggctaatttttgtatttttagtggagatggggtttcaccatattggccaggctggtctcgaactcctgacctcgtgtggaggctgggatttttaaggacagtttggcgggcaagaggctagagaatgggaaaggctgattggcaccatcagcaaagaaatcacagagttatcaaaactgtcgttgtgtgccgagtcagttcctgcatgggggtcactggtccagtgacgtcacttgttccaccagaatgcaaaatctgaaaaatattttacataccagtcttaggttttacaatagtgatgttatctataggggcaatcagggaagttgcacatcttgtgaccaccagctacatgactcctgagcagtaagcaggttacgaagcaatggctagttatcatgcaactatgtataggtcttagcagaatgcaggtccctcccacaagtctaaccttggggccgttcattagttttacaaaggtggttttggtccccgaacaaggaggggtagttttgggaagggactgttgtcatccttgctttaatgttaaactgtaaactaaaatcctcccgtagttgacctggcctacccagaaatgaacaagggaagttagcttgtgacattagaagcaagatggaaccagttatgttagatttctctcactgttacaatttttgcataggcgtttttcaaattcctattgctttgttacgtgatacagtcacgcatcgctggatgacagggatacgttctgagaaatgctctgatgggtgatttagtcaccgcgtgaacataatagagtatactcacacaaacctactatacacgcagactgtatggtatggcctattgctcctacactaaaaacctggacagcaagtgaccgtactgaatactgcaggcggttgtaacacaatggtaattatttgtgtatctaaacatgtctaaacatagaaggtactgtaaaaaatatggaattataatcttataggactaccattgtatatatgattcatcgttacccgaaacatcgttatgtagtacatgactatatttataaaataagtgtggaggccgcaatgtttcttttccatgttgcttctttatgtagtattcagcacgtgggagatttttgtcaagaagtgcatttagaacttgtctttggtaatacctgtaccaccctccaaacttctcaacttctactcttttacccaagacagggttcacgtgacaacataatgactactgaatacaatctctagagttgtctcaggatttatagacatagtagtggatttcacacttcccattctgtgtttgtctctgcatggtttgcagaatcaggattaacacaggtgttgtggctctgtggacctgtgaattagtgcaagagcgacaaagcctgtcttgctttttctcggcaagcacaccctggcttcagaattgagaataactttgttctatgttttaaaacatagtgtatagaagtgcctaaggaagaaaacattgcatttataagaagacgtcttacaaacactccagccaaacacttaatttgctatctttacatccactctagtgaaagcacttagaatgtttgactttatgttcagtgcttggcaaactgctcctgttggaaccctcagggttcctcaggctgctcctgggagcttcttcagccctgcggtgggaattgtcagagatttaattccacccacttctgtaagaacagcactgattttcatctctattagacattcttatggatagaagtttctgtgactaaaaacaatgacaaccattactttctctacctgttctgttttataacagaaggcaacactgaagctgaaagatattaagctgtttatgtaaagactagataaggtctgtggataccctctcctgcatcttagccgtgatttctttagctgaattattgcatagggaaggaaaaagtaatttttcctctaccctgtctgagttcttatctaggacagacccttgtaacaaaaggcagataaacaagagaaaacaaatagtttattaacatggatacctcctgtgtatctgggcaatatccaaggaatattgagtaaatctcaaagaagtgaaagagagaaaggtgtgggaagggacagttatggagaagtaaccaggaaaagtatggtaaaccagggtaaggttggctgtgcacatttcagttggtgccttctccaaccttaagagtgtttaatcattcagccttccttctcttccagtaccatgaaggagaaacccttacaaatggagatttcctttacagatgtaaatctctcttagaaaacagtaacttctactctgttttaagagcttctcctgtgtctgcaattactcaaaataattcttacgccaaagaagcacattgtggggtgacgtattcttgtcctttcttactgtactgatgtaaaaaaaaaaagtgatatatgcatatgtgtgtatacacctctctctccactgtcttctacactttctagccatgggatccacaccaccaccactacaactatcagtgaccaccacaacaaagagatggacggattttagtggaataaattattttcagactcaaagatctttaatgcaaacaatctgagctgtctttcatttgtttcttagctgtctcttcacgtgtacctgtctctctatctgtattttggacaccttgggctgagtcatcttcatgtcttaggtatgcaactctctggtctcctggtagtctgcctgtatccatcaaggtctccctctcaccaccagcagccagaggcaccttctcaaaacccaggcctaaccctgccactggccctgttggaatccttcaatggcttcccgttggaaggaaggtggaatttcagaaccaggcctggatgggtctccattgtctgcctcctacctttcttcctactctcaggtcctccctgcatctgcctccccctggctttcttttaccccatcaggcaacttgtcttaaaacctgtcctactacccaggctgtcttcccctcagggccatctccccagccaactcctccttccagtaggcttccttcctctctttggctaagtaatgaccactccgtgctccaggcactcttgttgcatttgcagtttcatactatttcttgtgtgattatttgtccaatattgattatttgaataagatctgactttgcaaacacattgcaaagttctatgaaggcaagaccatgcagtgcatcctactgttacaggaaaggggtcccgagccagaccccaagacagggttcctggatcttgtgcaagaaggaattcagggggagtccacagtacaaagtttattaagaaagtaaagtggtgaaagtacagctactccatagacagagtagggcgttcccgaagctaagaggaggaatgtgtccactctaggtacagtacttgtttacatataggataaaaaaagatcatggggtgatgtgctctgctacaagtgtttgtgataaaggattaattttcttaattgctatattttacaagaatcgatattattatatttaaagcaaaattaggaatgcctctgttctcaagatatcagggtgttaggacactcccagttctgggtctgtttactaaacattatcaatctgttcccttaaccgtaaacatctagaggctaggaacacctaactttctgggagtgcagcccagcaagttccagcctcattttcctagccctcactcaagattgagtcgctctggttcaaacccctctaacactactgtatccctacgatgcacagcgtgccttagtagatgtttagtaaataactgctaaatacatggatgaaaaaaatagttccaatgccatattaatacaatactgataaaaattatatatttttggatttcagtcacacaggcaaaaaacaactttctgatatgatttagccaataactgacaccaatataaaaaatgatctgtaacccccccaatggattatctttgcccaggtagagcttgtttatcaagacagaaatagagaaagaattgaatgcacacagagccagttaaatgggagaccagagttttattacccaaatcacgctctctgtgcatttggagactgagttttttttaagggaggtagggggttaggaagtgaggaatgctgattggtcagattggagatgaaataataggggcccaaagtgggttcttcttgctgtcttctgtgcctgggtgagattgcagaactgattgaggcagattcctggtctgcatggcaccagttggtagatcagatcacagggtctaaaaaacatcttcaactccaatcttaggcattccaatagtgacggtatccctaggaccaactggggaggttgagaatcttgtggcctctgactgcaggacttctgagccatactttctaaacttgtggcgaatttgttgtcctacagaggtggtgtgtccccaggcaaaaatgggatttttttccggaaaaggctgttaccatttttgtttccatgttaacactgtaaattcctcctgtagttagctcagtctgtgttcaggaatgaacgagggcagtctgcaggttaaaggcaagatgtagttggttaggtcacatctctttcactgtcgtaattttctcactgcttttgcaaaggcagtttcagatctttaaccctgtctggggtttcacaaactttagccttgttctgttgagtttatatcctcaaatagggtgaagcctaatacctgttaaaagattttatccagtgaacctacccaagattccagaggaaagcaaaaacgtctgctgcctggcagcaagtttttttttttttctttatagagttttaaactaaggtccatgaatttcctgccatattttcctgtgtgtgcttcagctgccttactgacaatcacttaataagtatagcagttccttagtttatactgcatgtgagatagctggcttatgagaataatttttctatataaaattcatatttaatcctccattttaggagtgagttctatagaaagttctatggaaattctctattttaggagcgagcctgcaatacagttttcaaatacaatattatgatatttgaagtcaatcaggaagtgatccatctatactacaacttctcatcatgtttcaatataaaatgttggaagagtaatgaagtgtccaaaattagattgattttataatttagggtcacagccttctaattttacaataataatcagttgacaaagaatggttagtataatacttgtgttaatcgatcctactttctatctctattttattaaaatcaactctgaatgttatagcatagtagaaatttaccacttattataataaatcgtgttttcacagtttcctcttctcttaacttaaaacttaggttcttgcttagacttctaaatttttatgactgttttagtttctgggagtccttagggtttttgcagtttctttccagagcctgaggggctttgctgtatgtttgtgtgatatttcacacctgatgaatggagagccagttgatattagtcatctgtcaactttatttatttcaagattccagtattcagagtgggggttgattaagtacatagccaatataatatacatttacaataatgaatcagatgtcatttccttgcttagttacttatgttctttgctttttaaaataaggcccagaccagttattctgagatccaaactttgactcttatataaatttaaggacatttttctttgctagaaataaaaaaaaaaataaattacctaataaaacccttagctttggagacattaccatacaaatgtaaaagataagtatgtgaagcacatttaataacactgaacctaataatgataactcaaactcattttgatttcctacctacaaaccacacatttgaagtattagaaaactttgtgagctttcttttttttttttttaataatactgttgtgtactttatttcaaatattatcctaggtcctcttgtatgagaatatctagaatcagtttagtctttaattcctagttttcttcttagtcctttgaaaatattatttaagtaatattttttgttttttactgctaactccccaaatttgttataaggaatatttttgttattttcttctttcatcgcatgggggaagattcaataactatgatgtaattcctttaagaaaatttttgtcagacatgtcggaaattttgaaatcccgtatattaactctagactctcaaatttcaaatcatattatgacgtctctgatggaaaaacatgcttcagctttctctgcctctgacatgtaattgataacctcatgttctcattttgggagatagaactagtgaaatgggaccaagcaaatgctaaaaacaataaaatgagctctcttgctgtctttggatgtttcttggaccaagcatgaaaaagatggatgaaacggaaagggaggaggggagatgatttttcgtttgtgtgttcagtgacgggaaggagatgccaaggacaaaaatggatgccccagtgccacagtgaacatatttccttagctctgagtttggtagtgggggcttctgtggattcacaccaagaaccgcagtccaagcatattttgtagtctcatctgacacatttctctaaagcttagcccttcttaaactctcatgtttcaaccactttgccccctttcccctgttcacctgcaagccacacatgaccctcagcacatatgacaagagctgtctttccacatgcagtttgctttgccacccacagtttaaatgaagctatatataaaaccataaactggttagatgggtggatggatggatggatggatggatggatggatgatagacagatacgtagataaatgatagatcgatggatgatagataggcaggcagctatatagatagatgatggatgcatggataggtagatggatggataaatagatggctacatggatgatagacagatatatagatagatgatggatgataggcagacagatatgtagatagatgatagataggtggatggatggacagataaatagatggatatatagatatatagatatctagattgatatataggttgatgtcagatagatggatggatagatagatagcagtttccatttctgtacttttatggttttcatgttgagaatgttctcaaagggacatgtttgtggttaaattttctgaatcaacaacaaatatcactccttcaagattgctctctcagcataaaaacctaaaccaattttgtgtttttatagcctctcttttctcacacacatacttaactttttaatttttttttggccagagttgtggctttatgaatcattattagaatcattattattatagagaagggtcagcaggccctccacctagtgaatgaaatttcatttccatcctgtctcctttctgcttgtgctgtgggaggtatgttctttcatcacatccatttcactcttcaaaggcattcttctcaacagtaatccactcgcaagttgttattgcttcatggtttgtgtagatgtgggagatccgctgtgctttagggaactgcgccagagatttcatgcgtttgtctttgaacactgatctagagactttcagctatttgggcttcagggatacaagaacagagaagcctttagagagtccagatctgagccctcctcagaagaaggaattgtctatgtttgttgctaggatggacccctgacaacatggccacctgttctgttttctaatccacgatgctcataatggttaattttaggtgtcagcttgactggattaaggaatacctagagagctgctgaagcattacttttggatgtgtctgtgagtgtgtttccagaggagactggtgtggccagctacagaaatgaggactgtcattgtcacgagtattttctccccattttgttaagaatacatctgtgtgtatatataaatatatttagtatcaagataaaacataaatacatgtatttagcaaatatctttgttttcattcctctcttattcctttattatataacataaggtatattgactttatatcagtatatgatatgatggtttgtgttttcctgttgagagcgttcttggagtatctttgttattgactcagaaattttgaccacaaacatgtttgtttgagaacattctcaacatggaaaccacaaaaatgcatataatatataaaccactctattgactacctctctatcagtatttaagtattattaattttacctcatggtatttaagtgatgggatgtcaggagaagagtcaacatcacccaaggacttgacctcctcttccggggaaggggattactgcattttcagctgtgtgcagaatggttacatcacgttaggtggaactgttgtaattttcttatcttcatttagaaattaagtatggtttaaggagatgcttatgggtgccaagttgatgatgggtggatttgtgatggttgattttaggtgtcaaattgactggattaagggatacttagagaactggtaacatgttcattacttctgggtgtgtctgtgagggtgtttccagagggcattggcatgggagttggtggactaagtgaggaagatccaccatcaatgtggactggcaacatccaatcagctgggggcccagatagaacacaaagcagagaaaagagttccctctctctctttatctctctgtctctctccctctctatctctatctctgtgtgtctctctgtgtctatctctctctatccatctctgtctctcgctctctatccacgtccctgtctctctgtgtctctctccctctcttcatctctctctttctttccctggttttgtctctgtctctccctccttgcctgtgtctctgtttctccctgtccctctctttctctctcttcaagctgagacactcttcatctctagccctagaatattagagctccaggctctcccacccttggactccgggatctatgctacccacgccacaagttcttaggcctttggcctcaggctgagaattactatacttagaacattcttccatggggcaaaaaactctaaagattagaaatctgtattagttcatttctctgcaacaggtatttattagacacttaccatgtgcttaaaaaataggaactaaacaaatttctctaaaaaaaggaaccttgttagttttttctgattatgtgacaagggacagctgcacagggatcagagctcattaagctgaagttctctaaattagggtctctttaggccaattgtaagcccaagttcattttctttttattcccactagtaaaaactatcacatttgaggagcattgtgaatttatgacactttctccatcagtaggaatacactatgattaaattgtactttgtaaactgtttttttctgtttataaaagtaagtagaacattttatatatacaagaatttataaagaatcatataaaaccactggtagttctgctccctgcaaactaatcccaaataaaattatatcatcattctttccagttatgtgtatgcctttctatacaaacatatgcatatgaaacatacatatccatatgcaaatatatatatatatagagagagagagagacagggtcctgctctgctgcccagggtggaatacgatggcacagtcatagctcattgtagcctcaaacttctgggctcaagcaattctcctgtctcagcttcccaagtaggtgggactacaggcgtgttctaccacgcccagataatttttaacttttttgtagagatggggtcttgccatcttgcgcaggctgctctcaaacttccgtcctcaagtgatcctcccacacttggcctcccaaagtgctgggattacaggcatgagccactgcacctggacagattgtttttcacatttgtgctgatgttgcctttatatcatgtttggttctgccttttacaccctaaaattataccataaggttttatatatgaaaaaatattcttcaaaaatcgagaatattctagtgtttaatttattttttcttcaagtctcctacttcttaattttctaacccaagtgttggcatgccataatatttgccaaatcagtaggttaaaaatagcattttccttgtgtttaaactttaattttctttgatttcctggtgaggttgaacattttccatatttgtattaatttacaattgttttctcattcatcatttgtcttttgccattttaaaaaatattagatgttgattattttctctgttgattccccttctttccttcctccctcccttccttcctccctccctcctttcctcccttcctccctccctccctccctcctttcctcccttccttcccttccttttcttcctttccttcctttcctcctttctctccatcttctttcttccttcccttccttcttccctccctctcttccttttttctctctcctgccttcctccttccttttttcctcctcaccttttctctctctccttctttcattccttcatttttccttccttccttcccttctttcttcctttcttccctctctctccctcctttctccctctttcctcctaacttcctctctccctgccttcctttctttccatcccttcttccctcctcccctccttccttcctctttgcttgcctccctttttttccttcctttcccttattcctccctccttcgctctctctcttgctccctaatcagttacttatgatatccttctccactctgagaccatggatagtcatgattgttttgctgacctgctttgtggccccacatggccctaggccaggtgcttctgttgcctgttgttgtacacacactggtgggcttgggcatgtgtggtacccagactccatggacaacggaagaagaaatataagatttggagttgttagtaaaatagacttttgggcaattgcacaatcatccatgctagcacaggaaagctcttagcaggtgtttctccttccagtttactttgaaagaagaggggctttccctgcctacacaccaacatcctggtttcatagtgaggaagagaaagaatgggaatgtaattattgcaattattattcatcacgttttgttgttccccccaagctaaaagtgacaactctatgctgtggttctttggggatattacatgtgagagtgcaaccacagaaaatcacatcaattaggcatgaaggctttctccccatactgactagcagcttgcttgggagcagagaccttcagcttgaggagcaaatagtgggcactcagtgtattcactgactttattcaggggccaatgcaactgtgtctggaggggttggctggtataaaactgtaggttggaaattatttggttttctttttctttttctttttcttttcttttctttcgttttcttttcttttcttttttctttttttttttttttgagacagtttcttgctctgttgcaagagcaaggcactcctggctggagtgcagtgatgcgatcatagcaatctcttcctcctgggctcaagtggtcctctcacacaccaccaccatacctggctaattaaaaaacaaattgtagagacaaggtctcgctatattgcccagtctggtctggagctcccaggctcaagcaatcttcctgcctcagcctcacaacatgctgggattacaggtgtgagccaccactctcggtggaaatcatttttcctctggatttcacagtcattgcataattgtcttgtaccactcagggtaaaggccaaagccgtgatttgattgtatgtaacccatccacccactgcaccccctatgcacttaggattttgtcttggtcctctgtatcctaaggttccatgaaaatgggctttgctctgggtttatattccttcatcgttttgggcccccaggcctgttcaatactgagattcatgcccttcagttctaaaactatattttgttttattgctttggtaatctcttgctctctctcagtctcttcctctggaatatctattagctgaagattgggacctggttatgatatcctaattttcatgtcttttctctcctgttatcaatcaccttggctttttgttccagttctctttgagatgtcctcaccttgatcttcgcagcattctgctgaattacttcatttatcatgttccgcatgcccaaaagttctattttgttctctaaatgtacttttctcataccatccttttattatttatttacttattgatcaatcttttcttttctttttttggttctttgatcgctgtccatatatgaccagccatatgacattgctgatagttaaccatactttatctgcaaaaatggctatttcaaatgattcatcctatttgataaagagatgttatctcacttatcaataatgaaaacccttctttttcattccaaaccaacatagagctgtgtgatccaagggccttaaataagaggcatgcaggtatctgtatgcataaaatttaaatcttaatttaaggaagtactaacctgaaagctatgctgaaggatttttgttgtgaatttgattattattagatacatcatctcgatccaatggtcatcagagggaaaaaacagttacttagttttggtttggcagacacaattgatattctttttctgtactccattttaatagcttaaagttttcattaaaaattacaccttgggcttggggggcaatggctcatgcctacaattccagcactttgggaggccaaggagggtggattgcttgagcccatgagttggagaccagcctagggaacatggtgaaactccatctctactaaaaataaaaaagtcacttgtcatctcaattactcaggaggctgaggtgggaggatccctcaagcctgggaggagggggttccagtgagctgagattgtaccactgcacttcagcctgggcaactgagtggcaccctgtctttaaaaaaaaaaattacacttattctctcatgcaaaggaaacacattttaaagagttgctgattgatttttctgcattgcccaggagttgcatttttattcaagaagtaacaactagcaccctgtcctcaaatctcttttgcattgccgacatgaatttgttggcattgtcttcaagcatttccaggatatgtgcaagttacagggatttagattgtacctggaagtacaggattggagaatggtggttaagctttaacaattcagtcaagaaattctttgttatgaacacttttaggcagggaggaagtttagagttttccatattgattggatttatacatattaatttttttctaaatgatgtcataaaagggtcttttaggtaatgatgaaataaccaagtcccagtaggaaggtttcaccatatagtacaatgtaatgatagggaaattcagagttcaaagtattttaatgtcataaaccaattttgagctttaatggaagaaggatcattatgcacaaatgaaattgcatatatattttgttatgtttttgtaaaatcattcataattataaactggtcaggaacttcacaagtaactgaagaattatactataacttgacagaaagaatcggctattcgatagcaggctcaggggtacacatacctttttaatatcatgacttgtccacaaattgatgtgtgaaacaattttccctgttgtactctgctttaggagatgagatgattgtagggggcaaaagaatggtttcccagcctcctggtttgcaggacagcagaaaaaacagccattcagttggatgttattggaatcaacaacaaagagactgaaatgctcatttatctattacggtaaaatccaacatttgcttcacatacggtgatacaaagcaatagcatttgccgtggtatttgaaatacagtaaaaatatgagttaacaaaacttgggcattaagctatttctctccaagagataatgagtgtttcttattcttcaaccctttatactttattttttaaaagtgtctttgtttttaaagaaaagagatatgcttattgtaaaaaaatccaaaaatcagaaaagcatagaaaagaagcatatgatagtctatactcaccatggaaacagtttacagatataattccagaattttctatgtgtaatatatagaaatggcaggttactattcattccactttataattttctttaaatattttgtgttgatataattatagactcacaagtagttatgaaaaaatggtacagaggagtctctcctaccctttaccctgtcttctccagtgataacaaaaactgctgtttttcagcagatcttttttcttgtatttctagacttggaaactcctcagtagattcaaataatttctgtctccacctcccttcttcctctctccctttcttctttctttcctaccttccttcctccttccttatatttttcctttcctttctgtaatttccaaacactgctataacacgttatagtgaactgagtgggttaaaactatgtaaaacaatataaccttacagttcgggaagtcttaagcacaaagtgggtttcactgtcctaaaatcatggtgtgggcagggctgctttcttttctggaggctctaggggttgaattcctcttcttgccttctctggcttctagagggcacctaccttccgggctgctgggcccttcctccatcttcaaggctggcagcatagtgtcttccagtctctccccacctccttcttagaggggcctttgtgatgacagtgggcccacctggctaatccaggaagttcttcccatctcaagatccttcatggcacttgccaagtgccctttgccatgtaaggtaaagtgtgaggtgccagggatcaggctgtgggcgcctcgggcctgaccattacttagcccacaacacgtccctttcttctttctgttttgggactggaccatccagccaatagattctgggccttttttacatgtaggggtggtgccagatcttccatagcaggtaacattaagttgtagttcaatcaatatttgtagatggaattaaaaactgaattgcaatacaaagattaataccacagattttaaaaaatatttattttcatattatgtattttatatataattttatatataaatgcatatatatgtatttatagaaatatatatttttatacttactattatatagtataaatgttttattttaaataaatatttatttaaatattaatatatttagttaaaatatatgattaaaaatgaaaaaaattatttttaatataatttaaaaatgaattcgaatagatgaataccacagatttaaaaaaatatttattttcatattatttattttatatattttatttttatttttatttttatttttatttttaaatttttttcttttgtattccttctaaaaaaaactgggatacatgtgcagaacgtgcaggttagttacataggatacatgtgccatggtggtttgctgcacctattgacccatcctctaagtttcttcccgtcacccccacccccaaataggccctggtgtgtgttgttcccctctctgtgtccatgtgttctcaatgttcaactcccacttatgagtgagaacatgcggtgtttggttttctgttcctgtgttagtttgctgaggatgacggcttccagcttcacctgtgtccctgcaaaggacatgatcttattcctttttatggctgtgtagtattccatgatgtatatgtaccacttttctttatccagtctatcattgatgggcatttgggttggttccatgtctttgttattgtaaatagtgttgcagtaaacatacatgtgcatgtgtctttatagtagagtgatttatattcctttgggtatatacccagtaatgggattactgggtcaaatcgcatttctggttctagatccttgaggaatcaccacactgttttccacaatggttgaactaatttacgttcccaccaacagtgtaaaagtgttcctatttccccacagcctcaccagcatctgttgtttcctgactttttaacaatcgccattccgactggtgtgagatggtatctcattgtggttttgatttgcatttttctgatgatcagagaatatgcatttacttatatatatctatacacacacacgtattcatagaaatataaaatatttatatatttatacaattatacaatataaatgttttattttaaataaatttttaaatattaaatatatatttataaaaaatagatgtatgtataataaataataaacacttaatacatattaaatatataaattgatgtatttatatttatacataaatgaataaatatttttatattaaatgtataattataaataaatcaatgtatatataaatgtatatttaatatatactaggtgttatatgttgaaatatatattaaatctataaataatattccttttaatactttataatattttaataataactttttaggtaaaatatgcaaataaatttctaaaccaaatatcccagcctgagatctctagctttggatagaaaagcatttactttttagcaaaattaatttttttaagtgaaaaattaaaattatgtatatttagggtatacaacatgacattttgttttttatatatatatgtatgtatgtacattatggaatggctaaatgaagctacttagcatgtgcattacctgacatactttgtggggagaacacttataatctactgttttgtaattttcaaatatccaatgtgttgttattcactacacatgaatgttgtagtcaccatgttgtaggaaagatctctggaactcttgctcctaagtgaaactttgtatccttagaccaacatctccccaatgaaaaacacttactttaatattcactccactgtattcattttctattgctccatagcacacagtggctggcaacaacacctgtgtatcttctctttgggctcaggagtccaagcaaggacagactttaccctgctcaggggatcgccaggatgaaatcagggtgccagctacgttgtgttctcccctgagcctcccggtgctattccaaattcagtgcatgttggtagaactcagttccttgaggttctgggactgaggtccccattttcttactgctggaagtcctgggccactagtaatttctaggtctgtggaccccacaggaagttcacatcatcaccgtcagcttctttgtgggcaccagttggtgtccagcatctctgtccgacttctggccatcttagaattctgcctactactcccacgaatttttctgggttggcttggccttgccccttgtagaaagttgctctgcagggaaaccactctctttgtttttccaaccagtatttctcatgttccacaatgtgagtatatctgtgagatgctccagtttcctgggacacctatcattttgctaagatttccaacaggcatcaaagtctctactggtgggctttgaggagaaggctgacctgttcttatgccccagaggcactgcctatctttctttattttttaatctcagggccagagtcatccctgccctgcccaaaatgggaataggacatctcttcatagagatcagagctacatataaaagccaaactgggactgaatctaaacatctgcatttccttcctcctccccttcctttcgggacttcctgctgcagatcgcgggagcagatacgtgtcaatgtattccttccctttgcagcctgtccatttgggccagtcagaatcattcagcaatgcataagagaagaaatataatatgcgctgatatccaggtgtatgcaagtgataatatggctaatggaagatgtgaattgagaaggggatgtggttattaatgattacttatgaaagaattctgggccaagcacagtggctgatgcctgtaatcccagcactttgggaggctgaggtgggaggatggcttgagctcagaagtttgagaccagccatgggtaacatggtgaaaccccatctctactaaaaaatacaaaaattagccgggcatcgtggcacgcacctgtaatccccagctactctggagactgaggcacaagaattgcttgaatccgggaggcagaggttgcagttagctgagattttgccactgcactccagcctgggagacacagtgagactccatctcaaaaaagaaaaaagagaaaaaagaaaaaagaattctgtctcaagatactagggacgctaaaagtttgctgtttataaaggggattttatacaatgcgtacctttgactttgtgccttcttgccccaggagttactccttttaaatagatagctcatctacagatcctgcagataatccttctggtataaccagaatacgtagttatttatacatatatgtcccataattttttcctttcaaggtaattgatgaattatactaaacaaacaattttctggctgacaagtactgtactttagtgaatttgcttgattaaattgtaataatgaaattaaattttatgcttgctgtgtgtctacaaatgcagttcctgttgaaaatgagacaatctgaagtgccttctaatggacatcccacttccttaatgtttcttttgtatgtgtaagggagaaagtctaatgtctgttctttccctcatagattcttagttgagacactctcctgaaaataaaagtcagattcacaaaagaaaaactgttgagcccagactggtctcaaactagcctcaagcgatcctccttccctgacctcccaaagtaccatgattacaggtgtgagccaccaccgccagcctagattaacagtctttaaagtagatatgctgggataggtgagaggaagtgaaaagccaactgggacacacaaaaacagccaggagcagcctaggaggatgacatatattctacccatcacacaggagaggcctcagttcaaaaatacttctctctcaaggcagtggcttaggggccttgctcaaataggattttaacaaagagccataaatcctatgtactgacaagacacagaggagaacatctgcaggctaccaaaaggtaaatttctggaaagagtaaaatctgcctctagctgctgtagtgctgtctctgagctaataggcgagagttgtaaaggggaccatctttcggtgggaaaggcaggcaggagggcaggaaggtggcaaaggcagacaggtggacagaagaccttgtctttgtaaattgctgtcttgctatgaggaaggcagatggaggggcagtgtgtccactgcgttttaggattcttcttttcaatcaataatcctcattattttaaaaagggatattttggtttccttcgtgtgtaaaaactgtatccatctccaagctcaggaaaggaacaatttacagtcaccctcccaggctgctcctgactgtttttgtgtgtcccagttggcttttcacttcctctcacctatcccagcatatctactttaaagactgttaatctaggctggcggtggtggctcacacctgtaatcatggtactttgggaggtcagggaaggaggatcacttgaggctagtttgagaccagtctgggcaacatactaagaccctgtctctagaaaaaaaatattaaaaagttagccaggcatggtggtacctgcgtgtagtcccagctactcaggaggctgaggcgggaggattgcttgagtctgggatgggaggttgaggctgcagtgagctatgatctcaccactgtaccccagcctgggccacagagcaagaccctgtctgaaaacataaaaatataaaagattgtattaattgtcatcatcatttatataaaatgcaaagcatgcctgatacatggtaggaagacaataaacactatttacatgtttttcccccttgaacatgttccctttttctgctgagtcacattattttttgactgattgcggaggggggcccccaatgcaaaattagtaactctggcagctttctctatgtcttccttttcctaacttttccataaaaccattcctccaaagccttcacatggtcacagtggccttattgtctctgattaatcacagttgaaactggctatctagaaagaatgactagctgtcttaatactctaatggaaatctgagtcagtacactactcctgttttttaaaatgtcttctcttcccttgtggaatgaaaggaatttacacattacacataatgagaacaaggtatttttatttatgcttttatttcaataggtttttgggaaacaggtggtgtttggttacatgagtcagttctctggtggtgatttgtgagattttggtgcacccatcacacccgagcagtatacactgaaccctatttgtagtcttatcactcacccccttctcaccctttccccctgagtccccaaagtccattgcatcattcttatgcctttgcatcctcatagcttagctcccacttatgagtgagaacatacaatgtttgattttccatttctgagttacttcacttagaataatagtctccaatcccatccaggttgctgtgaatgccattaattcattcctttttatggctgtgtagtattccatcatatatatatatgtgtgtgtgtgtatatatatatacatatatacgtatatatatattatatatgtatatatacatatatatacgtatatatacatatatacgtatatatatatattatatatgtatatatatacatatatatacgtatatatgtatatatacacgtatatatgtatacgtatatatgtgtatatatatacacatatatacacacacacacacacacacacatatatatatatatatatacacaccacagtttctttatccactcgttgattgatgggcatttgggctggttccacatttttgcaattgctaattgtgttgctgtaaacatgagtgtgcaagtatcttttttgtataatgacttctttagctctgggtagatacccaggagtgagaacaaggtgttttggaggcagacaaaccagggttccattcaatgctccccctctggtattcaacttcttcaaatcctggataaatgtggggaccctctaagcctcacttcttgtgcaatggggagaaaaacattaccatctaatatggggtgagaaaggagtgatgcagttgtggatttagggctcctgatgaatgatacctccagtggagactggcctggattggaatctttcctgttatccctggaacccctctacctatccccacctgttctctaccctggaagaagcccaggatgaacggcatccataggctgtcttgccttttctgttgtcctggttgtttctggccaaggaaagtcaacaaatgaaagggaaaggagaacaaggttggggttttcatctcctctgttccctcctgcagggttgcccaggattgcaccctgcactcctcaaaggtcatcacaagctctgggatcactccttcgcctttgggcctgagtggtaccagcctcagggatgagccgtcttcctcctcttcctgtccacactgctgttagctgtcttttcagtaaattctcctctcattgtcctatattccatgtgtctcttcttttctgctgggaccatgtgaccaatgctaggtcctgcttggcacccccagggaaatgacagcctattcacagaccacagggctgtccacagcagaggaaccagagggctaattaggagctcatgtgcatagcaaacatattggaatgtgttgctcctccaagctggtcagagacatttgccatagtcactgagtcatcagtggggttatctgccttgcaacctaacagtgatacaactgacatcttaagagatggagcagacatgcacctgcaccccctttttatcaacatgatggtgaataagtgacatgtggcttccaatagatgcagaatagcaggatgctacatcaagggctgtgattctctagtctttagggggtctcccaggaaattttattttatataaaaatcaaacttcaacagggctgcaactccattggtccaaaagtctccccggttggtatcaaataaaaaaacaacaaatgcagacttagtaaggagggacttttattcaaaaagcttaatgcaagagggaaaacactctaggtctgcaagcctctcaaaggctaggggcaaaaatggtttttcttttatggagaagagtaaacaaggctagaaaacataacaggcactgaccttgaatttaagggtggcctgattagacagtagatgagaaaacatttgctctgaggccagactgttcccaggaggaagtgcctgctcactcagactgaggatgggcccatgttcagggttctgggggaaagagggaaactgatccaacatttgactagggaggacaagtggctcagctaacttataactgtttataagacaaagaattaggatttagagggtctgtctctgtcctattagacaagggacatctgtgagtcttttctcagtcatatggggaagggggttctttgcaataagccattttccagaacacaaggtgtgggaggatgttaaggagtattcagtagcacttgataaagcacagtaaggaagactttattcaggaccatcgcaacaggtgcagggaccacagcaatggggacttgcagtgggggagaaagattgggctcagatctgaatacagcatgggaaagtggggattcatagccacggaatagggtgcccatcagtggatggaaaactactaagaggaaacaccaagggccagcgagattcctcctaaccgacctagcaggattctagcataaggccaaccaggtgaccacacatcccctgggggtggtggaggctgaggagcctgatccctgatcagatactgaggttgaacagatggagggggggtccagtagggtgttcttgctaaattgacttaacaggcttcttgctaaaactggattttacaagcaagtgcacagatgggcctagaagaaggttgaaggtccccagaggtcagacagctatgatataagaggttttgagcatttgcatcacataccacattttctaggcactaaagagaaggtaacaaggctttagcttttagaggcctccacatgatcaacaccttccctcctgagcatgtcggccccctatggccatgcacttgccagcagcctctctatggcaactttttgcctttttattaaaattgctcgggcgtatgagagccagttctagtcccaatagtatgcccatctcatccaacctcttactgcttcggaggtttgttttgactcttgtttggttttcctaaggaatctggttgaaagagagaagagagaaaaatatttttcaaatcaaatttctgccccaggtatttgtagagcaaagccgctgcttcaccaggctagagtcccttccccagggcccagtaagactttcatgggccatgaaggcaaaacatattaaatatgttttaatatgaaaatatattatgtaaaaacataaaacattaacatttgtattttacaactatattggtgcaaataccaatatgatcttcaatccccaatgttcattttcttctgattataacacaaattaaaacattttgtgagcccctaaaaaggccttagagtgtgtgcctgttgggtaacaatctggcctttccccactctcagatcatggaggttgggactgttttgtgtcttattcctctctgcatttctcagcctctctcttgaactaagaagggagttgatgaatctttgcagaactggaacttgtattccccattgcttgacatcaagctggaagtgtagtaaacattccccacattgttgaattgaatcacattagaaagcagggtattagcgcacagcatttttaattgccaaggaaaattttattttaactttgcattaatatgttctaaggaacctttatacttgatgcaatcagattcctgagagaagccaatacttttcctgtttttgtgttttatcctccattcttcatcgtatgcccttcaaggaaatctgaaaagttggcttttttgaatcattagtcacattgatatgtagactgcaattttgcttttcctgcgggattgctgaccttgtaaaatgatgcttatgtatgcgtcactaatctatgtgcttaacttttaacatctatgtaatgctaagaatatagacatcgcctgggggcaggtggaggttgaggaaccctatagagaatgatctgatatcatgtgtgatcagatagtgagggtgagggcttcttgcaaaaactggattttacaaagaagtgcacagataatcttagaacaagattcaggagactgggttatatttggtcaaggaaggaatctttgtcaagggatttcttaacctttgctgttttccaagatcaaagggttcgggtggaatgcgacaatgtcggtggtatttcaacttagcaacctctttttttgttttgtcatggttgctgagctgaaagggagaaaatattcaagggatccaccaagaaaatgctcacttaggctggaacagcatataataagagatatgttgtggttataagatcaacgattgccaaaaagctcacttgagggtctctcaggctgacaccacttgtcacttagcagcatgatgcaacctggctctgcagttagcaaacctgggctttccaaaagctaaaaccacctcagcacaggtgcagcttttatagaccttaaaataaagcttactcttataagaatagcttaaactatctttaggaaagaaatgcctggtcattgacccagactgaagacaggtataagagaggggggaaaatcccttaaactcccgttcagtctcttatctgaccatctcattctctatggcccatgtcactggcctgttcctgctgtaagtttcataacactgctgctagcataaaccgcttgggtatcagattgtgtctgcatttatctttgacacaaatcataccgaaggggagaagttgccccttctgaagaatccggtttaccaggatcacctgaaactcccaaaagaatgcagcaactaggcaaagagtgtctccgcctcacattatctgcccaagcacagtgctgttggccaagcctccagcagctgacgggacccagctgtagtgaggttgcagtgattgagtaggattggcctgcttcaaagcagaggtttctcatgggaatatgcttattaaactcccactggtgcagaaaccatgaacagaggatgaacaagtgaagttgcaatctcctccatcacagctcagttccccaacaacaggatcacaagctggagatgcctttaaggtaagcgtctattcccctggccaggctgggagtttttaaccctgaaacatactagttgggatgttcacagcagctacctgcttgtgttgcatattctcccaacatgtgttgtcttgttcttgtttcttaaatctgtttttgcttggtaatttccattgattataatgattttctgtgaggcttagcgagggaacattttaggagaggttataaatgcggctaattagtgacatgcaaatcgcttttgtggctgtttcaaaacatctaaatgacctataattaaattttgttgccaaattatttgttaattatcatcttcctatcaagtttattgcatcaggagatgtcattcactgtctaaaaggtggagtgaggaagagcatcatgcatatgtgttgcagagtgggaaagaatgcttgttttgttgggtttctgtctccattggtgtgtttttattttttgttcccacttctatgtatctcagatgacgagtttgtctatgggctgtcggaatcttctggttgagaaagatggtgggagccactttgtttaaatttcctaattttccataaacgaatcccttctgcaatatccccgacagatgcggcttttcaccctccacccaattccctcatgggaggaagggactttgagaggctgatcatttcgtggtctggcagcacttgtaagtccctggttctgttctggacactgtcccagctgtggcttctgagacaatggctaaatcctttctctcttttacagaccaccattcgagcacacttaagtgcaactcgaatgccattttccgctctgggtgaaatgttaccgattcctaagaaatcctggatgtcagatttttttttttttttttttttttgagatggagtctcgctctgtctcccaggctgcagtgcagtggcgcgatctcggctcactgcaagctccacctcccgggttcacgccattctcctgcctcagcctcccgagtagctggggctacaggagcccgccaccacgcccggctactttttttgtatttttagtagagacggggtttcacgtgttagtcaggatggtctcgatctcctgatctcgtgatccgcccgcctcggcctcccaaagtgttgggattacaggcgtgagccactgcgcctggccatcagatggtttttatacccttaagcatcctgatcactctcccttgatatgccactgaatctccatccctcttaaatcgcagggatctgcactgaaaaatattccgactctggtctgacttcgtgtaaacagctgagtggaactcatcttccttgtcccaaaagcatcttcttcttaacgtacaccaaactagtattaacttcagtcttctcagtcattcccttccccaactgacaaaacttgctttgtagttgtctaaagtcttcttcgtaggagctgcaagtaggtcacgtctgaatattggcatctttgtgtcattgattacgtttcttaaataagaagattatgtgttttccccattgcatttaattttgtgacttccatcttttgttccacttctcaaggtcttttctgaatctctgttctcttctgacgcacatgccattccccatgttggataaatattctgatagtcgattcatacaaatcattgatgtaaattatggaatagtgcagagctgtatagcacaggctcagtaacctctctggttcggtacaaagctttaatcagcacccttgtggagcgtttgtttagctagttacaacttttagatgctgtaacacatgattttctaattctaagctagatggctattcattctattgctgatattactggaaggaggaagtctggtagcattacctcaaaagacaggaggccaatgtcgttcccagagagctcaagatggcaccaaaagttcacggtttagcttcctaagtgcacaggaaccatctttaggaatatgaattcaggaatcttatgtcagacaaattttgcattgactagtctaactaaaagaaagataattaatatcttctttgtttatttaaaaataacatggttgtttataaagtgacatcaaaccatgtgcgcctctaggcagtaaatgtttatcggtggacattcacctaatatacacagcatactctctggctatattgggcatcttttgtttgcatttgcataagcactgttatagactgcttctgactccccaaaattcatatgttgaaaccccaacccccaaaatgatggtatttggcggtggggcttttgggaggtgaagaggttctgaaggtggaaactcatgaatgggactagtttcccatagtgattataaaagaggccccagagagtccccttgcttgttccaccatgtgaggacacatcaggaaggcaccatctatgaaccaggaagcaagtcctcactaaatactggatctcttggtgccttgttcttgcacttccaagaacagatgtgttgttccaggactgtgagcaatatatttctgttgtttataagccacttcgtctatcgtactttggcataacagccaaacagaccaatgcaagaaccattttaataaacaaggaattgtcattggctaattaagtagaattgtgtaatcatgttgtttgaatttggatcttgttggtttattgttgccataactgtctgtctgcaagtaacaataagcttgaagcctaagcaaacttaacatatgaaaatctgtgtcaagggcatctctgctttataaaagacagtcttcaattaggacccctccccagtgggattgagcacaaaaacagctatttgtgagaaaggatgccctcagctgcaaaaaaaaaaaaaaaaaaaaaaagatgttttcagtctttttcaaaattatgtttaaagacaactatcatcattaagttttttgctctatctagactttgcaatgttttccatctcagaacagaaactactgccctaaatattcaattaatattaaatggccctataggaatttatgtctaagagatagcattcattatctgtattttttcctattgctttttaggcatttatttatttttatatatttagggggtacaagtataattttgttacagggatatattgtgtagcagtagtctggacttttagtgtacccatcatccaaatagtgaactttgtacccattaagtaatttttcaaccctcactcctatctcactgcccaccttttatactctccaatgtctattattccaattagtatatccatgtctatccattatttagcacccacttataagtgacaatatgcagtatttgactttctgagttatttcagtaatgataatgacctttagttccctccattttgttgcaaaagacatgaattcattcttttatatgactgagaagtattccacggaatatatatataccacttttttttatccaatcctctgttgatggacacttaggttgattccatatctttggtattgtgactagtgctgagattaatgtacaagtgcaggtatctttttaatacaatgatgtctttccctttgggttcatacccggtagtgggattgctggatcaaatggtagttctatttaattctttgagaaatctccataccgttttccatagaggttatattaatttacattcccaccaacagtgtgtaagtgttccattttctctgcattcttgacaacatctgttgtttttagactttttaatatagcccttctgatggtggaagatggtacctcattgtggttttgatttgcatttctccgatgattagtggtcttgcacatttttgttttcatatgtttgttgggtgcttatatgtcttcttttggaaaatgtctgtttgtgtcatttgactcctttttaatggggttatttgtttttgtttttttttctcattgagttgtttgagttccttgtggattctagatattagcactttgtcagatgcatagtttgcaattttttttccattctgtaggttgtctatttactctgttgattgtttcttttgctgtgcagaagctttttagtttaagtcctgtttacctaattttgtttttgttgcatttgcttttgaggacttggtcatgaagtaaagccaagagtgaattagatatatttttttaagtttatggaaaccagcagaagacatagactacatagacattcatttttttttcactttcctcatcatggaaatattctgagacatgaaacatcactgtgacccaaggagaggcattggcgagagttagttgaaagagaaggagaaaggaaaagagtggaatatcattcactaaacacctcccatctgccttggaagttgggtgcacttcatctcttttaaaaatggagataatgggacatggaagcttggagtgataaagccaatatttgaaaaggggacgagttgactttatgatctgatcttttcacttaaagctctcagttcttcaatgagaaaagtaggtgtcctggacattattttatactagccaagttctgacttgagcaggaattaaaatgtaatggtttcaaagcactggataattcatcaaccagtagcactaagcacaggggtagggttagtccctcctcataccaattttatggctgtcattagagttaagcatttaacctccctggacttcagtcccttcacttgtgcaatggactgactgtttatttcccccccaaattcatatattttaattctaacccccaagatgatggtatttggatgaggggcctttggaatgtgattaatcatgaggggtttgtcctgaaaaatgggattagtacccatataaaagagaccccagagagctccctcattccttccaccatatgagaacatggggagaaggcactgtctatgaaacaggaagcaggtcctcaccagcacagaatctgcaataccttagtcttggacttccagcctgcagagctgtgacaataaatttctgttgcttataagctacccaatctgttgcattccacgatagcagcccaaatagactaagacaatctgtaaaataagggtattcaccacccatgaggtctcatagaaccttctgggtctaatcgtctgtggttctcaaagccttccccatttgaaggttgatgtttcctacttggtggaacatttctcttgcttccaactttattttgctctttctggcttccttggctgaattctctcttccctgtaattttctctgcatggcacttgcagtttcaccagtgggctatggaagatgtctttcaaagcctctggctaaggtgtaagaacagctggggtcctcattgggaagccgattaaactttaaaacagtaggctgaggtctagaactgttccaggaggtgagatgacagcaattgtccctgtgttcataccctctggttaatgtgactcccagctatgaatcaacctttatataaatgcattttggctcactggactgaatgtagctcggattcaataatagaaaatgtgtgggaggagacagtgagaaccccgaagccagaatggtctgatgttgtttcttgtgctggaggtccccaggttcagcgattcaccagaaggactaacaggctcagtgcatagtggggctcatggctaagatgtatttcagcaaaaaaattcagaacacattgaacaaagggaaacggcacatggggtaaaggctggcagaatccaggcataagcttccaggtatgtctctgaaaggagtcacacgggacatacttaactcctccagcagtgagctgtcaacacatatgaagtgttgcctacaagggaagctggttagagactcagtgcccaggttttttattgggagctgttcatataggtgccctttgcctagtactaccaaaattgcagactcccagacaggaagcaggtgttcagcataaactatgttgtttgtacaagcatttcaggcagagtgagccattcttgttaattctgggaagggtgagaaccctccccaaatctaattcccaattgccaaccaagagcacatgttacaagcaggcctttctaaggagagcaatctcaggtcctctatgttaacttctttctgcatatttctaaagtgttttatatttattatctttttaaggaaacaaactctgtcaccatgaagtcctagatgcatcccggaatgtaaaagctagaggagaatgttggatgtagcccatgacttcattttatagataagaaagccaattctcttctttttctcttttcttatttttagtatatttttatgagatataattttcctacagtaaaatgcacagatcttcaatgttccgtttaagttttgataattttatacaaacatataatcactgtcccaaacaaaatatatagagcatgtccattatcatctcagaacgttcctgttgcccctctctaatcaataccccagccagagacaaacacttttcagagttctatcaccacagacaatttttgccttttcttggactgcatatgaatggattcaagccatatagattatttggggtctcacctctttcactcaacataatgtgtgtgagattcttatgtgttgttgcatgtatcagtggttcatttattttcatggctgagtagtcttaggttagattgatgttccagagtttgtttatgcattctcctgttgatagttatttggattgtctccagtttttggttattgtgactaaggctttgggtggatagatagttttatttctcttgtttaaacatcgagtagtgtaattgcttgacagtaagatacatgtatattcaattgtataggaaatggccaaacttttctctaaaacgtttgcatgagtttacacttcaacaagtgatatataagagttctaggggccaggaacggtggctcatgcctgcaatcccagcactttgagaggctgaggtggaaggattgcttgagcccaggagtttgagaccagcctgggcaacatggtaagacctcatctctacaaaaataaaaaaattagccagggtggtggctaatttgcctctagtcctaactacttgggaggctgaggttgggaggattgcttcaacccaggaggtcaatgctgcagtgagctttgttcgtgctactgcactccagcctgggtgacagagcatgaccctgtctcaagaaaaaaacttagagttccacttgttctgcatcttcactagcatttgatattttccgtttttcgttgttttgttttgtttttattttagccaccgtaggggttgtaaaatgctatctcatggtggtaattttcacttctctgattactaatcaggctgaatacctatttatttgcttattagccttttgtatatcttcttgtataaagtgcatattcaattgttttacccatttcattgtttcattccttttttattattgatttgttctttacatattctggatataaatcctttaaaaaataattgtcttacaaataagtttccctggtctatgttgcttatctatattcctttttccttaatttttaaaaaattgaatgttactttgaattattttatctcatgtatcctctcaatagtcccactctcttcacttgatgataaattagaagcatctaaaaaaaccaatcattccccaaaaagtaaattaaaacctttctatagccattgttcagttctagttactctattagccttgttcaaatcgttgtttttttttttttttataaaagcaagctttattttgctatctgatgagacaatatgctagtttgagagtttggaataaaaaacatggatatttgtattattaaggaaagtttccaagcacatagttattaaggaaagcacatattattaggccaagtttccaagcaaaagtcttagaatagacataaagatgtgaaataatgaacggtgaccttagtatttgccattgtcattgttccatgcaatatgtttaaaaaatgtttttatttgatagtgataagaatactatcagatctaacctcttaaaattttaagtgtgcaatacagtattgtcgactgctgatacaatgtttgactgcaggtctctggacttaatccatcttgcttacctaaagttttatgcctgctgactcataaatccccattttcccttcccctatcccctggaaaccaccactttactttttggtcgtatgaatttagctactttagatacctcctgtaagtggaatcatacagaatttgtctttctgtacctggcttatttcacttaacataaggttctcaaggttcatccatgctgttgcatattgtagaatatccttccttttaaggctgcatagtattccattgtatgtatagaccatgtttttttttgtttttaatccattcatttgttgatgggcatttaggttgcttccatatcttggctatggtgaatagtactgcagtgagcagaggagtgcagatatgtctttgagatcctgatttcaatgctgttgggtatatttccaggagtggggttgctagatcacaaggtagttccattttttaatttgtcaaggaaattctgtactgtttttcgtagcaacagcacctttttgcatttccaccagccatgtgcaaagaaattctccacatccccactaacacttgtctcttgttttttgtttttttaagagcagctgttctgacaggtgtggagtgatctctcattgtgtgtgggtttgagttgcattttcctgatgattggtgatgttgagcatcttttcatgtgcttcttggcatttgtatgtgttcttcggagaaatgtctagtgaagtcctttggccattttttaattgggttatttgtagttttgttattgagtttgggagttcattatatatttgggatatatggttatcagtatatggtttggaaatactttctccccttccataggttgccttttcactccattatttcctttgctgcacagaagcttgttagtttgacgtagtcccacttgtctgtttttgcttctatggcctgaagcctattcacattcttaaaagtatcttttgatgaatagaaatagttgcttcattttaccttttactctttacattttaatttggataattttcttgacctgtcttcaaggtctctgattcttttctttgcccatgacatgaacttcttatttctgatgttacatctattttgttttatagctagcatttctgtttgtttcttcttttgtattttcatcttgccactgaaattccccatctcttaacacatgctgtttgcctttcctgctagattcttttatggatttcctatggatgtcttaaaggatatagatgaaatatctaacatttgcatacctcctgctatttcacatgtcatacgtgcaaacataaatatgcatgcataatagacattgattataaaaaatagtggagaccgagtcagtcatattttcgcctagaaaacatcacacgcttcatctgtgtggccccttggtaagctgccatttcagtgtggttgtgatttgtttggttttaattaggttccgctcacccccttggcttcagatgctttgagaggggatccacactttccctttagcagagcttaggatctgagcattggtgagactcttaagtcatgctctgtttgcagcctgactgctcacttgttgggtttttgaagggtcctctttgttttctgtcttgccctggatttggtcattccaaattcccatcctagctggggaacagggacaggtgtgtggctgcccatggggaagatttggagtgccttggaggggtgcatctgagcttccctgcactgcctcactctgagttttttttgcactgtgtggtgtacgattccccagggggcttcatgaagactgcaggagtgcattgaagggttggctgcaggtgggctgtctggctggacctcatcaggatgctgatctgccgtgccagcctacctacacccagtcgttaaaaactcctttcagggtcagctggattcttcctcttctccctactcctgctaccaggggtgaaagcaactgaaggtttcttctttgtaggaaggttcatcacatcctggattctagttcatttatgttttttctgcatcttcagccttttttttgtcggggggcggggggacagggttttgctgtgttgcccaggctgcagtgcactggtgtgatcatggttcactgcagccttgcaccccggggctcaagagatcctccgacctcagccttctgagtagctgggactacaggcatgtgccaccatgcctggctaatttatttatttatttatttatttgtagagatggggtctttctatgttgcgcaggctggtctcaaactcctggcctcaagcagtcctctcgctttggccccccaaagtgctgggattacagacatgagccaccaccaggtccatcctcagctttttgatggatcttaaaaagccatgattttaattggaagcctcataaatcactgttgggaatgtgaagtggttcaaccactctagaaaacattctggtagttccttcataatttaaacctagaatttccatatgacccagccattccactcctaggtatgtacccaaaagaattgaaaatgggtgtgaatgttcatagcggcattattcatgatttccctaaagtgaaagcaacccagacatgtgtcagctgaggaatggataaataaaatgtggcacagccatgcaatgcaatattatgtgggcattgtattggtccactctcacactgctataaagaaatacctgagactggataatttataaaggaaagaggtttaattgactcacagttccgcatggctgggaaggcctcaggaaacttacaatcatggcagaaggggaagcaggcacatcttacatggtggcagatgagagaagagcaagtgaaggaggaagagccccttacaaaaccatgagatctcatgagagctcactatcacaagaacagcatgggggaaactgcccttatgatccaatcacctcccaccaagtctctccctcaacacctggggattataattcaagatgagatatgggtggggacacaaagcctaaccatattaggcataaaaggaacaaagtacttttggtaacactgtagtatgtttatgccgatattatcaggtgggtgagcctagaaaacatcatgctaagtgacagaagccagatacaaaaggcctgattattttccatatgacccagccattccactcttaggtatgtacccaaaagaattgaaaacaggtgtgaatgctcatagtggcattattcatgattttcctaaagtgaaagcaacccagacatggtgcatgattccattcatatgaaatgtccagaataggcagatccgtagagagaaagctaattagtggttctcaggagctgggagagaggaatgaggagtgaccactgacaggcacagggatctccgtttaggggtgatgaaaatgttctggaatgagatacacctgacagttgtacaacattgttgtacaattaaattgatgtactaaatgccactgagttgtacacttaaagtgctttaaacggtgaagttgatattacgtggttttataataatttaaaaagaaactatgagttcaaggcttcatggcttctttaccttgtcaatgtgtgttcactggtccctttggctttccacgtcttaattagtgtggagtcctaattagggagagaggtcaggctagggggatggagggaaagtagaaagagaaggcaggtaagttataagtctccctttcttcatgctccagaacagatagccctcctgtgcaaataactcacagtctgcctacacccagctatctccagacccttggctgatagaaaattgcaagttatctcactgcaaccttggcattatcggtactgcacaaagccctcttcagcacacagcacaagcaccatcctataaaatccccagcaagtctttgtctctttgcagtcagctcttctctcactgacctgcctgttgcacgcttgcaacgtattttcatactctctctaataaatctgctttttttttttttttttcttaacctacaactgtcttggtaaattctttttattcctgcaccaccgaccgcagatagtcgccactcacccatgacaattagcagttaaagctgactgctcttttcatagcctataactttaaatttgtttttttctgtaaacattttcaactggccacatatgtcttgagtagacagaggctaattgtcagcttttgctttctgggttgttctattagggtgctatggcatagggtcctattaggatcctatggcaaagagcaacagtgagggtaagtggaaatttttaggaaaacttgaccacatctggggtaacaaattaaggcccaggggccaggagtttggtagaagcagcgtgaatcagaagctctgggggaaatggagtcgtccccaaaagcaggcaccagctgcaggtgcatgagtgaggagggagggatggtgcatttatacactgcattagggctagcgaaacctttatacagtgcattagcgttagcaaaaggcacttataggactttatcccctttattttttttaaccaccttgagaaatagagaatgggtttagagaaggcagagtgacatgcattttgttctgttgcaatttgggtattcttatgccttagtttgtctctgatatcttttagccaaggggaagaggctggcaaggtttccattaaaatttattttcacctttacttataccaatttggtagatatagcaggcgagcagtttcctaccttgaacaggggcatgagaagaatgtatctgcttttgctgcagacagcccaggtctggagaccctgcgattgggaaggctggttccactgggtagaagcactattgtgaatagtgatgtagtaaaaaagggagtgcaggtggtatggtttggctgtgtccccaccacaaatctcatcttgaattgtaatccaaattataatccccacatgttgggagagggacctcatgggaggtgaccggatcatgggggtggtccccccatgctgttctcatcgtagtgactgagttctcacaagatctgatggttttataaggggcttccccccacttcgttctgcacttctctctcctgtcgccatgcaaagaaggtctctccttcgccatcaccttccgccatgattgtgactttcctgagacctccccagccatgtggaactgtgagccagttaaacctctttcctttataaagtacttggtctcagatatttctttttttcttttttttttttttttttttgagatggagtctcacttcttcgcccaggctggagtgtaatggcgcgatcttggctcactgcaacctctgcctccagggttcaagcaattctcctgcctcagcctcccaagcagctgggattataggcatgtgccagcatgcctggctagtttttgtatttttagtagagatggggtttcaccatgttggccaggctggtcttgaactcctgacctcaagtgatctgcctgcctcgacctcacaaagatatttcttacagcagtaagaaaatggactaatatagcaggtcttcctttggcacattgatatatttccctttagataaatactcattagtgggcttgctggatcatatggcagttctagttttagttttttgagaagtctccatacggttttttataatggctgtactagtttacatttccacctgcgcaggtcacctgctggtcatctaattaccaaagcaatttttacaaaattcctctacatctttttatttatagataatcacagctgtatgcaccaatttatgatccctgaaaaaagagcagcaattatgagacagcttgttcaggggaaggagctcagtgtacaggttagggcctcccatcgctgtcttcctatgtcagatgcccgggctgattaccatgtctatgaaatacctctttaacacagagggttaactagcttgctgcagtgggaggtaagaataacaacagcctggccatccactgatcctggaaaatgctcatccacagagcagctgagccaagatggtttgagctatctttgtcttgtttcctcatctggttgttaaatcccagaggccctctgatattgacagcgcagatgctgatatatattaaatgtgtggaagcacttcatgccatccccaaatcccttgctttttcttctcctcaaacttgtgtgtattttattttctctccttttacatctgctgcccatggttttgttctgcctgatttcccctgtaacataacccctggttaccaaatgctggaaagtcagataagatgggaatgctctatggcgtttcatccaggggatcctggaaaatgcaaatatacaaaacctatcatgaccaaagcttcctgtgaggtccctggaaaaactctgtgcacagagatgccctcagggggcagaataacactttattattttctccactactggtcctcaaagaactctcacaggagactgaattctgcccagagctcctttcctgcatgtcccagacatccaccatcatttcctcctaagtccagactgactgactgactctgttgccgacatgcaaggaaagggacttctcttggtttaacaggaaaggaaatagagggacagagcaaataaaagggtggtggagctgtagggctgggacagagactatatgggagagtagatgttggacaaggagggaaaattgacactccagtcagaggcagctctggcctcttagctcactgtcattcttaaggcagtctctgggaaccttggcttctttagaacactctacctctgaaatctgtgacctaacccatgacttcaaacttgagcatcctttaggcacttggaggatgtaaagactatcctcatcctcatggagagtttattgttcttgaatctgatccttttacaggagaaagaagaagtcttaggctcaccctctgttaagtacaaaagtttcaatatatgtttctagacgtgttttttttcttacaaaatccttctataattcactattaccaatgaagagatcatttaaacatagccttctcaaccttttcttcaaatcccaccatcatgaaccatttgtccactgttctacagtgccaagaactctccaaatatggtggcctcttaacatgccagagaggaatgttttcagactccccagattgtttaggaccgctatgggacacagtcctctccatcaaatttggtaccttgtaaataaatgaaaatattaggtaagctgtgatgagtggttcatagcaaagcatttggatttggaggttgggtagaggtcttagatctgagcaagagagaaatggctccttccacatggtaactttatggtgagcaccatttatatcttgcctcagggagagcacacatattacacataatgggccttctggatctcattagagaggttaaaaccaaaattgcaacagaggtatcctgcctatgatggcactcaaatgtatcccaagtctgtacatttgctaaactaacagggatgaggagcttacaccaaggtaacattaattccagttgccttggtctgtggtatgcacttgtgtttgaaaccttgaaccttcttcagaaaaactgtttgaaaaatatttagttagccgggtccattggttcacgcctgtaatctcagcactttgaggggctaaagtgggagaatcatgagcccaggagttcaggaccagcctgggcaacatgacaagatcccatctttacaaaaattttttaaaaattggccagacagacacagtggcttgtgcctatggtctcagctacttgggtgggaggattgcttgagtccagaaggttgaggctgcagtgagctgtgatcatgccactgcattctagcctgggaaacactgagaccctgtctcaaataaaaattagtcttctgaaaaacatagggaaattaaaggaaattgaagtcctagcagagatatccaatgttggttattacacacttgtgtatgtgaatgtgctctttttattttctggttccttttaccttgttttatacataacctttagataagctttgaattagacaaaacatgttcactttgtttttaacaagaatgtttttctacaatatatatttattggaaaatacccaaataaagaaatacctattatttaatttaatataactttatattctaaattatgaccaatttaactacaagtatttatcctattacatttatctattttattttgtttacctagattatttatgaaaactgtgatagttatgatttaaagttataaaacccccattgcaaaattataactgagacagtgaaaaaagatttgacctaactgactccatcttgctctgaacctccaggctgtccttgttcattcctgggcataggtcaaactaactttgggaggaacttagtttatagattagctttgaaacagagatgataacagtcctttcccaaaacaaacctccttactgcctgtggactagactgcctaaagccacgagattagaagttatggtaattttactaaataattaaagatgtagctattttcattaaaccaatatcaatgtcttatttattaaaaattacacaagcaaaggtcgttctgttttgggctgggtttttagttttgtaacccctatgccaaaatttgacaccttatagtatttggcagggataagtatgacattgcttaattaataaatgcaaacaatgcatgctgacaattcttaagaaatttctaatattacttaccaataattttaaagctaacttatttattaaaggttttaagttatataaacttgaaaaagcatttgactagtccttttttcctgataaagtatttaagtgtttttatttttctttaagccaattaattagagctcttttatatatttttagtagtgaaacattgtgtacacaacgcataaatacatagatgcattaggtatgcgaatgaaagtacattttgtagatccataaagaccatcctttttttttttctatcttagactttcagattcttgataacctgttttacaaccttaggtggttgtcagctaaatagccttaaaattgcatgttaaaggaaaccactcaagtaaaaatcaaacagcaaatttacatcataaggcagagagagaaaagatctggtgttgctagagggagatccttttatttttctttgagcagatcaaacgtaaaattacacatatctattatgtgattgcataaggacaccaattttgtttagataaggactatctatcttttaactagatttctgaactctggccagaacccccccaaaaaccaaagatttgctcaaaaaaaaaaaaaaagacaagttcttaggagagaaaaacaaaacaacaaaacacgaaggccttttaaatacaaacatgcacacacacacaaacacacactttttgttgttgttgttagtagagacaggatttcaccatgttaaccaggctggtctcgaactcctggcctcaagtgatccacccacctcggcctcacaaagtgctgggattacaggtgtgaagtaccatgcctggcctcaacatagtattttaaagttcatctgtgtattgcatattgcaatatttcttcattttgtaaggttaacaatattgcaagaataatactgtaagaataatattgcattgtatgttgtgatggttaatttcatgcatcaacttgactgagctaaggaatgcccagataactagtaaagcattattactgagtgtgtctgtgagggtgtttgtggaagagattagcagttgcttatttttatttttatggatttaggagtacaagtgtggttgtgttacatgaatattttgtgtcatgaagtctgcacttttagtgtacccattgcccccatcatccaaataatatacattctacccaataagtagtattttctccttcaccccttcccacactcccatcttcaatagtcttcaatgtctgttattccactctgtctgtctgtgtgtactcattgtatatctctcccttataagtgagaacatgagattttttacttttgtttctgaatcatttcactagggaacattttctttgctgtggtaaagttcctgttatgtaagcacattgtttacatgtcttctgcagcaacatggatgaagtgtcctccagtttcatccatgttgctgcaaaagacatgagcccattcttttttatggctgagtagtattccatggtgtgtgtgtgtgtgtgtgtgtgtgtgtgtgtgtgtgtgtacacacaatgcgtggtgtagatagatagatagatagatagatagatagatagatagatagatagcacattgtttttatccagtcatcgttgatggacatttacattgattccatctccttagctccaggtagattcagagaaaaagcatcagattatagaagcataaacatcacagggttttagacatgataggagcctttttattgtacagctgtagaaacagggacctgcaaagactgggtgacatgtccaaatgttgacagctagttagcagcagcaacaggatggcagctaccatctctggatccattgctgattgtcctcccctccatctcatgatgcatcaactggagcaatgacagagaagggggaaaataaggggaaagccaggagtggtggctgacacctgtaatcccagctacataggaggccaaggtgggaggattccatgagtccaagagtttgtgataaacctggactacatagcgagaacccatctctacaaaaatttttttaaaaattagctaggtgtggtggtgcatgcccgtagtcctagctactcaggaggctaaggcaggaggattgcttgagctggggagttcaaggctgcagtgagctgtgatcgtaccactgtgctccaatctgggtgacagagtgagaccttgtctctaaaaattgtgtttttaatttaaaaaattaaaaaatcagcaggaaccaatagaatcttcacacatgcaacacttagtgtgtcttcactaagtgaagacttcagtgtaaagacttcaaatgtaaacaaacaggttaggcaaggcttacttttttaaacataatttttaattagtattttattaatactcaatgtatattataatgaattcaactatactaggtataattgattgtattgagaaatacaaagaccaatgcaccaggtactgttgtatagtcgatagaaacagattcgctaaatcaataaaacatgaacatttattttagaaaaatcacaagtgatttaaataggtatttaaatctatagaaaagtctgtttagacacaatttcagaatgggttttttctgtcctcatgtcagactatttttctttatcgatttaaaacaggacctttgttggataatagcactttgtgaatcaaatttcaccagtgtacataccttggattgaacgaagctgcttttcttctaaaaaatattgtttgtcgtgcaagtttttctctgtttttaataagccttcttccccatcgagcaaatagatcaggaacattttctttgctgtggttaaagtttctgttacgtaagcacattgttaattttcttctaatgaacaaatttaatataattacatctctagttataaaaatgttcctttgtctctctctttcctaatgatgctgttgtaggaatagctgctttctccacaaaaaaagtttttcgtgctcttttgccaaattaagtttgttcagaaaaataatttttaaagggaaaattatgcagtttttcagaagttaatgtgccatgttcttaatattttggagtggagcagctttatttaattttaagtacttttatgttaactgactctgtttcagttttttgaaacctctttatcaataccttcttgtaagccaggcttgtaggaaagaaaaagcaaagtccacttacttctgctggtaataatttatatacagtgggattctaagtggctttttttttttttttttgagaccgagtgtcactcactctgtcacccaggctggagtgttgtgtctcgatctcggctcactgcaacctccgcctcccaggctcaagcgattctcctgcctcagcctcccgagtagctgggactacaggcaagcaccaccacgcccggcagattttttgtacttttagtagagacacggtttcaccatgttgaccaggctggtctcaagtgatccacctgccttgacctcccaaattgctgagattacaggtgtgagccaccctgaccagccttaagtggctcttaacaaacttaaattttcacacattcttaattgggctagatggtatttctcatcctagtcctgataatatctacctccaggcacattttggaggtataatgaatgatatgctgagctaaccaaaatcattttgtgattcagagattaatataggcatgaaaaattattaatgggcttttatcctattgtgttcaatttcaataaaatggtctgcacctgaactaacccttttaccacaaagcatagaaaatggaaatgaatcttctccaaggagcgcgcgcgcacacacacacacacacacagatatgtatgtgtgtgtgtgtgtgtgtgtgtgtgtgtgtgtgtgtgtgtatatatatatatatatataaaatggatcccttctatgatggcatcttggtgtggaacaaattcataatcttaatcctccagtatttttaattgttccctacccagctaatgggaccagtatctttccaaggaacaaggctgaagtcatcattgactgttgcctctttctgacacttcacatccaggcaattaccagctcatgttgattgtgtctcaaatcggctcagttctctccagttctctcccacctgcccctgtgctagtctggaccagcttccttggggggttatggccattgtcgtgcgatccactccagtttctgcccaacccttctgccagggagcaaccagaatgcctgcgggagtgaaacgaaaccatgcctgtcatccctagtgtcctcaatctctgcttcatcacttctggataaagataaatgccccaaacctaaaacaacagaaaggaaaaagataaatgccctccatgtctgatcacgatgatttatcctgacctcttctccacctcacagtcagacttttgcatggaaaaaataaccaaccaaccaatgcgcacagtttgtaggaatactgcaacatcagcaacttatacaataatgataaaaaacaaagaacatggagagaaacacacatattacctgagtggctctctgagtggctggttgatgtttctcttttgtacatttataatagtaaaaatacaacaaaacatttatttaaaaaaatcaatttttgtgtacaaaaatcacaaagcataatagtccaaagtaggtctctaaatagctaggtttttttggtgagattttagttagtcctcatatagagcctgaattttgctctatttaatctcttttttagccatttccctttggtctaccctaaatgcccttttctaattcaggtgctttcaactttcagttataaaacaaaaattcatttttacatggttgctgagcagagacatgtgtccttaaattgcttatataaattctgagactcattactaatgaaacatgttcttaaaataagttcaacatgacatttcagagccgctgtcctggggagcttttttctcgtcctcattgacaaaattgaccttctcacctcaagctattggagttatctactactgtgtaacaaattaccccaaaacttagcagcttaaagcaacttgcgtttgttatctcattgtttctgtaggtcaaaaatctgggcacagcttagctggatcctccttagcttctacgtctctttcaggctacttcaggtgtcatggctgtggtctcatctgtggtccaaaagtagcaggatctctttccaagctcattcagatagttgcaggcaggacttagttccttgcaggatgttcacctgaaagcctcatttttttttgctggctgttggctggacacttctctctttttcttataacatgggtctctccacaatggccacttacttcatccacagccagcaagcgatagagtttgccagcaagatagaggtcatagtcttttacaacccaatcacagaattgacatctcatcactttttccatatcctactcattggaagtaaatcactaggtccagcccatactcaacaggaggcgattgtatcagatgtgaataccagaagggaagtcactggggccacttttagttggctgaccacatttttgttcaaaactctattagtgtacttattatactctacataacattttattattattaatagttgtaattttaataataactttataagttaataataacttaatattattaaataactataatgaacaactatggcctcttactatgattcccttgctgaatcaataagtactaagaacccagaaggagagaccctgtctctataaaaaaaaaaaattaaaaattagctggtcatggtggtgtgcccttgtaatcccggctacttgggaggctgaggtggcaggattgcttgagcccgggaggttgaggctgcagtgagccgtgatcacgccactgcactccagcctgggtgaaacagtgagaccctgtctcaaaataaataaattaattaataaaaataaaaaggtcctaagtgtgtagttttatcttcaaaataatacttgtaaggtattattattcctttcttacagaaaagaaaactaacaggctaaatatatagcttgtggtttcactgctagcaagtgggggagaaagaaagaaaacctcaacagcataaactgcagttctgactccactgcccaccttagtgggtttggtacttgtgcatttcctcatttgacctgtcagagtcttgcagggtgactgtgtgtctcatacaatcatagaaccaccataggactgctataatgtcatctttctgggttttgccctgtatttgtggaattgaaatagattcggttgaattctcagtgaattgctttccactggaaaggtgtagctagactaaaatgctcctaacaagttacatttgtctagcactttattattttggaaacctcttttggggttggatagggcagggtcttactctgtcgcccagagtggagtacagtggcgcaatcatagctcactgcagcctcaaactcctgggctcaggccatccttctgcctcagcctcctgattagctgggactacaggcatgtgccaccacacccagctaatttttacattctttgtagagatgggatcttgctatgttcctgcagctggtcttgaactcctgagctcaagcaatcctcctaccttagcctcccaaactgctgggattgcaggtgtaatctactgcatctggtcgcattttggaaaccttttatcgctagtatcctgagtaactcccccatggtcaaggtgacatcttagggtaatgtgcagaagagtgattcacaaggagaacatgccttctaaagcctcatggctggtggcctgagatgaggccagagctctgactcttatttctcctctcattctgctagttcttgacaagcagagaataaaagccagcaaaaagagaattaaggagagttaggaatgagagggtagctgtaacaaaaacaaacagagactatcacattccctgggttggttatctttcaggaagaatcgtggtgatctgcgtttgctttttatgaaaaggggagaccccgaaaagggagggaggtgagaggactattggaagtaggtcaggggagagagagagaattttatgtttcccaggctgggagctgtgtctcacgcctataatcccagcactttgggaggccgaggcaggtggatcacttgagatcaggagttcgagaccagcctggccaacatggcgaaacaccatttctactaacaacaacaaaaaaagattagccagctgaggtggcaggcacctgtaatcccagctaatcaggaggctaaggcaggataattgcttgaacccgggcggcagaggttgcagtgagtcgagatcacaccactacactccaacctgggcaacagagtgagactctgtctaagaaaaaaagaagaagagtatggctcccaatgactaatgtgtaggagtaaggattctttgactggggttcagacaggcaaggagcatgatgctgttgtgcagagtgtaactcctgataaaaatgtaaggtagcaaaagatttgccacatggacaaatgacaaaataagcaacttagaaggcatgagaagaaggaatgcttgcagcctaatgttttccttgaagagcctttttggagatggttgcctatgtgcattagaatttaagagcttccataatttgcggaagtatgttatacccgagaaacattgtctgttaacaccgaagatgtacttgtgggtgcaaatgagaaatttacacctactcaaatggtttggcatttccaaatcctttggtagatgccgatctgcctacatacaggagcagagggaatgaattgcaattctgttatgttcaggaggtgaaaattctacagatgatagggcgggtaacatgctagcactaagttggtggtttcagctggggacagttgtgttccccagaggacatttggcaatatctggaggacatttgttatttcacaactaggggagaacagagaagttggggacagcatcctgtcggggtttagtgggtagaggccagggatggtgctaagcatcttacaatgcacagaacagccccctccccaccaataaagactcatccagtccacatgtcaatagtgttgaggctgagaaacactattaacaaaatctgaggtccctaagtcaaatatcaactcatgataaaaacatgttctcatgttattttttcacacaggagaaattggttaagaagtaggtaaagcagttacagtgcttggtacatactaagcacccaaaaaactgttattttaaaataagaaaagttatgtatttatttcctgtatcaactgaaacatgaacctagtaatgaagtagagatgcagaacacagcctgctggctctggccttctctgatatgaatgctatatgttgcactcttatggggacaggaggttattaaactcactcttttgcaaattcctggtattagttatggatttgtaagccattaaatctacttagggacccctgatgctccaaccctgagcttttcgtgggcattattaatggtgttttcagttttcttaaaaacctctagtgtgtctcactcttcatatttaaagacggatgctaatttttgaatcttctctgtgccccgtaaaaccttccagccatttaaaaaaatagtgcatggccctgcttaatttcctctctggttgaactggcatgagggccttttaattaaacagaataaacatacatttttgatttaatgtggctttctttgatacttgctcaaccagcccctgctcacatggtgtctacagtctaattaggaaggggaacaatcatctgatctcagatttacaacccttctctgtcattatttattcatttgcctagtccacaaatcttgactatttaatgtgtgcgaagcatgagagaggatgctagggatatagccaggaggcatttagacttcttcctggctgcagaatgcttccagtgcagcagggaagattaaacgcaaaataactcaaactgcacttgcttgtatcatcagtgctgagaaagaaatgcacagtgataagaaaaggggaacttcctcccatgcaaggaatcttagagggtgtccctagataagtcacatgaaagctggggatgggggctgaagattggcctctccaaattatctctgccctcctctcattcttcagcctttccgcacctcactccaatatgaggtccattgttacaatcgtggtgttgaaggtaggagagttcaccttttattacacccacctagctatttaaacacaagcatgtagtacttgtatagatatatttgctcatatttgcaatttctctgtcacggatgtggggctggagcctggatttgccagccaaagagttaacagatgttgaacgcaatgaagaattgtctcaaaacagctgttccaagaaagggatagtgtttcgaataaaaagaacatttgttagagcacacatcatcttgagcctagccgtaaaaaaacccgttcacaagataagccattgttcgctctttgttaccaagtttgtgtttaaggagttaagatttgggagagactttttttttttttttttgagacagagtctcgctctgtcgctcaggctggagtgcagtgagacggagtctcgctctgtcgctcaggctggagtgcagtggcgcgatctcggctcactgcaagctctgcctcccaggttcgcgccattctcctgcctcagcctcccgagtagctgggattacaggtacccgccaccacacccggctaatttttttttttggatttttagtagagatggggtttcaccgtgttagccaggatggtctcgatctcctgacatcgtgatccgcccgcctcggcctcccaaagtgctgggattacaggcgtgagccaccgcgcccggccctgggagagactttcaacttagctgcaggtcctgcccagcacagtgttcacagtctgcaaggaaggtagcagggtattgcatgggattttatgttaatgatgttcaggggatgataattctcacccgggaaggaaatgatccattagttacactctcagtctgtgtcttaggccagcatgaagccattacatatctttagctgcaaaataataattttatgatgagataaggggtagttttatttctggcctattttaaaagagagaagatgcaaggcctacgccagggactaaatcatttcacttcagactttgtatagaattcatgtcaaataaatgtcataaattataaataagacataagtgtgtcacataaaataattctatggtaatagttaatgacagagctaagctgaataaatatagcaaatatgtgtgtgtgtgtatgtgtgtgtgtgtgttttcatgtaaacattttcctctatcatagaaagtgaatgtgaccatcgaacacatccttgaattctaggattagtcccatggatttaagtctcccaaggagataaaagtgaagagacttaaaataaaacaaacaaaaaactcttttgccctatttatttgaataaataagagtaagatagtcaatcactcaatcactttgcaaagcttaggaatctaactgaataacaaaagtaccaactcaatgtagataaggagaattgagtggatcaggagagagagaggtgattgactatgattagtagtgtcatgtgtgaaggaagtacccccggactgccagtcacatagcttcccacatttactctgtcttctttaaaaaatatcatgcttctcaaaatacttcacattctaagagtgcagctgcacgaacatagagttgatgattgcatggaacaactgtataggatgttgtaagaaaatatacttctcttggagctaagagctatgtagttgacagtgacttctctctcattactggatgtctactctctcacaccagcttcctcttttgctgtaatagagtactattcaagcaggagaaatttttgtctccctttctcccagcaatggctggtagagtctggagacatctttggatctcataactgaggggagttatacatgctactggcatgtagtgggtagaggcttgagatgtgctgaatatcctgcaatgcacaggacaggcccctacactaacaaatcatccgtccccaaatgtcaatagtgcagaggttgagaaatcctgatttaatgcaattcatgacctgtaatggaacccattatcctggctaatttgcatttgtgtgtactcctttactaaggctcaattaagtaatttagtgaatatttattcactcgcagggccatgggggagaactgcaaaagaaaattgagggattataaatacctaatgggaaggcaaggtgaacacacatgaaaacaaaccaaaaaaattctacttcaaaatgttattgattttctccagaccctaattatgtatattctatcatttgcagtgcataccctttgtctgtctttgcaaactgtcaattcagataatatagtgtcttagtgaattgttgccacaataatgtcatgtaccaattctcttccaagctcaacagattaacacaacagtgtatattttcattggtttgtctgttggctgaaacaaacaagctccaggctgtctgttgggctgtgtctgctacaatgcatttactctggggctcaggctgaaagggaggtagcacatactagagaaagagcttcttgtggtgatggcaaaagtacaacaggaccaagctaaacatgcaagcataacgtttctgtttccctcacatctgatagcatcccattggctaagacaaatcacatggttgagctccaaatcaaggctgaacaagtatactgtggtctctataaggccaatgcaggatacatggcctcactcaataccggtgggtcagagaaaggattgcgttattttaactaataagttcattttaatatttccatttcaaatttaacattataagaatttttcttgtttttttaagatttattactatttataattgtggcaaaatacacataacataaaattttccatcttaaccatttttaagtggcattaagtatgttcacactgttttgcagccatcaccactatccatctctagaattcttttcatcttgcaaaactgaaactctgtatctattaaataattattcccaattcccctgggattgagtacttatttaaaaaaaataataatctaccacccatttttaatgggagcaaggcttatttttatagagataattggcatatagcatgcatttatagttgtcagcccaacctatgcccaaggtgtattctatccaagatacagacatgtatgtcttcgggacctaaggtaggagccccacagaagtgtgttttactcagataaaaaagccttttgggaaggaattccttccaagttcaggccgagaagcagtatgggccatagccagggagcctgcattagagaaattggttgacattcagacccatgtccatcaatcactcaacagggaagtctacctaattctcaggttccaagcagtagtaggttaatccaagggggaaaaagtgaagtgtgcttttactgaaatctacatggaatattaggagcttagggcatcagcagcatatagctggcagcttcaggagcaaccagtgcaggagccagccagctggcagcagtaggggctttagcagtgttaaaccccagagcccatgagatggagctcagtatccttatcatcagccaccagtggtgggactcagactgggtaggcagtggttgtgaggtcctttagacaggacctgtttctatcagcaggaacaggaggcatcactacagagccctgggaaatgacaggcattattcagtagccaagggaactgctcgagtaattagaaaagcactgaagtctccaccatgtggaatgctgaaaagccctagaaatactgggttccagggacaatctgagagagaagagccatagggagtcctgggtgctagtctagataccacagcttgctatgagtatgactagggcaattcattgaatctctctgggtctttgttttcccttctaaaagtaagagaattgggatacatgatttgcctggtcttttctaaccgatactgtattacctgaatattatatgaatgttgttatatgatctcaagccaggctttatattcatgccacgttttggttgtagaaagtctgtattctttatttatttaattggttaattaattagagagagtctcactctgtcaactaggccagagtacagtggcgccatcagagctcactgtagtctcgaacccctgggctcaagcaattctcctgcctcagcctctcgagtagccggaactacagacgtgcaccaccatgccgagaaaatttttaaatttttttgtagagataggaacttacatatttcccaggctggtctccaactcctgagctcccccagtcctccctgctcggcctcccaaagcactgggattataggtgtgagccaccatgaccagccaatctctctgagtctttgtttctccatctgacaataagagaattgggatacatgatttgcaagacctttttgaactgaaattatattatctgaatgttgtgatttgctctcaagccagcctttaagttcatgccagattttggttgtataaagaccatagtcttaaaccatgctttaaaaaaaaaaaagaaagaaagaaagaaagaaataggcaatttctcatttctttccaagcataaatattagcttaagcattaagatagacaaggtttttgttgtgatggcattgtataactggattatttcatgcagtcttatgtgaggaattcagtaagaagttactttgcatcagctttatctgtatttagcatttagcagattaagccgaattgagggcctttagactaaatggcaaaaatggtttcacgtaataatagcagggtgctttttacattcatgatatctgtttgaacatgttaaattcaagataccagatatatgtctgtatggagaccttaattcagtatttggatatacagtctctctggacataaaacttaggtgtttctaagcattcattcagtatttaatctcaccaagacagcatatgtatttcataaaggtagggaggagatgaggaaagcagaaagtgtcttgaggctcacaacatttaaagtgcagactggacagtggacactcagaagtggcaccaggccaggaaatatgtttagtcgttgtttgattgtttctttgagtattttgcaccaagttagcctacacatttgtttaaattattaaattgatggtcatacaactgcacatgcaaatctgtgtgtctgtcttctctttaaaaattggaagctgctacaagggtgacattctttaggaggggtgcaagctcttggctggcaaagcccctccccatattgatgactaaacccaggccatttcccatcccccatccagcctctgtaattatgtggggttgtgttcctgattctgaggtccatgaatgaggaagaaccagcaaacagagactctgcagaaagagagacacaataggaaactcagagagtatgttcaaagagcagtgcattcctgagcaagggaatggctcactctgacaggtgttgctggaaagccagggaagagactctgccacaccatgtgcactggccttgatgtccagtgtccttagtgactctgggggagctgtctgcatgcaccaaggctggtgtgagtgcaaaaatagatgcagagtgaggtcaagctcacatgccagttcacacgctgaaggactgtcagtgctcccagatacacggcaatgagggtccagtgtcaggagagaacagataggtaaactaaaagcccagactccaccactacacatgcacgtaagacacctgcgctgtaccccctaaatctataaacatttttaaaaattaaaagtaaataaaattggtcctcaccatcatcccagctactcaggagactgacatgggaggatcacttgaacccaaaagttcaagaccagtttgggtaacatagtaagacccttgtctctaaaaaataaaaataaaaatattacccaggcatggcagtgtgcacctgtaattctagctgctcaggaggctgagatgggagaatcgcttgagcccaggagttggaggctgcagtgagttataatcacaccactgcactctaacctgggcaacagagccagaaccctgtctcaaatttttttaaataaaaataaaattacttaatagaacaaagaaattgttcaatttctttcactttacagttaagaaaactaagattcagagaactgatatgattaacacctacccctgactcccccacctagaataaaggtcataaaatttctccccgggccagtgagaaaaataaagtataaaaatttctccccaggcagatgagaaacagaaagagaaagtagtgagttttgtctcctgatgtcagggtcagagccacagagacttggttctggaagtatttgagagtaagaacctggctcaaggctgtgaaccagttgctgggagaggtgttgcctaccactgctggtgggaagactagaaggacatcgatattgagtaagtaagacctcaggctaccacactgcacacctacctgctaccttccggggaaccaagccaggcctctctctggctgggaaacctgttgagcaacctcctcatatttgctgccaacataagctccggttctaaatggagaacctgttgcagggtggggcagcaaaacctcaagagtgagaagagaggcaaacagcaaaatgaagtagaaagcccacgtcctcctcaacaagaaggggtctaactcaaaggaagcaggttgctggaacacgtacacagacctccatacaagaaagacatcatgtgtgtgttcaagccaccatcctccccaaagattccatcacctgttattcttacaaggaatgaaatgcagtgaggtgagagcgtgttgggatggcagacatggacgatggatgaattctcttccctctgtacattttccagcacaaagagctgccccaggctgttgaccccatacactttgagttttgaaaggtttctgtgtttcccttagaaagctactaaaccaggacaggcacagtcgttcaggcctgtaatcagcactttgcaagggtgtggcaggaggattgtttgagcccagaagttcaagaccagcctgggcaacataacaagaccttatctttacaaaatccacaaaaattagctgggtgtggtgacacatgcctatagtcccaggtacttgggaggctgagacaggaggatcgcttaaacccaggacttcaaggttgcagtgagctaagatcctaccacctcaccccagcctgggcaacagagcaaaaccttgtctcaagctgacatccttcagttcctttttgtgtccttgtcctttacaggaagatgaagatccctttcctcctactgttctttctgtgggaagccgagagccacgcagcatcaaggccgaacatcatcctggtgatggctgacgacctcggcattggagatcctgggtgctatgggaacaaaactatcaggttggtaatgcagctcctcagtaaacacatggctgtattcataggcaacagtccccgggatggttattgttgatctacagagcacagaacatgtagaaacgttcaaaaccctccaaaccatgcctggcttcatgtagatacactgagatgtaggtgtcatgaaggcaggtgtgagtttatctgtttgactatgaacagggagctggatgagctcagggagatcactaagaaggtgtgcatcacagttcttctttactaatggctacgatgctgctttccacacattcacatttccatcccttttgttcacctatttcgtcttctccttttggcatctggctttattctggttggttatgggtctgtactactctgtcctggctcatcagtgacttactctcactctcactctcactcatgcccaactctccctcttctagcccaggccctaccctgtcgtcagctatgcaggctgtcttagtctgtaaaggctgctatgacaaaatgccataggctgggtggcttctaaacaatagaaatgtattgctcatagttctggaggctggaagcccaagatcaaggcatagcagattcagcgtctggtggggacgtgcttcctggttcatagacagaaccttctcactgtgtcttcacatggtggaaggggggagggagctctctgggtcccttttataaggtcataaatcccatttacagggcttcatcctcatgacctcatcacctcccaaagaccccacctcctaataaaatcccattgagggtgagcatttcaacatctgaatctgggggggacacaaacatcgagaccatagctgacaatcaggagaggtatcatgttttaggacctcataacttgccagtaattatcaaaacagtggcaacaaggcaatcaaacgagactcgaggtcatttgacccttgggtctgaacatcctcccagaagtgggtgttttgtttctctccctctgcgtaaaatcaacctaacataagacctattttaaggacccttttgtttaaaaaggaaagtaagcccttggggagtagaatactgacattaaaatttcactttctcttcctaataatgtggagatgatggcataaaaatagttctatggagagcttcatcacatgaaagatcaatacaaactgaattaaaggagaggatgaggaaagagattatttgcttctaccagaactttcttttttctttttttcttcttcttttttttttttttttttttttgagaaggagtttcactctgtcgcccagcctggagtgtggtggcacgatctcggggatcactgcaatctctgcctactaggttgaagcaattttcctgcctcagcctcttgagtagctgggactacaggtgtgcgccaccatgcctggctaattttttgtattttttgaagagatggggtttcactatgttggccaggctggtctcaaactcctgacctcgtgatccacctgcctcggcctcccaaagtgctggggttacaggcatgagccactgcgccggcccagaactttcttgtaggatatgtgaatactaaatacctgaagccaggaatggacccattgccaagtgccatggggcgctggttattttccttccattctcttactcctcatcttctttttaacatgagaaatcttggacagtatatttaatcattgcatatcagaccaaacaaaaattaaatagattatgatattaaggaaaatctttcccacaagacatagccaaatatgtctcactttcaatctgaaactttgcatcaaatgttgctttttatttttttaagagtatattgacttatgacattgcttaaattttaaaaagcatatgcaagggtaagatctgcaattttaagagagcactttaaatgtcctcttaaaattgtaattatctttgtatgttttctgccccaccttttgcctacttttgtaaaatgtttacagatcactttatacatttgtgatatagatcttattaatttagtttttcttatcagcatcataattttattcagctttttcattttatctgtttctttaatattatgtattcctaagatatattgagatagtagataactgttcctaccaagatgtcttaattaaaaagttaaaatcaagcctttgaggttaaatctttaccaattatcaaaagaaaaaatgtctataaagccccatggaagaattcatggcaatatataccctaaatctgccttggtctctgtattagagtcccattatttctgaattacatttttcatttttatattttgtaatatcacaccccaaaatagtcacttttttttgtaggccactatagacactaggaagattaattcaaatgtaaaaacagtctctgtcttctaagcatctcaccctttaagaaaaaagcaaattagaaatattggtaattaaacacattcactaaattaataaatggtcactagtttgacattacagatgcaataaaattatttcccccttcaagctatgcatcattgcagcactactctgtgagggcactgatctagggaagccatgggaccaatgaacaagatgtatactcccaccctacaggcagccatcttgaaggggagcacaattagccatgccattgctttacagtgaagaagctgcttgtctggtggagtatggactactgttccaaatataggtcaatccccttgcataaacaaggaagggcactggaggcccatgagaattccatctgtacctggaactgaaggatggcagatgacaagccaggcagggaggaatggacctggattcctggtgaaggacgtggatatatcttgtggggtataacttggtatggtccaaaaactaaaagatattaattcctaaatgacttcccaaaatgttcagccaatccattcatagagaaaggctaaaggtatcactctacaagtgagctcataaataagtatttatgaagcataaaaaatataagccagcaaagggtatgtgggggtcgcagcatctaatttcttcactgtagtgtttgtgccttttccctggagcgtattaacccatttattgatgctcactggttgaggcacatggagtctgattattccctgtccctgggggcatgtagaaattaggcaggggctcattaaagctggttgtgggattccctttggctgtggttggaaagagaggggagtcagattgaccctggagatttctcttttggtgacacagaggtaacttaggagatgtggatcggagaagagtgaagcctcatcctcattcaccccttactttccctccctgcagtatcctatttcaaagacttggtttctctcttctaattcagggctagtgggaccaggagctcagagccctctgtaacatgaatggaccttttggggatgtcccgcctgcatcattcacacatctgcatggttttgttgtagcttgagtcttgattctgtatcacttcttccccacctcccctgcctctcatctcgcctctctttcccacataaccccagacttgcctttgctcattgagaagtttcccagtataaagagccatagacagtttcattttgaaaattatcacagagctgggcacagtggctcacgcctgtaatcccagcaatttgggaggctgaggcgggcagatcacttgaggtcaggagtttgagaccagcctggccaacatggtgaaaccctgcctctaccaaaaaatgcaaaaattagccaggcgtggtagtgtgagccgagattgcgccactgcactccagcctgggtgacagagtgagatcctgtctcaaaactaaatacatgaacaataaatgaaaatgatcacaaatgctatgattcttttgttctaggactcccaatatcgaccggttggccagtgggggagtgaaactcactcagcacctggcagcatcaccgctgtgcacaccaagcagggcagccttcatgactggccggtaccctgtccgatcaggtaacctcctatctgcatcgcaggggctgtggtcaccttcgggacagtctcccacctcgaggtatctcctggttcctaagggttgattttttcctggtccaggaatggcatcttggtcccgcactggagttttcctcttcacagcctcttcgggaggacttcccaccgatgagattacctttgctaagcttctgaaggatcaaggttattcaacagcactgataggtatggacatctatgggatgggaaccatctataggtatgggaatgggagggaggacttggacaaagttagcaaaagagtgggagaggacatcatgacagttatcttagggatgactttgctggtacactttgcataactttaaatggaaacaaaatgatttcaattgtaggttaaaacacaatgagcctatctggactactcaaatgtatagatgtgtgtgtgtgtgtgtgttgtgtgtttgtgtgtgtgtgtgcatgtgtgtatagataaatagatacttaggttatacctaatgatagatggatgaatggatagatggaagaaagcattgatgaatggatggatagatagataataggtagagaaatagctagctagctagatagacagatgcagagagagacaaaggtgagatagatgggatggatggatggatggatggatggatggatggaaggaatagatgatagctagctagctagctagctagatagatagagaaatagaaaaacagacatagatagatagatagatagatagatagatagatagatagatgcagagagggacaaagatgagatagatagatagatagatgcagagagggacaaagatgagatagatggggtagatggatggatggatgaaatagatgatgatagatatgatagatggttggatagatagatagatagatagatagatagatgttatatataaatagatgcagggagagagacaaagattacataggatggatagatagataatgaggcaattggatggatgaaatagatgatagatggaacaaatgaaagatagacatatacatagaaagaatatacaaaactattcacaccatgctattgataaagattttcattttactttccaatataaaattatgtcagaatttgtcttggttgacacacccactgattttatcatgtagatagggttgacaccttcctttttgcatgaagagcttgaatctaagcaggccataaaatgaatcctagcaaatctcagaggagcaaaatgacccttttctttcttccaacatcttgttaaaaaactatcatttttttcttttgtgaggcactcattaatttagtgatctaattaacattttataagaaattttcagaggtgcttaaaataattgctgagttactgagtgtgatttcctcatgcctcaggggtaggttctgaagtaaggattcgtttccacttttaacattcaaggaacaaaattaagttgcttctaaaactttaattttaagggcctgtctcagaaaagcatctgaccaggaaaaagaaaaaaaaaaaaacaaacttgtatttttctgtagagtgtggtttcctgcctattaaagatattagctagttttctttttggatttttatctgattggggttttttgttgttgttttgtgttgttttgttgaaatcactaaattagttcttatttcttggtagagtgagtagaggatttttatctggttgagattttgtttgtttttttgttttgttttgttggaatcgctaaattagttcttattttctggtagagtgagtaggtaataccttagcgtttgtggggaaaaaaaagtgaaaaattctagggtcctatgagcgggaaggctagcttcatgaaatagtcagaaagaacctccttttcagcatgtaggaacagaagcttggattggaatcagggtgtttattgggactgaagtgatcccccatttgtcttctcagggaaatggcaccttgggatgagctgtcacagcaagactgacttctgtcaccaccctttacatcacggcttcaattatttctatgggatctctttgaccaatctgagagactgcaagcccggagagggcagtgtcttcaccacgggcttcaagaggctggtcttcctccccctgcagatcgtcggggtcaccctccttacccttgctgcactcaattgtctggggctactccacgtgcctctaggcgtttttttcagccttctcttcctagcagccctaatcctgacccttttcttgggcttccttcattacttccggcccctgaactgcttcatgatgaggaactacgagatcattcagcagcccatgtcctatgacaatctcacccagaggctaacggtggaggcggcccagttcatacagcggtgggtattgccttgtcctctgatgctgcctgttaaaaaacattctgggttatttctcgtggaggtggaagaaccaacagggttttgttgttgttgttgtttgtggtttgttcgtttttttgagacagagtcttgctctgtcgcccaggctggagtgcagtggcgtgatctcggctcactgcaagctctgcctcccgagttcacgccattctcctgcctcagcctcctgagtagctggaactataggcgcccgccaccacacctggctaattttttgtatttttagtagagacggggtttcaccgtgttagccaggatggtctcgatctcttgacctcgtgatccgcccgcctcggcctcccaaagtgctgggattacaggcgtgagccaccacgcccagccagaactggtagggttattatgctagccacattttcccttccatgcctaacacatttcttcagccagagctcgccatagcacatgtttaatggccttagaaaggtattgcaatgcagtgtgctctccttagagtctctttgccaacattccccacatcctgggctggaaaggcccatggcaaattaatgtctgctgatgacaaaggaggtgtcagatatcccactggttttttgtttgtttgtttgtttgagagggaatctctctgtgtcgcccaggctggagtgcaagtggtgcgatcttggctcactgcaacctccacctcccaggttcaagtgattctcctgccttagccttctgagtagctgggattacaggtgcctgccaccatgcctggctaattttttttctatttttagtagagacagggtttcacaaacttggtcagtctgcattttgaactcctgacctcaggtgatccacccacctcggcctcccaaagtgctgggattacaggtgtgagccacagtacccagccccactggtctttaattttcaaatgtggccatcaagagaggcaagataatggcttatgtttagtttataggttgtccttgtgatataaacaatgtggaaagatccaaaatattttggattaatctctgagcaaacaaaacaaaacaaaaacctctgtgagtaaactgggtgaagtgaatgatgtctcttgggtctgtcaggtcccattgagtttatagttttggggattgcaatctgtaaatggaataaccatcaacagtggagcagacagcattcctgaattacataggtaggtataatatatatctatattataatacataatatagagagcataagtagatataattaagtagatattatatagaggctatgtcaaaaacacttgctattcaaaacaagcaaataaaagtattttgttccacttgtaactgtggagaacaggactctaaagagaaatggaaagttcatctgaaaatcagacgtttggtctttatggtgacttaaactctatgagagatgtaaaagagagttgggagggtgatttaaaaattataaaggagacagaggaaatataggtaatattggtttgtcatccaattaattgcatgacacaaaattgtaaaatcaatctctggattgaacaatgaatgacaatgaaaaggaagttattgtgatgaagggaaactatattagggatttaatttaaaaacaagcaaatatgctcagcctaagaagagaatacatagttaaggtatgtggaagctacataagttagggctggtgagaaaggtaaaaggtaacgtactctatgaaaattatgttgtcatttcctcacatggaagatgttgtgttcctctgtccagatcttgtgtgcctggagttgatgctttactggaggttgggaatgggcagtggttctcctcactctcttcttccagttatgaaacagcataggagcaacccattcacctggaggtacaacagtgtcctgctacccacaacatcacggattatgcaatagataaatcatagggtgtattttagtatatctctctggtatcacaaaagtgtttcatcaactctgacagaagcccacatatggtttgggtgtctgaacagactacgaagtgacttacacaaaagttgcaattgatagtatcacttcctccttctaaaaatgagacacaaatagaatgattagttcttatagttcacaccgcctctcagttttgacagattttgttaaaatctaaattgtcattgaactgtgaaatatataaactggtcattggtcattttaagtattctcagtttcagcctctgggacttggctccagagagtattctatgtactagctgcccaacggctgagggagcaccacacaatttaagtttttattttggttaacatccaacttctgctgccagtttctgtttttgtcagtgaagactgacaaaatctcagtggattaacacttgaagatttgtttcttgcccatgcaaaatctattgctggttgggtgatgctctagggaagctttgctccatgaggagactcagggatccaggttgctaatatcttgtggttctgtcatctcaatagatggccttcccagtagcgtccacaggagaaaagagttgaagggtcccttgggggctttttgttacttcactgacccaggggtcagcatgtagaccaggccccatgtctccaccctgacttgacatggggctaagaggcagtctccccatgtcttcaggaagaagaaaatgaaacggccttgctgaacatatagcagtgattttcctactgcaaacagtgattttcaaatttgttttaaagctgaggaatatttcagatgaaattttatgagaagctaagtatgtcagagggataaaagttgcagtgcttgggtgaacctggaacagaggactgcatttggaaattgctgacatttaataaagccccatggaaatctcatgaacagctggagagaaagggcagactctgcaacaaaagaataaaagaacatgtgagcaaacatctagttagtgcagactctaggcaaattaatatttaacagacatttgtaagtaaaaaaggtaggcacaccaggagaaaaatcaacaccagccttggaattttaaaaaagaattgatattacagctatgtgagtggaggttgaaggaatttgcccaaggttatagataggtgtaaactaaaggggctattttattataaaaatttggattgcagacatgtaccgcataataacattttggtcaacaatggaccacgtatatgacagaagtcccatgagattataatggagctgccttatgcagctgtacgtttgtatcttttttgtttttttgagatagagtctcgctctgttgcccaggctggggtgcagtggtgcgatctcggctcactgcaatctccccctcccgggtttcagtgattctcctgcctcagcctctgaagtagctgggattacaggtgtgtgccaccacgcccagctaatttttgtatttttaatagagacagggtttcaccatgttgaccaggctggtctcgaactcctgacctcaaatgatccacccgcctcggcctctcgaagtactgggattacaggcatgagccaccacgcccggccacgtttgtatcttttatactgtattttttcctgtaccttttctatgtgtacatatgtctagataaatacttgccattgcattgcagttgcctgcagtactcagtacagtcacatgcggtgcaggtttgtagcctaggagtaataggctttaccatatagcctgggtgtgcagtgggctataccatctaggcttgtgtaagtgcactgtacgatgtttgcagaatgatgaaattgcttaatgatacatttctcagaacatatccctgtcactatatgatgcatgtctgtacttgaagcattgatgtgaagtatactgcttattggtattttaatattttcatcagagaaaaatagagtaaagaaaatctatagtttggtgttgtgttgcgtttgtgtgtgtatatatatatgtatgtgtaaatatgtgtgtgtatatatgtgtgtgtgtttgtgtatatatatgtgtgtgtgtgctttacacacatatgtatttaatttacaaagagataaattattgaaattgatttccaagggaagctataggagatatacatgtacagcagcagcaagtattaatgtaaagaataaagaattttctgcccagggttggataatagccactaaaagtcctttaagcaactatttatagatctatcagaattcaggtaagacatgagctatttgtcatgattttcacaggtttgggctgacaggcacttgctggaggggttatgagtcgttcttgggcaatatgcctgttgtctgggtgcctgtccttggtaaacattgggatctgtgagtaaccatagctccatcatgtcatgcccatgctgacagcctgtcttacccaggtgccagagactgcagaaacctctcggattctgctcacagcaaaatggcatggtgaaggatgtcgtgcaattcctaagagaggaaggaagacttcaagctgtcagtcacactcctgaacatttatttccagtattatttgtacagagatactgcagagttagtgcccgtggtcagcccacacagccagatgcaggcattgcagggctgaccacctgcctcctgggcatggcgcttggttcagaactgtacattgtagggtggcctttgctagcctagtgtatggtggcgtataatgtaggatcactatgacttcctgcaggtagacaaagaagggaaaagggagagtccaggactacaggggtagacaagtgatacctcagactttgcataaggaaaaccccagaggtgcttattacagctgaagatggccaagatgaactctagggactgtcacagagtagttccaaatgagactttgcatcagcattttaataagcttctcaagacattctaaactgggtgtttcataggacactctaagaaacactgggtttcatatacatgtatgagctttggctactgtgcagaaacactgcagttatttgtcacctagatttttctagaaggtgatgctgacaggtgatctcatgtaaaagctttggaactttataagatacatcattcagttatatcatcatctagtaaggtgcacatagatatgtgattaaaacaaaagcttatggaaatgatctttctcttactagggtgattgccctaatattttctaccccattttattctgttttttttttttttttggtaataatctggttttggaactaattaatttcatgatgtatcaatgggtcacagtctacatgattgaccatgctcttacctagtgtgtgagctttactgtgtttgataaacaggagcacagccattccaagatggagcggcgctcttgggcctatttaaggcagaaaacaacagtgtgctgtttatcaaatttgctgggaaagctggacatccttatatcagtcttcatctaccacaaatctctcaaaacgagacaaggtggagattaatacagcgtccattatacaatggatagtcagaaatgatacttggcttccagggtgaatcaccttgtatgacatgtattttgacagaaattatttaatctattaggtatataaatattcatatgattacaagtcattttaatgggtatataattttgagaggggaccaaaacaaatttattgatcatgaggatattgaagcctgacaagttaatcttgattatctctaattattagagagctgagattttcttttagaactacagatttaagatgttctggcagcaccaaagttgaagggatggttattgaattacaacaaaaggattttttctttaaaataggtgattctagtgtagatggctattgtccacattggagcactcacagcatggttaatattagtgaaaatgctagcatcttgtacactgtgtacattcacaaacagcttcttacatactttatctgaagatacaaagatttaaagcacattgttacaatcatccttgggtagagctgtctatctgtgttagattagttatctgattcacaaaatataatatccaagggtcctgagagaatggccttgatatgttaccaaagaatcctaacattggtgacaccaccatgttcataaaacattttttcaatgtctgaagacacatttatatgtgttatttcattatccagaatatcctgagcaatttagccaggtcttaccacctttgtgagaaatggaggtagagttattcagcagccgaaaaaggaatgcctgatcaaagcaatggtagtattagtggaatttactcaaatgctttcaaatttaaaaatttccagttacaactggtgccttgtttagatattttaacatatatatatatatttgtacacagctgcttctcagttcatctgtcaaaggtggtgaggaaaatgatttaaaactcctacttctaaaatttatagcctttctctacactgtgttactgatatgatttatactcaagggtttgctcctgagatgctagcttgcaatattagggtatgaatgacaaggaggcataaggcaaagatgcttcattggtttgtgattcttgcaaatgaggtccacttagtcaaacccagtttgtggcctgggattccaagcacatattttcaagttgaggagagcgatgatttagaatgtataaccatccactccacaatccctcaccctaattgactcattcagggataaatttatctgggggagatgcttctattattagagagctggataattagctcaccatatgttatacactgtatagtaattcaggagatgggtcatcctgaatgcactttaattagccagaaatccttgctattcttgcataaaggagtgaattataaatttcttggagatacccaactctctgtatgtgccctgtagggtcatcccattatcacagctttcggttttgccatccctgtcttcattgcaatgcaaaacagatccaacttaggtgcacagcagaaatggtaacacataatgggacatgttcaagtgtaatggacaccgtggaatggttgccaattatacgtcaggtgctgtggatacacacattgttttgtgcacctcccacacccattgcttccttcacaccacataacaacctcatgaggtcggtaaatagatgtctcactgtggagaaactttgaagctgaaatcctttgaatgaacaaagctccacaggtaataaagagtagaggctgaatttaaacagaactaactcaaccttttaaattttggaatgcttcataaacagttgggggaatcttttccatctactctagtgcggtagacttattgagtgaggattagtccgagtgaggattagttggaagaagattagggcattgtatgagtgtctcaacacctttctccagatggaagagtctaggtccaatgctcaaggaaggagaatgcatctctgtaattcttatagataagtttgaagatcagtagttttatcattactatggtaatcgagaagtacctggatgctctgaagagaaaataaagcgtaaggatgatgggtgaatgtagcaagttaattttattcacaaacagcttttttctttagttcaagtcaaggctaatttttaaaaaggtgtcatgctggtgggtagaatgagattcatgttttatgtcttcaatagaaagagatggatgttggtcactctgctttgtgaaaaaacagatatgttggcctcttctctgaattcattgaaacagtgcttcattgctaggaaaaatatttaagtaaatcacttcgtgtttttctctgaagatatatacatgcccacttcgaacagtagatttccaagaatggcaatgactttatacacacctacataatctgtatagtatgttatacagttatgggatttatagatttatctggaatttgccattagtataaggttctccaggctgaagtttattaagttgtttcaatatattaaatatatgtatgtatattttgagatattttaattagaagttcaataaaagctaataagttttagtcaagctcaatgtaggataactcttgttctttatagatgaattttttcagcaaagggtttatggatagcaaatcaaaaatttggaaattatgtagagttctgtttttaatctctgacttcccggagtggtaagatctcctgttctgaaaacagtaaaccctgctccctgacaactctccacagaaaacacaccaagacatcagcatgatggaaagtatcagtaatcaaggggtgggggggaaacacctacatgaaaagattatacatttagtggagagccatggggaagaatctctcctaccatttcctatggtctgtacttttatgataaataaatactcctttctacaagcattgcttgtgtaatcataattccctaaaatctatgacagctgataaatgtattattggaagaagatatgaccttttgtcctggtctatgtactgctatcaccatttggcacagtcacaatcccgaaatgcatttattgggttcctccagcctagcctctcccacttccagctggaccccagtgtaagtggctgtgatgaatagctgtgatttggctcaaagtgtcttttgaataaagggatctttaggaggtttcattagtttcgataagagtgtaagccaggaaggaatggggtgatattgattttaattcatggtaagaaaagtaaatcagattaaacactaagagcaatatacagggacacacacagatgctcattcaaaaatggaaaaagtaaataattaaagaattatcaaagagtcacattattcaataactgcaggtaacacatgatttgtttctaacttttgtgggcctatgggatatgtatttaaaaatgagggcaacgggcacagtggctcatgcctgtaatcctagcactttgggaagcctaggtgggaggatcacttgagctcaggagttcaagaccagcctgggcaatacagcaagaccctgtgtctacaaaaaataaagaaatattagccgggcatggtggtgtgtgcctgtagtcccagctacttgggggactgagatgagaagattacttgatgccaggagttcaagaccagcctgggcaatatagtgagaccctgtctctacaaaaaatcaggaagtattagctcggcatggtcgtgcacacctgtagtcccagctactcaggaagctgaggtgggagaatctcttaagccccggagttgtaggctgcagtgagctatgattgcaccactgcactccagcctgcacaacagagcaagaccctgtctctgaaaaaaaaaaaggaggggagggcttctcttttgaatgaacctctggtttcgggctgagcatattgtaacaatacaggtactgagggatgttcgtcttttgccatactagatctagtgggtccatggcattcccaactcactggggcatagataaagaatacttacacctgaccctggaaatgcctctccagccatacatttctgtatctctgaatatcatgcctgtgaatagctcgaaagcctacatgtttatggaaatcattcacaaacactgtcatgctatgtgaaccattgaaagctacctctttctgggagcaaattctgacccctgccaggttgagataagttctcctctgaattcattctctgcagcactgagtggggcatttaagacagcttagactagctgtcaatgctcttgtctgaactgtgggttgctgatggcagggtccggtccagtctctctttatatttctggtgcctggtattgtgtgtcagcagaacatttgcttaataactgcaaaacttatagatggaagacatgaacagctgggtgtataaatccacctgctgcacgcagaggtggtcacatgaactttgtgggggttgggggtggcggttgttgataccgctatctgatttatgccatactctaattaccagcagcagaaggtagccagaaggaattcacagacatccctatttgcattcctgttattccctatgcccactgtagttggaacaatactacaataataaaggtcagacactcagatgaagattattattccgaagatcctcaaaagtatactttatggcagacagaaaaaaaatgccttagccatcttcttgtgtgaattttcactcctgcctctatagaatgtaaatcttttgattctgagattggaatgattacatgttgctggaaaggctcagggctgtcttctgtatttttaacaaatggagcgcaggcatgtagcagctgaaagttctatcttttcgcacagtgtgcaagacagtggcaataaattttcagaagagttgtttactgaagtactccagctaataaaaaaggaattaagctgttattgagaaatctttcttccaccaacttgctgatgtgtcattcagctttcaaggtcgtagagaggaagagaaacccagatctccttcctgagcctgggtttgaagcaaatggtctttcctggtctctcaaaggatatcacaaagcaagaattccttcacctgggcacaggctgtcagttacaccccaggtgtgtgcaggaaagccagtgatttatgtctgtctagccaacattcccatgcaccgttgatttcacttctgttcctgaatggtaaatcttggaacagtgtttttgcaagccaagtatgcttttctctgttttctgggtttgtttttgtatgtcaaacctaatcaactctactcgatgcacagagtatacataaagatgctggtatctctgatgtcacccctatagaataaaaaaccactgctttatagagagatgatagaaaacaagttccataaatatgtgaattttgataataaacacattaattcccttctccccttctaaggaggattcccctgcattccaagacaaaggtcatgttccgtagccttgattgaaccctgaagctcaggtctttgactcaactgttctttcagtcctcatgaaccagcttttatttcaggctttattatttgccggttgtgtcatctttatcatttatttctttatttccacctcacattttaatatgccacaattttatgatcctgccaatcatgttgatggatgtctctttcttcttcttcttcttctttttttttttttaacttttgagcaagaggactgctatccaaaattggagaatccaagtcgaaactggactggagcccagtgctgggcatttcaatccatgcaatagctcctcgttctcagcaaattctgtcactcacatcctgtatgaccatgtactatgcttgggagattgactttttaagctttcttatctattttccttaactttaaatctaaaaataaatgggagaacagatgagagtgaaattgcagtgagattgttctcatacataatgtaactctctatttaggaacacaaagactgtaatttcatgttcgttttgaggaatctaagccagtttaggggaacacaatctgcttctggggaaggaggtgcaatttgcccaggtgtgagtaaactttccccataataagtaggatggaggcttcacagtctgctctgtgtggccaagctctctaacatactgtggctccatttcagctcctccaggttcctcaagggcatcttctcttagaaggagccaaacacatggcttggtagagatgctcatatgtaagtcatcagctaggatgacaattacagtgcttccatctaagcagtagtatgtcctcttttctttctgagatctaacagtgaatgttatagaccaggtccagtgggctctcattgcatgccttcttattccagttcctgtgagaggtgagacaagccactcaggattttttttttttttaactttcttggctgtgagatattaacaacatttccttgtttcatattcttgtaaaaaaaaaaaaaggttggggggtacctaatttgccaccaagtactggaataataaaacatggtactgatgattaccaataacttgttagatttgatctgcctgttttcagagaactggggatgcctggcttagctctaacccaaagtgtgctgttttgtgctaattttctctttcaaaggagtagggggttaataaatgtaagaactgaaaagggaagtgttacagccataggtgtgagcagttcgaggagcccaaggtatattaacattagcaaaatacaaaatgcatttagaaaagcatatatccatttattgtttccagaaaaacttattagtatttgtgacacccagtccaaaatttggaatgtttttggctatcatgagaagttaaggaagccaggaatacatagaagaaaaattaatttaattacatatatatatatatatatgtagtcttctgaacttttactggctggtaaagatgtggaccataggagatgaccccttcaaagtaagaagagacttaggagagaagttctgcagagtagtccctgctctagagcaactgttacataaaccatgtcccgtcaaagtaacaaaagactgaggacagaagttctgcagaggaatctctgctctagagcaactgttacataagccacattccttcaaagtaacgagatttaggacagaagttctgcagaggaatccttgctctagagcaaccgttacataaaccacatcccttctaagtaacaagagacttaggcagaagtctaaaccatatgcaacataaaccattcacaatgcaattcacattgcattcccaaggccctgtcgttcacttgactgctgggcggggctgccaatgctcagaaagcaaatgcagtatttcatccaatagcagagatttgctgaattcatgccacctgccaatcactttgcgggtgtcaggaacaccatgatataaatgacacctcctgcctggtggtctggtgggagaagagagcacataaagagctctggtgtcgtggaacacatactttattagcatttgctaataaaaattgaatctccgggctgggtgcagtggctcatacctgtaatcccagcactttgggaggctgaggcaggaggatcacctgaggtcaggagtttcagaccagccaggccaacatggcaaaaccccatctctactaaaacaattacagaaattagctgggcatggtggtgtgcacctttaatgccagctactccagaggctgagacaagacaattgcttgaacccaggaggtagaggttgcagtgagctgagatcatgccactgcactctagcttgagcaacacagcaagactctatctcaaatataaaataataacaaaaaaataagctccagaccctacaaccatgcctggcctgtaggggatgcttaacaatattgttttagggttcccttttctgagccccaacagggaaactagagaatactgaagagaaagaggaaatgaccagcagagaatcatctcagtctcccctgaggctagccatacaaactagaatccctcttccccaaggcaagttatagagaccagaaccccttctccctcaatcaagtcataggactgaaaaataggaccaatttttcctcatcctttctatgtaaaaactggccataaagaaattccccaacctaccttgactgtgggtcctagcactcccattccagagaaggtcctaccccacacttagaaagaaggaacgctgctcagagaggccaagaacaatctagacagacaggccttgccggctttccccactcagttcattagcattagatcaggccctttttgtccaatcctatttctacatggctgtacatactttgttgaacctaagcataaaaatagtcaatttcccctttatctttgggtcttcattctcaaggctcctatgtgtacacattaaatgaatttgtatgccctttctcctattaaaaaaaaaagaaattgaattcctgcccccatccatgcattcattctctcatttgtttggcaatattattaagtatcttctacaggtcaggcatggcactagggcctggagattcagtggaaggttaatgctccatggtgctcagccctgatgggacttcctggaaaaggggaacaggctctcagaggaggtggcattggagatggcttctgaacaatgactgcttgccagggagagggggaagtaagttttaggttgagaggtgatgatgtgcagagcattgagctgtgaatgtgcaagctgtgtttgggactggttaccatattggggtagaagctgggctgtgtgagagtattggcatcaacataaggcttcgtcaggactgttcatgttttgataataaatctgaagtgtagttatttaaggaacccacccaagttcacagaagtagttaaaggaagagcttgaatcacagtaagaagaagccattggggagtgggcagtgaggcaggggctgtcattaaggtgtgtctgtcccctctaagcattgcagcttcttgcacaaatctctcagagctctcaccaaccctggggaagtggacacttgtcctgttccctgatagccttcaaaaaggcctctcacccagtattctctttcagcagaaaggaattgctaattatttcccagacgagaggtaaagattgagcctacgaggtgaaactgagacacagcactaaatgcatttctcagagggcaacccgatgtgaagaagcacccatgggacttattgatccctatcagcagactcagttgtgaaacctcataccttcgtatagcaacatcgctcacagcccattgtagcaaaggccacgcattgacagtgacttataactcttgagtatctgtgcattctaatcaattcaaatgaaggaggtttaggtgctctctgaattaaggaatatgtttgcattatcattcccctctctcgagaggtttaggccaattgaatgaatgttctatttaactttgaaaatttcagtattgaccatttagtgttcattctaggagacttgttgtattatagaagagggtagaacacaaaattgagttggagttcaaacagcattgatgaaagtaattgacaactgaaggtacacaatggaatactattcacctttaaaaagaacgtaatgctgtcatttttgacaacatggatgaacctggaggacattctgctaagttgtataagccagacacagaaagacaaatactgcaagatctcacttctatgtggaatctaagaagaaagttgaactcctagaagcagagagtagaatggcagttaccagggactggggttaggggagtggatggggaatggggacatgttggtcaaaggataaaaagttttagttagacaggaggaatagtttggggatgtattgcattacatggtgactgtagtgacttacaatgtattatatatttcaaaattgctgagagagtagattttaaatgttctcacctcaaagaaatgacaactatatgagaaaatgaatattttgattagctttatttaatcattccacatggtaaacatatattattgcactgtccccaacaagtctatacaagaattatttgtatatatcaaatgatacctatatatacaaaatttgtatatatatttgtataattgtttgcatatatcaattaaaaattttaaaaggtagtcttctctagcagtgtgtgtatgtgtatttgtgtataaatttttttcccaaagaaatactattttcaaggtgcttgaattcatattaatcaccatatagagaaggaagaacagaattaaacaacaacaacaaaaaacaaatataggcaattttctattaaatctcttcctgagttgggtctttgggggatgtctcaataacataattcttcacttactgatccatagagggtaacaataagtcacttcatagagacacaacagagacttacctttctctgacagaagataccatattaggcaattaacttgtaatattttgtgaattttcaaatagcctgctatgataataggtggatcttaatcagaatggtggcagacatacttaacattatctgtggtcttttttttcctccctttttttttttttttttgcaggaacactgagactccgttcctgcttgtcttgtcctacctccacgtgcacacagccctgttctccagcaaagactttgctggcaaaagtcaacacggagtctacggggatgctgttgaggaaatggactggagtgtgggtacgtttctcctcagtgagtgcttagaaagctgctaagtctttgcctccttgtgttttctttcctgtgtatttctatctttgttcctgatgcctttagagacagcaaatgtatggggttttttgaaagtaaccaaaaatgcattgatcctgaaaggtaaatagaatacaaaaagcaccttcaccagcctcggcaacatagggagaccccatctctacaaaaaataaaaaaaaatcagccaggtgtggtggtacatgcctgtggtcccagctaattgggaggctgaggtgggaggacgtcttgaacccaggaggttgaggctgcactgagctatgattgcaccactgcactccagcctgggtgagactgagaccttgtctcttaaaaaaaatatatatatctttaccctcttttgcatgtctgcagttcctagtggatacatttcaggggaagtctagtctgtgggctgcagatggaagagattcatggacgaaaagagacaaaactttagtccttattatcccttattctatcaacaatgaaatatgaacaatgccttgtcattagcagttaaatgtgtgatggattttggatccagaatacctgcagctggctacagccttggcgaggctctcagggcaacagtgacgagatcctcgtgttcttcttgctgcatctaacgatggcaaagctttgcttgttctccaaactccttctctcccttcctgagcaaataaccctatttctgagaaacatggcatttttcactgacattgggaagacttccttactgaagctttgtttaagttaaaatgcatgtcttccatatctacatcatcatccctatgcttttattttgtcttgcagagctcagagatcccaggatgggggattacacctggggtctcttagctgtacacagctaaggggttggctggcatgcaatctcatgctgaatgaggtagggaaggccttagtgtgtgagttacgcaaaggagtgaaaaatcagcattccagtccactcggaacttctcacaacttccagtcttttctagcagcattgcctcttacttttacattgctgggctcatctggacagtatcagagtgacagaagagatcattttgtccatattccagtactcgcccaggttcctgaagattttcatatatttgtttccttttactttttctctctctcattcttccttccatttcttttggtgaaataactcaatagtttctaatctttggatccagatgttttggaaatccatgaaagttgcttcctagttctgtttgtttgtttgtttaaagcagaaaattgatggcagtggtggtcacctactgtggtgattgtcagaacaaattttgttctgttttgttttaaatcatgaaaggagcaccttcttaagaaacaagactgggctcttcttccagcttctagatgcttctttaattatctctgtgaacttgggagatgttttacatcttcaggcctctcctctatcatcttgataggaggattcaaattaggcgagttctgaggttctttttttctctaatagtctgtgattctataaagtaatgagagtgagtaccatttgtaatactaactaggaaaaacaaaaccagaacattctctctaacaagatttataagaagaatgcattacgcttagggctcgtacatataccaatacaagcctgcctccttttattttttcctttctaaaatgttgcacataaatcaatttatatttttcgcatcttagtgtaaatcagtagaatattttctctttttaatgagtgttctattttaatgtgtcaggctgcttatgcaactctaagatttctgttggctagcaagcaacctcacgctgatctcatcacacctgttgattaaattttatttaattagcatggcatacatgcctgactcattagaaagtctaacttccagtgttgtctcactactagttcctctaaagtatttggagagtattttcaatcttcaagacctgccttagcccctgatttatagatgtttgtgttgtttttttgtttttggcggaaagataaaatccttcccctaagcattccatgaatttttaagaaagtttttgttttttaaatccaatacatatgagtgttctaaagaatatttcttctttccaagaagggcttttccttattacacaggacgggactgttggattctgaataattatgtaataaaataaaagggggatatttgcttcataagaaacactccctgcacaaaggaaaactgagatggaagcggttaactagtgagggtgcatctcagtcactcagagcatgttctctccacatgtttgagggctgtataattctgtggatcatcactttctccactgcaggtttctctaagcctggaaaggcatattcagtgaccaagaacctttattatgtaactgtacaccagttctactgcccgtgattgtggcttactgccttattcttagctgagtgagtgctgtgtctcatattgttatagtaactagagaaagactgacttcatacagatgttgtgagagctgcagaaggggcttctcagtacaaccacacaagggcagttgaaatccaggagatacaattctgctctgcaaattcacggggtggtcgacatgattttaatcatcagagtgactaacattgagagctggccgtatactgggccctgatagcacatgtatttgtgggagccataggcttttggtcccataaaggttgtcaagaaatcactggcatgaggcagattgattcataggagaaaagacatactaatttattgaatgtgcatacacaagagccttcataatgaagacccaacctcccaatggggtccagaagcttatacaccatcctgaggttacagaaaggttgggggcttgggccaggcatgggggctcacacctgtaatcccagcactttgggaggccgaagcgggcagatcacctgaggtcaggagttcgagaccagcctggccaacatggtaaaaccccatctctactaaaaatacaaaaattagccgggcatggtggtgtgcacctgtaatcccacctactggggaggctgaggcaggagaatcatttgaacctgggaggcggaggttgcagtgagccgagatcgcaccactgtactccaggaagaaaaaaaaaaaaaatatatatatatatatatatgtgtgtgtgtgtgtgtgtgtgtgtgtatgtgtgtgtgtgtgtgtgtatatgtgtgtgtgtgtgtgtatatatatgtgtgtgtatatatatgtgtgtgtgtctgtgtgtgtgtgtgtgtgtgtgtgtgtatgatgggggcttggatcctggtaaaacaggttatgcgggtcagggagaagaggagttctgttgaggggcaataaatgattgctagggagaattattggatacaggaacagagattatcttgtaatttaaatgatccttggagttagtcattgtacttggaaaagggtctcctcaggggtagtcatatcttggtcttcttttctgcaacagacaatgaaattacagggaggggaagggaaaaaaatgttctccttgtgggggtctggatcttaggtagataaaagaacttcaccttctatgggagaaactgtgtgtgggatgagggggaggttagagagacttgaggcttcttcggtttagcatgtcaaaatgcaatctttggggatatcagtttctgagtcccagcatcttacctcattttgtgctgccagtggtccctgtgcagcaggtgatgttctcatcattcgcattccacaggtaaggcaagtgaggcttgcaggttaggtacacccacctcaggttacagaattcataatgggtgagcatgagttccaatgcaggtgtcccacctagaacatgaaatctacaccactttgtttcttttctttccatgtaataagaaagcgtgcatcatgtcagtgcacaaccaacaacatatctccgggacagatctagttcattcattagtcatgttgactggatgctaactgtgtgcttaaatgttttttggcagtgtagggtgggagtggggtgcaatgatgataagactataggtttaggggagaatgttcagcctacaggatagtaagaaatttaagattctttcaggagatcctataacaactcagggcagaaagtgaggaatgtcatgagggaggtgcagataaagtgcttgaacagtttggaagcaggaagggcagtggtgctgtgcatgttggatacagcagccacatcatttcagcagggcacacccacagtggaattctttgggcaatcatggtgctattgcaaagtctgattttcaatcccagttaattctgaagcagcccaagcatcagggaagaacaaacgtgtaaaatctcattgttctccagtatacaacaagcattttggaggcgtgtcattctggctgtttctcttcctttggaaatagactgacatttttcatagacctgttcatggttgggggtcaggtggaaggatggatgtagttctcaccgggggtttcttatctacagcttacaccattatagtgatcacagctagtctgtgaagtggaatttgcatgcaatcagcattcactcagagccctgtgctattaatagaacaacatgaaggaatcataaatcagcctttgctcaggattagactagcaagttctgtactattacaaagaaaaattcaagtggagaacaagaaggtgaatgctaaaacaaatctctggcttccaatcaaagcttcctggccaggtgtggtggctcatgcctgtaatcccaggtggatcacctaaggttatcagttcaagaccagcctggccaacatggcaaaaccgcgtctctaatcaaagtacaaaacttagccaggcatggtgtcacatgcttgtaatcccagctacttgggaggctgagatggaagaatcacttgaacccgggaggcggagattggcatgagccaagattgcgcccctgcactccagcctgggcaacagagtgagattccatcaaaaaaaaaaaaaaagccttgctatggaaaaaaaaaaaagaaaaaacacccttccactgctgagagttggaatcaactgattttatgagattctttcaaacaagaatggcaagtcttcatctttagatggagttccagaagtctttgtgcatttgtcgttcagttgctcaggattggtagcttggcatcccctgttggctgagcatgacagggcaaccctcagtttgatttctctcactctcctctgccttccctgcaggaggacctggacattgctatcgtaccctctgggcacagagaaccaacctggaggaaaaataagtggtgaattcatgagatgagcttgggggatgttacagaatgaatgcgtgtttgccatgcctgacatttagtcagtcatgtgcaactcaatgtagcagcaagggccatgcacccaactcgtcttgagggatggagaataaattggaaggcctcattcgtaagagctcaggattgtgtcaagaacctcaagaaacacaagaaaactctggcaatggggaaccataggtattggtctaagcccttcaaatttgcagtgtaattttaagtagggcctggattatcagacatggttgtaatggattatccattttaaaatagactcttttaggaggtttggattaaaatgattgtgaaagtatggactgtagcatgcaatgaataacccctctgtatataggttcatttacatggacaaaagtcctctgattcaatatacgtagaagacatctacttttagaatctgtaggggccatggggaaaacttccccttcaccctctgaagtttctctaaagctcaactcacaaaacgcagattaattggagaaaagtcataaaaactatattaacctgcacacagggagcatcacagagtggctacccaaaccccctatgggataccaaagcttgtataccatattgaggttacagaaagaatgggagcttgcatcatggcagccctccgataaaataagtggtaaatggtttgtttgtttgtttgtttgtttgttcgttttgagacaggatcttgctctgtcacccaggctggagtgtagtagctcaatcttggctgactgcaacctcgacttcctgggctcaagcaatccttccactttagcctcctgagtagctgggactgcagatgcttgcccccaagcccagctaataattttattttttgtagagacaaggtctcactatgttgcccaggctggtcttgaactcctgggctcaagcgatcctcccatcttggcctcccaaggtgctaggattacaggcgtgagcctccatgcttggccagttaatgtttctttaagatctttaaagtgtaggactctcatttcgtatttcctagatctggacgagggaagtcctggttacatgaatacagagtttctgcagatgcaaatctcccccacaaaaacagctctccttgcatgctgtctgagagccatctcgcatatatgaaataaatatattttgtggtaaaatattttgatttccttcaagttctatagaccaggtacacattaggtgctcaataaggaagttttaaaagtgaaagtatggcggtcaggtgcctgatatttgcaaagcctgatccaaggtgccaggaattactaggaacacagatatgaataaggttgacttggctttctcctatatatcaaaatagtagtccaaccatgggcatggatgagattgttctgcaagaatatttcaggcagttgggcaacctgtgacccacaatttatctccatctaatccaggataagagtttagaaatcaaccttcatgtctttacttctcaaaactgtaagacccaaaaaaacaaaagcccatgttctatttgacattctttgccctatacagagtctagcctggatcttaaggctttgtatttcccttggggtgtaatgcatcacttttctatcttgaatttcttaaacattcttatttttgatcaatgcaaccctctttaaaaagtgacaataatgtgctcacttctggtgcacagtgaggatggaaggtccagtccagcatccaaaggaaggtcacggcagaaagaacctctaaaagaaaaccaaaagaacagccaaaaactgggaagacagactcagagaagtgtgatcagggaattcaggagcaaagagcatttcaacggataatgatcaataccaacgagtacttcagagacatcaagaagggctgaaaagggacaagtgaatgtaactcctgtaaattgtagaattatagtgtattacagagaatgatatttgaggagctgaggtcaatgaggttggatatttctttcaagaggaatggaagaatttgtgccaagggatgacttaccaggctttgtctgagctcatctctgcttggagaccatgaattgggtgttggcacataggtatgtggattttcagttcaatgcagggccagaaagtaggatcaccaaacttattgatgattgaagttttgctagcagggagtgtcacaaaaggcaactgggcagtggaatttgagtgattagcaacagaaggactgaagtggcagatggtggtgggggatgaggaaggaagagagctggtggcttgtgatgatgaactggagattcaaacaagattgcagcaaaggtgttggaaggctggggcagagtggaagtgtttatattccagaggttgaatcattccaggtattcccaggtgcatggcatgcctgctggatgatgaatggaaggcaagttcctggcgttggagaggtcatggaattgggaagccagagtgttcagctggtgccttcatatgactgtgcaccagcaaagatgccatgcacggctgtcctgtgattcctagggctgattatctttattcactttcatggtggaggtttatagccaggcagagagaggggatgcataatggtttacttgcataatggtttactttgtaaggaggaatgtagaaccattatggactgctcattcattaactgagcttccaatattatcaaacactcaaaattgaggcttgaaaattatttcaatcgttggttacctgccaacgtttcaggtttttaacaggtttcagggagtcagggaggtggtccatgcacactaagaaagctggcttccctctgtccagcacagacccatctgttagctcaatggcattaaggcagtattaagagctaactgctgagactatacaactagttatctcttcatagctgtggcacacatcccagtgggatgtgatgtgcagggggatgcacttggagcaataagaaatagaacgtggaagcattttgtcttaaaactcttaagaaaagcaaatgtatcccctagtctctctctcatctgcttccgcagcaatggttggatgtggtatgaattcttaaatgtgtttttaattttcattttgttttaaacatgcgcttcatagagttcaaataaagataaataaatagagcatagagccatgtgacactggctccagactagacagcatgatggaacagagcaggaagcccagaaaaagaatttcatgtaaaatgtaaatgtaaaggtgacccttcaaggcagatggctaagaatggattatacaataattgtgatggtatgattaaacttttaggagagcgattgtagttaattcactactgtctggcattgtggtgctttgcatgtgcttaaatggtataataatggtgttgtgttgatggtgatggtgatggtggtgatgctgatgatggtgatgatgatgatgatggtcatgatagtgataatgttgatgatgatatgatgggtatgatgatggcgatgctgatgatggtggtaattatgatgatagtgatgatggtggtgaagatggtgataatgatgaaaataatgaagatgaagaggaggaagcagggggacgttgtgatgctcaaaataaagaagtcaattttacaagaagtatagaagattaaagtaagttgcccaaagtcatggagatggcatatgatggctaggattttaatcttgtctgtcttacatactatgctattcttgctgttcctcatatatttaaataaattccccatgcagattgtgtttggaaaatggaagtactgaagaattccaaaaaatatattgagatatatttatctgatatacaggataattgagaaaggtctttctgagcacaaaagccaagaaataactaactcaaagagaaagattgcagaattttacttcatgaaatctaaaatctcctgatgtcaggtaaaaatataacataaactgaacaaaaagaccaatgacaaaagacttaaaaagcatgtgcatcatcaacataaaaagaaaactcctgagatataggaagagctcatacaaagcaaatgatagaaagataaatatcagaaaaagacattgattataccaatttattgtatcagttcattacacatgttctagcattgggcattatgattttaaaaaattaaatgtttgctaaaataactgaaagagatcagctctttttaaaaattacacataccacattatactgattcctgaataggtcagacttttttcttgtatttttaaaaaaataattaaactacaaaaaaaatctgttgccatttatccagtggagtcagaatctttccttaatccccaatgcttataggaggacctgatgaaatctatggccactgaatcccttatgagtctgccgctgataccatattactgttgtttcagcttacgaggcatattttaaatattcagccaacacctctcatttatgaatcccaaggcatctatgacacaatgattaaaactcaagtgaagcaacaaattgggctttattttcacactgatgtttttcttcattggaaatcccctttaggaaatgtctttcaaaaggctttaggttatctgtgtgtgtgtgtatgtatgtgtgtgtttacacatgatattttacattaaatttatctcccactcatcctaaatcacactttttaaaaaatgagtctgtgaaatctacttattttaataatgctaatgtaatgttaattccccaaagtggaaactgcagttaaaaaaaaaggaaatccattggtttattcagactgtcaactcttggtatatgcttgcagtcatagctgagctctggatcagatgaaatatgacctctgatcgtgtcattgcacacccgtattgctgagattgctgtgataatcatgaaattgcagatagacagtatcttctcagggacttttgacaggggctggtattaagcctctgctgcctaatgaaccaattttttattcaagcagatctagacaggagagaaatgaaatcatttccattacagaccactgtttacctgaatgcaacatgcataatgaggttttgaaacttcaggaaaacatctaggaggtgatgacaacctctacattgcaaaggaatgactaatacaaacccacttatgcgtgattctctttccacgattgccaaacgtatttaataaagagacagtttaaaaaccgccagttacatgcttgactgtaaagatatatagtacactttaggatatgtgctgttttgctgtttgggagtgttttgtatatactttttaaaatacaaggctttctcaaataggatagaccatttgttactggaatataattttatctagggttcttactccttttcattactgcaggaagaaaatgaatttttggtaaattgaaataaaatcacatatgtcaacattttctattgattgtcactttcagaattgtgtgtttgggaagcctttgtgagtgacaaggcgtggaatggaggagacagtagctatgagatgctcgctgactgtcccagagtttatgcttttcttgtgccttcctacgatgtctggacagctttctcttcatgcagaggcttaggatgaagtcactgagagctaaggtctatgatttaatgtagttcaagagcagagttctgggggtgagtgtgagatagcatgtcacataccactttgcaacagaaaaaaaaatttaaattgttgcctcagtcttctgtgtttttttagtgttttccacactttgtataaatgtttttctgattaccaaagtaatccgcagtatgcaaaaccgaagaatatagacacaaacagtacagaaagggaatgacccatgaaatctcacccctaaataggcagcatcattaatagtttgctggatagatttatttcttatatgttgccagtatgacatattaatatcaagatttgactattaagaatattttacacaaactctatatgctattctgcagttttttcttttcgctcaactatctatttggtcatttttccatttcaccatttcgattttcattttacctttcttagactacaatttgtttaatcattcctctgtgagggacatctgagttccttttttaaaatttttttattttttattttatttatttatttatttatttgtatttcaggtagtgctataagtgaatattctgtaaagctgtgtgaactggtgggaataattttgaaataaaaattcagccgagatcaaatttgctggatcaaagagcataaaaaatttgctttcatttgatattgcctaaaataggtatactctttttttcaccatgatagtaggatacccattgataatcaatgagaacgctaatttcctcatactcttagcaaccctggatattatcagtctctttttcatctatcgggtgaaaaatgctagttcactatttttttttctattgtgtgtagggttagtacagtgttgtatttcttctcccaaggattctttggtcacttttctattggattgtagatctttttcttattgatttgtttgcactatctatatgataagaacattaatattttacttattgtacactgcaaatatttttcctgccttttttttttgtcttttcattctatttaaagagtcttttgcaataaatttttgtagttaaaccttcatgatgtctggggcttgtaattggaagattttttttttttaaagcttttcttactcccctacaaattacaggttgagtatccaaaatactcaaatattcatccaaaatactcaggaccagaagtgtttcagatttggaatgctttcagatttgggaatatttatattatactcaccagctcagcatccctaatccaaaaatctgaaactcaaaatgctccaatgagcatttcctttgtgtgagcatcatgttgacactcaaaaagttcaggacttaggagcatctcagatttcagattttcagatgtagaatactcaacctatatgtatacaccctttcccttgtattttcacccaatatgtatatggcttcatgctttacagttagatatttcatctgtggaggaaattctgtacgtgtgtgtgtgtgtgtgtgtgtgtgtgtgtgtgtgtgtgtgtgtctgtgatggaccatgtgttatttgcctattcttgtgaatttgggtcttgattgatcagtactcttggctggtgtgggacctcttaaaacttgggtaggacaagtgttggtggcccagtgttatactttgtcttcaggtggtaggaatccagttaggatcttttctgcaagggctatgcagagggtcaccataatgaaaccactggaagccaggtggctgtagcccagtagtctcttcccatgaggtccagcattggctgattcatctagctagatccacccttgagtgggcagcaataattagttcaaacctacactgtcactgcaggagattgggagtgaagccaagctccccttgcaagtacatgaggtcctcatggtggtcgtggcatccaccagccaaatgagttaggaccacaaggagggcttcaactgctagagctgtcaagagcaacctatggtttctgggagctgctgatggcttctaacagcctcacttttggactggcttctgtagccaccatttctgggtggggttttaggaggaggtgagggtcatcaggtggttgggcttcccttggtcccatggggcagcaacagtgatttgcaacccatgtgagcaggcaggggcaaggttagggctgggaaagtagtttgcacacaggggagggtgggatggtttggtgactgtaccctccaagagctattttcctcaggtgctaccattcccacttggatgaggagcacaaagccttgaaatcaagtgaaggaggggcttttctcaattgcctccaaagggagcctcctgctttgctcccacatgtcttccccaagcagtgaggagggagcagctggctggtgctactgtgcatccttccctgacctgtgggtccttacctgtggaatctcatctgtatccaggtgtacagccatgtcccccactcagattcctatgatggtcatgaatccaggaatatgtcttttttttccttaagagatgaggtctcgttttgtcacctaggctggagtgcagtggcgtgatctcggctcactgcagcttcaagcaatcttcctgcctcagccccccaagtagcagggactataagcatgtgccaccatgcccagctaatttttgtatgtgtgtatgtattttgtagagacagggttttactatgttgcccgggctggtcttgaactcctgagctcagtcagttcacccacctcagcctcccaaaatgttgggattacagacagaatatgtttcttctagagtagttatgtcacttttgcaaagggagctaggaaaaagaaggaggcagaaattggtctatgttctccttgtttctggaatcttatgaaaccagtgctcaagctgtttagatttctgcatttagaaaagagggaagagaaatacaactcatgagatcatttgaagagaagacatttctatcccatgaatgaatgcatacttaattgaaagcagacagttcttgatctgagccctttctttggcatcatgggaccattttcaaaaaccaaaaggcccttaatggtactggcagcattaaattgggggttcagtgctgtgttgccatctcttctccttgctcttcttgtgttcactgtcacattagactgtgtcctgttgtcacgctgccgctgtcatctgctccactgataatattaatactactactaataaagttactcgttcttctctcactatatacttactgtctgccaggtgttatgcattcatagtagttctcatggcagccttctgcgaatggaactgtattatcccattttaaagatgtgtaaaccaaggtgcattggaaggcagtaactagtctcagcaagctcacaaaatcagcagattgcagaggcaacattcagagccatgtgtatatggttccgccccacacagtgtatactgggacgatgatatcataccacttctggcttcagcatattgatggcagcagcggtgccaagaaaggacagactttgtgaccagattgcatgtgattctatcccccactgaccaacctctggcggttaaatgtgggcaggtgacctctctcactgagcccccacttctttctctgtaaaatgagatcatttcattgcctttcttgctggggatgttttgaagagtgccttcggtgtattaagcactgggcaaacattcactattgttaggaagccttcacacagagcttttgttgcatcacagcgtcagttgattctcttttctgtgcatcttgactttgccgtctctcctccaagtatattttattttgctttttggtaggaaaggggagcaaatggccatagctctcttagggcacaatttcgtgtgttcgagtcttgtgacctttcgttggtttggtatctcaccatgagaaaaatggagtaaatgaaatatttccataactttgtcatctgagatcatgtgagcacgcctctctgcctgcaatctgaagagtcacttctccaacaagcctcgtggagtagaaattcaggattgctcacagagtctgctgggagctaactgtctgtcttagggtgatttctgggctcacccacttggactgcatctctcaacatggcatgcagcgcccgtggtttgggggcaacagtggcttaatgctttcttggggaggtaaacacttaggaaggaaagtttctttacaacaggattctgtaagtcattttatttgctctcaagaagtagaaaaaagagaaggttataacatagcatatactttcgtatattactccttctcagtgcaaaatggatcttgttcattgggtaccccagataccactgaagcaaaaaaattaaaacagaacaaacctctgctgtttctggcgttaccttagtgcctgccatacttaacacaaaatttcatttatttaaggtcactcacagtgagtgtaccctgactaatttagctcatcaattacttaaattttaaaacaaatactgatgctcacctaaatgaactccatttagtcagtcacggcaaaatctaactgttgcacctattcacacttccagtttgtagaaaattgttagtgaaagaacattgttgtcataattttttttttattctaaggtaagacaatagccagaacaaaacaaaaatgacaaaattacagcattttaagtcttttaactttaatcacttgaaggtggaattacctgtcaaatacctgtgccgacaatagctatttcttgtctgccaagtttcatcagtaacaaccatctataaatgcttttatgcatccgatttgttgcaagtaaatataccatactttaggaagaaaaaaacctagagaaaacaagcttctttgacaatctttgaagctttgagcgctgactttgagaaaaacgattttgttttgtttacacaacttgacattttggttttgcgtagtgctgccttgcaattaagcataggaaggagagacgtgaaatgacattacaatttatttggaaacagagagaattgccatacttacagatagagtagatgcttctgtgttactatttctttgtaactttatccttgcagaacttcccgagagggtgtcccagcatggggatgcatctgtacaaaacacagctcttgtagacaggagtgggtcttgctcagatatcgttggccaagaagggcttcagtctattcagtttgggagatggaaagggagtctttgtacagaacagtatacactgagttataacatccacaagtggtgttactgcctggatccacatcatagaatatacatccacattcatatggatttgcataaaagcatgcagcgaactacacataatatgtagcatatttccttccaccatgtctcacccaaagccagtaaatcctttagctactcatggctctgcagatggcttctgcttggtttggtccatagtcttgtcgttccttaccatgttctgcattgcatgccatgtgctttgatccactgcatgccatatgccaagttgaccattcacagaatagtcatttcctggaggaaggtctttattctaatgaaattgctcagtccctctgcttgcaattgcatcagagtcctgcttgaagcatttcttaatttaagagtattccaaagaatacttttctcactttgccactgaaccagtctagttaggactgaagatggaggtcactgggcaaggtcatcctttcagtgcatgcttcctgacttcaaactatattacaaggctacagtaaccaaaacagcatggtactggtaccacactgtctcaatgccagttgcctgatatttggcattggcttctctttgtgcttttaaagcaagagtgggtagggtggcagggcttgcctctgttttgggagggagaagaatgactttctaggtgactgctgtctaaacactagttcaatgcaacaagcctcattggctctcagttgccatctctacttccgggttagacttctgtgcccttgggcagcctcctggagtgtgatagttgaactattcatgcccctgaacatgagccccacaaaaatgtttattggacttctttacttggtactttttaaagagttgaggaatggaacttctacataaagccagtatcaactgaagtatgattaaagacaaggccggaacactagggacataaagatgagaaactcttcattgcctctcctcgactatctggtatgagtggcagtgctggagttattttccactgaattcctcaatgattctttttgtgacccatttgcccactaatttgatattccccatatgtgctgtagtcagaatatagcatgctttcaatggcattaatgttaaatcctttgctcttgcaggtgaatccacatcttcgaaaatggcatttttttttcttccatcatcctattcttgattttaaatgtatgcctcagttacacccatatggaaagctcaaagtaaaccagggtatcagaaaacccagtgataacagtgcagcaagaatgaaggatatgtagatattgtgtatgtttttcttctctctccactttctatttgagtttccagtaaatctgcatttgtgacaaaatagtaaactttgcagaaagaggtttttgcaacctcagattacagatggaaacagtacatagcaggaaaaatagcagaagggttagcttgagaccaggtgtttgaggctacaatgagctatgattgcaccactgcactccagcctgggcaacaaagtaagaccccatctctaaaataaatttaaaaaaaataaaatttgagagagatggggtaagggcattatggccagaccaaggtaggcctggagagccaaaaaaaacttttaactgtaatacatagttgaaaatccattgtatagagtattgattttggtcctctacattaatttagcttataaatcattaatctctgagtcttatcaagtctataatgatgttaccatgtttaaacatctgcaaacctaatttcaggttcttgagcctgaaactaatattatcttacctggaatttgtatctcaaattaaaattaatagtgtttaatgttgtcttataaattatttctatcgtttccatggtatcttccatttattatggtatcttccaagaagataccataagaaattatcaaagaatcaagttatcaattatcatgaccacgctaaaatggtcatgatggaatgaccattaaaagaccatttggctagttaattcagatgggattaataaaagtacatgagagcatctgaatactatcaataattagcagcaacacaattgcaccacaataataataaacatttaagacttacaatagctaaaatgcaaaagcatttagtctattttagtcacatctctaagcacaatcttagtcatgcgtctaaacatggattacttaatgtaatccctacaactatgctacaagatacttttatcatcacctctggtttaaaggcaacaaagcaaaatttggttaggttgagcaacttgtgtcaggattgcccaacagccactacactatagagcttcttggctgcatgagaagagttctggattgtgaattgaattcagacagtagacctacctggttgctggggagagtctcctgctctggagctgcaggttgtgtataagacaagtctgtttggaccaatggcctctgacagttttcttctcactcctgtattctagtattccatcaagtcctgagttcttgagtttgcctcagatactataaagatatctgggttcaaagttaaacaagggatgtggaggacagtagaagctatgggtactacaagggtgttttgggtaatgctttttctgccatctaaccattccaagcacatttaattttgctaattaagtctttcaaggcatagaaaggaacgacattagaatccatgagtttgagttaaagctgtgttctaaataatactccactgaataccaatgtgtatatttgaaaagtgaggtcaaaattaggggtcagaactagagttgaatacctgttgctttaaagtcatggcccaattatagctcagtcaaaaaaatctagtggaacattcctcctccatgaatttattcagcctgcttgaaataattgaattaattaattggattaaatgaagtaatatatttagagtagtgagcatagtgcctggcttgcaagacaggctcaataaatggtaactgctatcattattattatcattattgttatgattactcttctttccacagatgtgtaaagcatctttgcttaaaatgtgcctatacctccattacattgagtagaaaaatcatagatgagaaaacgtctataatggaaaactaagcagatatttgcatcatcttatcttttttattactagctcaccttatatttaaggtatctctggtaggacccacggtccctagaagggcccaccaatagcattggtattaaggatcttggggaaagatctgcttctctcgactaacactgcaagtccccacataaagcaaacagatcatcctggagttaggaggatattgcaaagaagctgtgactggcaaactgaaggttgcatggattaaggaggttgcaaaacataaaagatgagtttaccaaggcattaatcaatctgtccatgttttaattcaagtggaaagaaaggcttggacctgtgactgatgtacaaggtgtcagcaaaggaaaacatcattttcaattttgtatcttcagctttagagatggtaaaatccaatgcaaagacctagttgtagcatgaacgtgagtctcgatggtgtggtagagcatcataaatatgaagaattctgaagggctttgtttcccagtccattgttcatagcctctggccattctcgactcacagtcctccctcccttgtggctcagtctggaggtttaaggttgcacctccagttggatattgctggagaagttctggctgatctgtgtccagagctttgcattgacttctgtcatagaaatgatgcaatgagcatctgtgcaacctcctactccatggcacaggctgggttacctcccagggcaagttcagctgatggccataccaaacagcaaatggctgtacccgattacccaatctctatctttgcaagaagagaaagtccaggaaatacaatggcattgctggatcaagaattgaaagacagtgtgctcactttgaactctgctctttcaaaacatgtcctgctagtctgaatgcccatggctcagggaaaccactctattgtgatgtcgataaccctatggaaacgatgtccaaagtggcttcccttgagctacaggcatgctgactttgggtcttctcccagacaccggaaggagtatagttccacagaacaggtacaatgactttgttcttccccgcaccttttcccatctatgcaggaaaacactggtgtgccccatgaacgtgagaacaagttggagttatttaaattatttccagcaaatgcaacaccctggaaaacacacaagttattgttaatccaagaaaatagtggagtagatccgtgaaggcatcccagatggtgagagcagatgcaagtgcaggagggtaaatcacacattacgactgccattagggcaaagatgggtttaatggaggaaatcacaacattatcacaacaaccaggtacaacacaatataagaattaattaccaggggacaatatgaactcaggaacaaaccaaagagggaaacccagtcaagtgaagacagggttatctgtagaatggcgacattgcactcttacagttttccatgttttaagtaccctaataattccgattatatgcatagtatgattatttactatgtttgaaagttatgtgtcaaattgtctgaaactagccaagtctcattatgagcattgttactgagaactgtgaaattccagccatctctttttatatgtcaacattgattaagcatttagtcgcaggtaacctttcctctcaaagtgtggttcttgggcaggtaccatcagcattatgtaagagcttttttttttttttttagaaattctcagatccccactctaggtttactgaatcagaaccttcattttagcatggtcatgaattagccaattgaaattcaagaaacattggtatataaggtgactatactatgaaacctatatgctaagtacaaggtcttgtgtgttagtttggttcagccagcagaattctttaaaaaattgtttaagttaatctaatcagtttccgaatatcacatttgcttacttttccatagttatttaaaaaacgattagggatgtcttcttaacatgttttgaatgaaatttttatgttaacttatgacatgtgaaagtgagtaaattaataaaaagcatgatgatacacaaattaatgcatgtagtgactagttgaatgggaagatcttgcattgggtacgtccacccatcaccgtcgaagagaaatttatcctctaatccaagaacttcagagaggatgattctccatcatctatttgaggcagacaaatttgcatttattaacataaactgcccatggcagaagtttgagccccttgtctcttgctcagtcattaggggagataggagccactcttctcttgttattcaggaagtagatacagtatgtgctggagttcaccatctgcctcccagttccttagttcctgcaactctcctgcaagagtttcatttccagtgccctccttagaccttgctgtccacttggcatttgactgattgaatcccagatgaccttttatgcaggagttgcattagatccatgttgagtacagcaaagcacaacttctcctatttaactattatgccattttgcattcttctcttgaaaaaaaagggaaaagccatacaaacaccaatattccctgcagttacattgagtaggtaggaaagacttccttaataaaccccccaaaagacagcacatcacttttgtatctcaaccaacatacaaaatgcagattatcaactttatgcctttttattttggtcctatactatttttcttttatgtgtaaacttttagatttgattttatactgtagataaatcatatgctttccaatgtctgatctgaagggtcccttgagctccatatggatggaggagatcaggactaaagttttggaaatcttgaccatttatttcaggaagaagtactagattgaattcacctatatgaaatggacattgtatcaaactggagatgatacacctatttgtgcagtgacagatataccctgatgtatgggacattggtgttacttctaatcctaacaaagaattccctttctgggactagtgacagcagaatatctctgtgccactccacaatggttcaggagagcatgagaataacgctccaaaggccacatccctgaagtaacacctagcattttatatggccagcagagagtcgtagccacccccaggtggtacaattattgcaactcttatctatcttaaaattctagctttagctgaaatactggagtctcgccatctctgttggtcagatgtaggagtaacttgctcaccagcatagcttcagggagactttagggtaccattgtgccctggagttacactgagtaagtgaagaggctttcttaattattaacagtgggtgcctgtttaaggggatatctacctatctatctagcatatgtgatataaaaataaaacacctatgttttatattatatattaatattatataaaataattatatatttatatatatataaatatattttatttatatatttatatataaataaatatatttatttatatataaattattttataataattatgttatatgtatataacatatataagtatatatttatataattataatttctatataaattgtataattaaaatttatatataaagtatataaatatataaatatataattatataaaatatataaattttatataattatatataattataaaatttataattataaattatatgtaagtatataaatataaataacatgataataaatatataattatattaattaaatttagaaatattataaaacataatttacatgtatacttacaaaattataacattctatataaatttatataatatacgtataaaatatataattttatatatgtgtatataaaaatatatacacatatataatataaaacatatatacatatatgtgtgtgtgttatatataatataaaacatatctatgttatatttaatgagcctaatgcttccaaaagtataactttcatatatatatagtgacttcatagcactttgctccagtattctgtctgagtgtacctaccttgtagaagaaaaggcaaagcgaaatgaactaaaatgacaaggatttggtgaggcaagctgaggttctaactccattgtaaagttaaggaacagtgagcactccctgtacggccagtccaggatgaagtgttttgggtggaattcctcattcttccacagcaaccccctactattatccattatcacctctgacttagtggcagaggatcccagtgagaagccagagacttgggtttcaaaccaactcgcttaagtcaggacctagaagcaagaactttagcacttagtcctatgctgtggcacctcactcacctaagacctcgaattctgctttcatgtttgaaacccttctctctctgcactttgtagctcagtgcctgactcttaatagtagcttagtgcttgtttgtgggctaaataaatggaatgacagaactttctagaatttaggcttcctctgcaacccacatccacacttgacagaggaaggagccagatttttgcatttccaaggtttcttctttgggactgcaaaaggtctggttaggaagccctcacattgataagcttgttcttgttatctccagttaaataacaaagtgctcttgaaatggcttattttctatatttgtttccttcagaaaacaaaggcagaaagctttggagatagaacatttcatttacaagctataatgcagctcaccatcggcaattcaaaactatcactctatataaatcagtgtcattatatcttgagaaccttcctgagaaataatatttgcagacctctaatttataatagattgctctgaaagcaaaaataatacagcagcatttgttctcatgggagatttctgttcacagtgtttaggagggaaacatgttagacctttgtaggatcaatgttataaaaaattaaatgtcgaatgggctctgggatttacaaatgagattctggcttaagacctgagtagtatgggatccagactgtatcttttgggaaagaatgggctaaaaggaaattagaaatctgaccatttctcaggaagttgagctaaatattctaccatgcatacgtgcatggcagcctcagctactttctcttgtactaatcccagcccagttgtatagggcactttaatgaaagtgatcactctaggcaatgaagaagaaacttgatgaggacatgttaaatatcatggtcatttgaaatattggaatttggaggagatatccagggataagcattaagatggggaaggatgcaggatatttcagttgagagaatctgcataataaatgcagctgtaaatttgtctggagttaaaaataggcaagaggagaagctgtaagtaggatgtagctggccttggctttggggataagagctgtccctgaaaaactctgtgacaccccagcctttagcacacagcccgtgtaaggtgggcacttcataaacccatgttgaatgaatgcatgaggaagtctaggagtcaaaactgcatttgaaaggcatttaaaaaattaacagaaggaggctgaggcaaggggattgcctgagcccaagagtttgagaccagcccgggcaacaaactgagacccaatctctacaacgaatacaaaaaaaaaatagccaggcatggtgatactcacctgtagtcccagctacttaggaggctgaggtgggaggatcacttcagcccaagaagtagaggttgcagtgagccatgattgtgacactgcacttcagcctgggagacagagtaagaccctgtctcaaaaacaacaaaaataatagactatttttgagcagttttacatttacataaaaactgaacagaaagtaaagagtgttcatacactctcccctgcacatagtttccttattatatatattatgtattcatgtggtatatttgttacaattgagccaacattgataagctgtgattaactgaagtccatagtttccattagggttcactcttcgtgttgtatgttctgtgggtttggacaaaggtataatggcatggatccacaattacaggatcatacacagtagtttcactgcccccaaaatcctctgtgttccgcctcctcatccctcctttctcccaagcccacggtaatgactgatctgtttaaggtctctatagctttgcctttcccagaatgtcccatagctgggatcatacagtatgtagccttttcagattgactcctttcacttagaaatatcttaagatccttccatgcttttcatggctttatagctcatttctttttagctctgaaataatctttcattgtctggatgtaccacagtttatttatccattcaactgctgaagggcagtttcattgcatccaaggttttgacgattataaatagacatggtataaatatttgtgtgtgggtttttgtgtgcacatgaattattatgggagacacatttttataggaaatttctttgcagcattttctttgtgcagatacttctacatatagaaagatgaattttgtttcaaaggagggtgtatggtcatatgccctttactaaatactaactacaatacacggaagcaaattcctaagtcctctgctacctgcctaatctgtgttattttacacagaggttgttgtatgagcaaaagggggcatttttctttcaaagtataaacgggggttatagcgccttattgtttccttctatttcaactcattaagctaattaccattttcaaagtaattaggcttaaattagtgtctcagccaaacaaccccaagcccgagagcacaggtggtttgcttagctgcaccagataacaccataataaatgtctgcctgatcatgatttatcatgggagacaaattgctaaaatggccctcgggtgtcttattttttggttctgagtatgacatttacatatatggtgtgggttctgggaatgtttatcatttgagttaaaaattgagaaacattgaacatactctagcccgtggcacttgcaatcaaatagcaaaaatatgccttgccacaaatgacttggttgttgcttttgcatcagaaatcatctctgccacctccatgggcatctcactctgcagtccttctccttccccttttcgggaccaagtgggtgtgagtgcaacctggagcgaagggtctggcactgcagggtgtgatctacctgctggataggatgtattccaaatcctatatttaattatttcgactgcagaggatgcctgcggccattgtagaatatcagttgttgtggacatcctagtgtgactaagagcccacccaaaatttgattcccatgtctagaccagtgacagcatgcacacactaagaggatatgaaaaggcttattactcatataatgtggctttctgaggagagcaggtgatatggtttggctgtgtccccacccaaatctcatcttgaattgtagcacccataattcccacgtgttgtgggagggacccggtgggagataatggaatcatgggggagattttcccccatactgttctcatggtaataaataggtttcgcgagatctgatggttttatgcggggtttctgctttcgcttggctggctctctctcctgcctgctgccatgattgtgaggccttcccagccatgtgatactgtaagtcaattaaacctctttttataagttacccagtctcgggtgtgtctttattagcaacgtgagagcagactaatacagcaggttactaaaccagtacaaaaaatagcttgagagagctcggaaaagaaacggattctgctgttatggtgattagtacttggggctgggataagggtctcttgcatgcagacaggggcttgcatagttccaacctcccaccggcggtgaaggagggagcgcccaggatttcttatcagcctgcgtggcacgagcagaagagggagagatgaggcttaaaaactcttagcactcaaacattaagaaatggagtcaggctctaatataccagtcaaagcctagcagtatgcactgacttattaaattaaatcagcagcatatgactatgtagagccctgtggaaattgtacattgtctacctctagtttgcccatcattgtcttctgatttgagagctgagtgatagcttcctaatcagaaagtccatgtttcagctccttcttcaaacttcaactttcctctgtttttttcttgcagaaaattataagcatatgcagaaatgaaatagtacagttaaacctccatatgcccttcactcatatttaacagttattaactcctggctaatcttgttgaatctatatcccatactcatttattctcgccctgcattcttttgaataagacagcagctatcatgttcctcaccacctccatttcatctacgggtatttcaggatatatctctacaagattttttttctctggtgtactttttactcctctgattctcactgagtctatctattcacctgttcaggatttgagcattttgagttttcaatcagatttaattcttactttctgattcttccacttcttaagtatctgaacttgaacaaatcggccttttacagcattgttgctctacccataaaatgaagctagtgccatttactcatagggttcagtgtggtctaaacaagataatatgtaataaaattctctacatgtagacagtgctcaacagagggtagcaattattgttattattattgttgttgctattattttttgaggggttatctggaggtggtatacaatgttagttctggggaaagaaggtgaggtcaggaggaatgttgatatttgtgatggacggtttagacttggagaataactcccggttattcctctatcaatgaggaatattgatattcatgtgagggatagtttagatttgggtatctactgtaagtattaaaagagaatattctcataaaatatctatatacatatttgttcacataagaggaacatcactggtttagttttcccatccaataaagaaaaatgatagacttctttatagccttagagccaacaccagctggtgagaacaacctttcagcttctttcttctggcacctgcctccaagtggctctccatcaatgaacctggtacttttagaatactttctcaggtctccctgcagaatcacttcatgatacccagaggttcaaatggtgcttctaaatggcactcaagtcaatgaatcttggtgtctattctaagaagccagccacagccagtcttgattgcatcacgtctcatgctgggataaactccaatatgtaagaacgtttacttccaccttgagaaattagccacccactgagtagggcaaccatctccatttgctttatgaatatgcattatttttaaatggagtctttttcccctccagggcagatcttgaaccttctggatgagctgagattggctaatgataccctcatctacttcacatcggaccagggagcacatgtagaagaagtgtcttccaaaggagaaattcatggcggaagtaatgggatctataaaggtgagaaatgctgggatggagaagctctggcctctcagctcatccgctggtcacttttttcttgattttcgagcttttccatagttcttctgctactttgcaataggtaggacttccttgtgtcatggagacagtcagaaggccaaagtgaccatttctgttctggttcccacagaatttaaaagcccacatcttgtgtcaagacattagaatgagagtatgtatctccaaatgtaaatgcagcctcatataatgtaactgattaaaacaagaattcctctacacctatgtgtagatttcctgtcactactgtaacaaattgacacaaacttatgggcttaaaacaaatttatgaacttacagttctagaagtcagaagttcaagatggatatctcactggtctgaaattgagatgtctgtagggccttctacaagctcttggggggaatctgtttccttggctttttcagcttctggggacttcccactttccttggctcatggccccttcttccatgtggaaagctaacaattcactgtcttcaaacctccgtgtctgtgtccgacctgtgcttccataatctcatctccttcacttactctgacacccctgcctccctcttatgaggacacttgagattacgttcggcccacttggataatcccacatcatcttcccatctcaagatcatgaacttaatctgcaaagtgtcttttgccatggggtgtaacatattcacaggttacagggattaggacgagggcatctttgggagaccgttattctgcctacgtgaacccacaatagtattttgagctaacacttttcaaaaattttttttgcagcattagctgagccactttcatggtggattgggcatcatgctagtcattggagatatttgatgagacccagctactggcttgtatagtgtatgctctgccaatataagatagacatatatattgtctaatatatacatttagacatatcttatgtacttatacatagctaatatttaatgtctatatacattagacatatctaatgtctatcttatatgacagacattacatgacacacaacgtggcccatttcataaagtgatatgatacctaaaagggtgtatttgtgctaagggttaggactccccagccaaatctgcagtggatatgggttgaaggtacaagaagagatgacgccttaaccaaaaggggagggtgaatcacagtttacctgcaaagatatgaaaggatgatatagggaatgcttttatctatcaatttgtttagaaatattgattatcttctgtgtgtcttgcattgggccagacacaacagtaaatatataacatggtgtcttccctgaaggaagtcatgttgaactggtaggtgggtgggtagatgatgacgtgaagcctgggaagacccagtacaatttgacaagggcgctaacacttgcatgcacaagatactaatggcacaaggggaaagagagcctcacttggctgaggggttcccaggaatgtttgcaaaggagacacggctagaaaggaggtcaccagtgggtctgtgcctctgctttctttccccttctgtctctttctgctcttccaaccccttgctctcttttgtcatgctggaaagaaggagaagcagcaaatagcttgttctgcaaactgcaaggagctcagtaaggccagattacaccatacctgaggcaaagagaaatagtcctctgtagtctatccctgcagcataaggctgcaggtagcttatgaagccttatgcttctagttacgtctctgtgtgcacatctggagccctatgaccggctgagcacccatgggcaggaaccgtctcctacaccttttgttacctggcacctagcacaaaaagatgcctgttaggtgcatctggacaaccttcataggctgctcagacctcctcccagccccttcctttaggtctcattgttaccttgctcaatgcaggacacataatcaatatgtaatgtgggtttgattaatgaaccggtgtgtttaatctgaacaggattaaccccagtaggctatcactctttcagcccttctctgtgtgccatgttactttaaaagtagtaaaaagtggaaacatgtattcctaatatatgaagacttggtattaccgggctgaactggggtccactcacccagcgcagtaaggccaaacatccacaccgaggttttgcagtgggagaaaggagggtgtttatttgcagggttccaagcaagtagaatgaggcctctctcacttaagattccacttccccaatggtttgcaagcaaaggtttttaaagcctgggaggcagaggctacaggcaaagtcataagtctatacatggagattatacattggtttgacctaaaaaggcaggacatcccaaagaagggcgcccacaggttataggtggcttcaaagattccctgatttgcgattggtttaggaagtgaagctttgtctgaaaatttggggtcagcaaaaacaaacatgatatctggcctgtgggcgtggcttcctccaggccccttgggaagaaatttggaacaaagaatgtcagtcagagttcagtcctcagttcctctttacctggagcctaggtgccagcagatggcattttccatttggaaggggtccactttctgaaaaacaactatgggacatatgttaaagtgttatctgtagttattacagggaaccaaacattttatggctctaacttccttgtctattattttactctatgattaccttcttgcttatcagttgctcatttacttttcaaagctagctaggtgcctggaattttctttgaaggaactcaagatttttccttatttccctgcctgggggagtccagcaggcccctaagaggggtccctgctccatctcattggtgtttcagtcttattttcacaaggctataacctgtgtggatagagttgtttttatttcattttgtagatgccagtgtccctaaagactggagttccaggctgcattccacgctctagttcatccattcattcattctctctcttagtgcctgttcagttccaaaatagcttagcagctgccgaggaggagacgtgtacatcaatcacaattctagaagtggttggagagtaatagttacttaagaaagttacctatggaaggctatagagccccagggcagggagaggggacccctgactgacaatcccggggaagtttcatgggacagagaaggagctgcatcacgttttgcacagatagttcaccagggttcagagacacgagaggtatagatcagaaagggagcctcaatggtcttgaataatggttgggaaccccagttttatcatacaaccctgcaagcatgtcaggagctactccataaatttcttttttttttaaagaaatgtatttgatgtattagaaatgttttgcttgcatgctggagagaccatgaatgtgtaacatgattaatgtctcagccaccgctctattgcaaagtattatccttttgtcaacttatttgaaatcaagttcacagtgaaacactgttaaaatacaatgccctaaaaggaagatggggtttccttctagttatgggaagtaggcttctgagtgtcaagtgtcaagatatcttgttctctagagctgcaaactcgaacacatacctgtggtttacgcagacacagagaaatcataggatttaacaccctgtttaaaatagcatcctttctaaacaatgatgacttctactgtccatcaaaacccttcaaaggactttgctatttgaacttttttttttccttttgagagaatctcgctctgccacccaggctacagtgcagcggagccatctcggtatttgaacttaatgattctactgtattcccaagtcaaatctgtttccctggtgaaatctatgggcttcatcaatgacagagtggataaagaaaatgtggtatatatacaccatggaatactgtgaagccataaaaaagaatgagatcatgtcttttgtaacttggatggagctggaggctattatccttcgcaaactaataatgcaggaacagaaaatcaaataccacatgttctcacttataagtgagagctaaatgatgagaacttatgaacacataaaaggaaacaacagagactggggtctatttgagaggggagggtgggaggagggaaaggagcaggaaagatcactattgggtactaggcttaatacctgtgtgattaaataatttgtacaccaaacccccatgacatgagtttacctatgtaacaaaccaaccttcacgtgaatcctcaaacctaaaataagttaaacataaataaataaataaaataaaatataccagacttcttgttaaaaaaaaaatctatgggctaaatttggtagaatggctaggattaaatcatccttccattaaattcaataggttattccttttaataagaggtacattacatgtctgctgcagtctacatttaaaaaacaattatctaatattccaggggtgagggagtaataataggactgtttcatttctttaaggaaatgactttgcagtatgattattctgtttaggtttggatatgggtaaattttgtctttgtcaaaatgttctagcataaagggaaattgggaaataagggtagggtcaaatgtatactttggatataattctggtcaaagtttagaaatcttggcagtaagtcctttatacagtagttcctaaaatatttccctctgagacccttctaaaataaattttcttctattgtccacatgctttgaatgattgtgtcaacctaataaaaccaattttctaaggaataatttatcttcccatttaataattaagaaatcattatctccattagggcttccacttaatttgactgtgttccataccatgtgattatgattttcatagacagcaagataaataagtaaaccactgaacatcccatagcctgtgaccctttgtagctgttaaatgtaaaattttccatcagggctgttgacatttgaaaatgttcacattgcttctttgggaccttaggagtagaaaccattgcttgaaactaatagaggatttaagatttctatgcaatccttaactctttctaggaaatttagtttatggctctcaatttatgttcctacaccctggacaggtattggatctatttggatcagcctggtgggtgagtcttgagaagacgcttcattctgcacttgtatctgtgtcaaggcagtagaacagaaaggagttcaagctgagagtcctgcaaattgcagttctcttattgaaggagcaagtggccccacccctagcttcacttttctaaatcagggttcaaagcctttgagcctctctttgcatgaggagttgcaaacaaattcatggaagtttcttctcaaccttcactgcagctgcttctcacctgatccacctctcaatgttgaagacctccagggctctgtcctgggcccccttccctttatcttcacacttgccctatctgatgtcatccaaatccaggacgtcatatgacatccaactgcagggcatcccacatacagagccgggaccctgctgtggaggtccacattgctatgttcagctgcccacttgccacatgacctggaagctcagtaggcatgtcatctcggaaagatgcaagctagacatcaaatgcaagctagcccaagcccacacatgcccaaatctgcatgatcttattgaatgctttaccccgtgactgaacctcagtgctacgatatttgctggttgatgggcttgttttattttgcctctctttaacccctatgtatcccatattttggaatcacatcctattcactttattttctaagtttatctgacattggtcatcttttgtcagctgtatcaattttccatcttgtccaggccactgtggtctgccctttggacttctccagtgtgcttcttggtggtctccctaattctttgttctcacactccgttctctacccagacactggagtgagctttcgtaaacatagtgtcaatgtactctattgaatttctgaggactgacataactgttagcaccacaaactgggtgacttaaaaacagcagaaagttgttttctctcagttctgggggccaggagtctgaaagcaagctgctggaagtggtgggctccctacgaaacctctaggggagaatcctttgttgttctgccattaattcttaaccttccttgacttgtagatgtgtcactccaatctctgcctccaccttcacatggcttttttcctttcttcaaacactctaatatcaaccagccatggtggctcacacctgtaatcccagcactttgggaggctgagatgggaggatcacttgagctcaggagtcggagcccagcctgggcaacatagtgagaccttgtctctacaaaaaacatgtaaaaattagctggctgttgtgttgcacacctgtagtccaagctactgaggaggctagggtgggaggatcacttgagcccaggagtttgaatctgcagtgagctatgattgcaccactgcactccaggctggtcaacagagggagaccactgtctctacaaaaaaacagtttaaaaaacaaaattaaccaggggtggtggtacacatctggagtcctagctactcaggaggctgaggtaagaggatcgcttgagcccaggaagtcgaggctgcagtgagctatgattgcaccactacactccagcctgggcaacagagcaagaccctgtctcaaacaaacaaacaaacaaacagaacaaaaaaccactccaatatcttctcatccactgaaaatacaatgtgaagtctgcaccccagctgtacagttttctcctcctctcttcctggcttttcctgggtcccccaaccccttcatcttgttcccacctcagagtctttgtgttagaaactcatccttccatctcatctttggatggattttatctttcactcatatgttgcctttgtaaggtctccctggaccaccaaatcaaaagtccttgtctctcccaccactttattctaattgctcgcatctctgataacttacctgtttattattttatttgctcatagtccttctcccatggaagctggaatctgggctgcctcatttaccactgtgtcctagtgccttgagtaaccatggagtaggcattcaataagaacttactgaatgagtagggatatggtttggctgtgtccccatcaaaatctcatcttgaattgtagctcccataatccccacatgtcatgggaggcacctggtcagaggtaattgaatcatgggggcgggtctttcctgtgctgttctcgtgataatgaataagtctcatgagatctgatggttttataaagggcagttccccttcacacactctcttgcctgatgccatgtaagacatgcctttgcttctccctcacctcccgccatgattttgaggccccctagccatgtggaactgtgagtccattaaaacttgttctttataaattacctagtctcagatatttcttcatagaagtatgaaaatggactaatacaaatagtgaacacttctcagatttctcttccttctgtctccttctctccctatttcttccctttctcctaaaatatcccttagatgggaccagaataacttccttaagattttcttttagttgagtttagagttgtttgccttttcctcatactacaagatttccttattctcagaacagaacagttaaactcatatgtctggcttcatttccatccctctcccaagtcaaggtcaccctgaaggaggctcttcctccctccctttttctctgcctacaggcaagtaataaatgtcaatggaatggataaattaactctatagatggcttctgcagaagtgtgggggtgggggatcatattttccagagtgttcaagaatatatacttttttttcatgtgcagagaaatgcttttaaaattccctgatggctgcatggaaggcactgctcttcaggcattttttccttaccttaaggccaaattccaaacacgtggcttgagtccatgtcacttatgagttgcttcttacagtcactgattttgacatctcttcctgtcattcaataacacagctttctgagagcaattgatacttttattgtgagagaaaaatagtagcaactgactctggtagattattacaaggtagttatgttcaaatgatgttggcaaacattgtcattggcttcccaagagtaggcaaagctgcctcttcatgctagtgtcagtatttagtcctccagcaggtatccacagccttttaacctttgaaagatcacatcagtctcatttatgtgttcatgcatttggtttaattttactggcatgcatttatatattgattctatagaacatgccaggcacagggctagctgatagggtataaaggcaaagaataaagggtctccgactgctactaatttacattctactagaagctagtagcttaaattctactaaaagacagaatgcctctaaattctactagtttttaggatagatatataagagaccacttcagtgtaatgtactggtaagggaactgttaaagaatggtaaaggcagttagcccaacttgggaattcagagaaccttccaggaggagctgacattttgcaggttgacgttttgcattgttggctaggagaggacaggtgggaagtacacagtaggcaggtgtgaaatacttatggggagcgaaaaagcagctcagtatttctagggatgaaaatgtagctgggcgcagtggcttatacctgtaatttcatcactttgggaggccaaggcagaaggatcgcttgagcccaggagttcgagaccagtctgggcagcatagttagaccccatctctaaaaaacagatttaaaaattagtcagatgtgatggcatgtgcttgcagtccagctactccagaggcttgagatgggaggatcagtggagcctgggaggtggaggctgcagtgagacttgattgcaccactgcactccagcctgggtaacaaagtgagatcctgtctcaaaaaaaaagtgtgagcaaggactgacagtgtcaggtgatggagacttggtatcatgtccgggcattgagctctgccttgtgggttatctgagctgggagtagggaccagacagatgggttaacattagtgaacaccctgaaaatggaagggccatttggaatgattgggactgtccactttagcagaaaatgcaactgctggatcaccactgtctcaggcattgccgtaggcagagtgatttgattgcattggcttcagttgacaaaatgtatgaccttaatactacacagttaaatgtggcagagcttgcacctgttgttgaaaaagtcacatggacaggcaggagattgtgatcccgtaatgggaggcttgaatttctcacttttgagatgggcaagattgaagttgtgtggtcaagcgtgctctgcaggagagaaaggttgggattccgggacagcaaagaggtgggaaagtgagaaggatgtggccacggtgggtaactgggctctgtgagggcagggagtgggcatagctcatgcttatgggctcattttctttgatgacatgcagggagagtttctcttttgatagtcaaaggtcaagctgtttagtatatgactggtggagaaaattttaggaatgcaatgtattagggaaatgaaacatttagcaaaatagagaccagaagaggttagacataggaatttgtaatcacattcacctataggcttctgtttttttcccacagtaatacgcttcattgattaattcattatttcatttatttcacaaaatatattgagtaccatctatttggaagggatttcactattactttagttgatttaacagtgcattagacagtttgttctcaaatactgttgatactgttggaatgagacatgcatagaattggttgtcatatgtcccataaacttgaacttgaaaaatactgtggaaattgaaagttgaaaaataatatgtgatcatagaaggcttaatgaaatcggagaggcttgttatctaggcttttaaggagctttgtaaatgatttgggtgtgggggctgtattagtcagggttctctggaggaacaggactaataggatagatgtctatatgaaagggagtttattaggagaattgactcacacaatcacaaggtgaagtcccacaatgggctgtctgcaagctgaggagccagaaagccagtccgagttccaaaacctcaaaagtagggaagctgatgatagtgcagcctttggtctgtggtcgaaggtccgagagcccctggcaaatcactggtgtaagcccaggaatccaaaacctgaagaacttggagtctgatattcaaggacaggaagcatccagcatgggagaaagatgtaggctggaagactcagccagtctagtccttccacgttcttctgcctgctttatcctagctacatgggcagctgatgagatggtgcccacccagattgagggtgggtctgcctctcccagcccactgactcaaatgttaatctcttttggcaacaccttcacagacacagccaggaacaatactttacatccttcaatccaatcaagttgacactcaatattaaccatcccagggtcaaatcctagcagagcaaccatcaagagggagcagcagaactttccggagagcagaggatgagctgttgaccaggacattttcgtgggactcagctcaaccaaggtgtgatgttggaaaggtggaccccagtcaggacatggttagcttcgcattccagagtaagatgtattttttagtttttcattcttgcagacaatattaagtatgagttcaattaagtgacaagaaaaatgttagtagaagttgctgtgacacttccccccgatgctgaaggatttaatattatggagtaaggtccaagttggtgtgctcaccccaccccaaaaaatcaaaatttagtaaattagaacaggactggcctagctgtagcatgtgggcctaatgcaaaccagcccttgattttctaaataaagttttattgaaacccagctgtgctcatttgtggatgtctcattcctggctgcttcttaattacaacagcagagttgagtagttgagaaagccacccaaagagcctgaaatatttactacctggctctttagagaaaaagtttgccaacccttgacttagattccttagcagttggatgtattgcttgatgagtcattcttaatcatttgacctgtgtcaattaattttaaggatattcttcaattcttgacatgttatttaggaactgatatcaccaggttccttatttttgccttcataatagatgggtaatacgttggtggaacctgaaaaatattgttatatttcccatctgcaattcatgggttttagtctttggcatgaataaatcaaggagagtataaaatgtagcatcttgggtgagaaaacatttcccgtgaattatcatcacacacttcaacggggtttgcctcaattcagagaattagtgttatctcagatgggaagatttgaggagaaaaatgaaaaacaatatttcataaaactctgcccagatcaagcataagaatgactagcatatgctcttgccattaaaagtgatttgacctgctgtgtggtagcattcagaaggacaaaaatagaagcctggtttgcaaacagctgtttctaacaagagtctttgagtaaattgtagaagaatcctcgctacgcttgcctagagagattgagtaactcagccatcatccttctgtgatgagaacatcatcacaacatgccatcaagatgttaaaactgtgaattggacaattactctacaaaaagttaaacttagaccatggctttttctctgctcataaattttcagaaaaaatagttcatactccttcacctgtttttttttttctttcccccatatcccattctccaactttcctaagtttatttctccttcaaaacccaagtcaaaatctattggcacagggcaggtttgcccaggtaaaagacatttctttttattttggttggtgtttaatcagagttatctgtgggcatatcttttggtttgtttgtttgtttgtttgtttgtttgtttaaggcagcgtttcactttgtcacccaggctagggtgcagtggcgtgatcacagctcactatggcctcaacctcccaggcttacccaatcctcctgcctcagcctcccatgtagctgggactagaggcatgcaccaccatgcttggcttttttatttcttattttttgtagactgggtctcactgtgttgcccagcctggtctcaaaccccgacctcaagtgatcctcctacctcagtctcccaaagtgttgggattacaggtgtgagccactgtgcctggcctgtggatatatctgagctgtcttttgagacctttaatttctgtagggcaaggtccctcttcactgtgttctctctgggattctgttggcatacaatcagagttctcagtgggtattatctgagctatcttttgaggctgtgagtttctgtagggcgtaatctccattgtatatctttgtgtcccatttggggatgtgaaaatcagtaaagcctagcatttggcaggacaggttctagaactatacctaataccatcaattactggctgtgtaacctttgccaaagttttcttggctgtgaaatgggttacttgccttgcagagtcatggtgagaatcaagagttaataaagtcacgagtttgaatggtttggggaacatgtgaaactccatcattagtcctgatcatagcaagtcattgcttattaaatgtctgctgaatgaatgaagcatcccgtgtccaccctctgagttcctctaaactctgctcgatgataatgtgagtggtgcccgggagagcagatttcggtgctttttcagcctgacagacacatttggcgcatctcgctttccacacaatatcgcaggaggaaggagactcaaagctacaccatctgacaagcaagggcacttgctcatcaacacatgcctgcaaatgtgtgatcatgcttcctccaacatgtttttccataggcagtgtgtgctcggatgtgtttatcatctgttaaaaaaattttaaaacatttttttgccatgactgttgtaaaaactctccctttatagctttagaaaattgcacaagattatgtttatggatacatttctttaggacctgaatatagactcagaactattaatacaagatgggaatctcgtgatgttccacatagtgggttcagagcttccaacagagcgtttctcgggtgtgacaatttgttaacactagctgcagatgaaaccatgcctggtgctaccattcaggtggtcagtaggtggctagatctaggggctacaggcacagctgcccccatagtccagtgcctgcaatagaggtgctctgtgcatcttacctgagcaggggtaagctacttctttgcacccaagcagaagtattgccaccaggtggccatttgtggcttggagctcctttgggaatctggaatctctggcaggctgtgatatttccagggcctctgcaggagatttgttttattttgctttgttttcaaagtggttatacatcaagccatgttctcataagatgtctcttccatcacctggagttctgggatattagcaaattcctcagaggggaatagatcactggcacttgggttgtaaaatacacagacattggatgtgcctgtggatttttgtgaaactatgtgctttgttttctgttttttaagacatgacgtctctctctgtcacccaggctggagtgcagggacacaatcatagctcactgcagcctcaaactcccagtttcaagcagtcctcccccctgagtagctgggactacaggtgtgtgccaccacacctggctatttttttaattattattaatatttttttgtagagatggcatctcaccatggtgccaagactggtcttgaactcctggtctcaagcatctcacctgcctaggcctctcaaagtgctggaattacagacatgagccactgcacccagccactatctgctgtttaagggccatgtttttcagccactctgtcaagtggctctacagccaggtgcatcccttggcttcccctggtgagcccctagtaaaccatcctcagacattgcctttcaccctaaagatgatgtacagatcaactcctgggagggtacgaaattcgctcggtgcctcagtccttaattctactgttcacatgtatctttctgagtttctacatagggtgtagaaactaaatgtggtttacaaatatggtgtgatcctcttctttcaggacatagacaacttggcaccagtgctcttgctgcaaagataaagtgatattggagaactgtttaaattcacaggctttggagtcagtcagacaaacctggatttctatctgtaactctaccgcttactaaataagtgacagtcagcacataactgaagttctctcagcctcagattgtgcaactattttatatatatatatttttatatgtatatttatatatatattttatatatatgtatatatatttatatatatatttttatatatatatttatatatatttatatatatatttatatattatatatatttatatatatattttatatatattttatatatagttatatatattttttgtattttatataagtattattttatatatatttttattatatatttatatattttttattatatatattttattttatatatatataaaatattaaaatgttatgaatgagtttagattgatggagaattacaaaggtagtacagaggtatatttttcacccagctatctgcaatcttaccatcctacacaactatggtgtatttgtcaaaattaaccttcacatgttaccagctttcccattaatgccctttctctgtttcagaatcaatacacaatgccacgttacatctagaagattaacttttagagggtgctttttcctgatttaatagtttggtttttgttcctgtttatttatgctgttttatttaaaacaagggggcaatatgtgtatatctaaaccattaatgaaatcagcccttttttgttgtatagcgatcacttattttgttgttaaatttaaagtgaagatggtgtgagtttgatcgagtagcaggataagcaggtgaaaattttatgagtttgatggaacagaaggaaaactagacagtaattcacacgttgagattcctcccaaagatctgctttcaactgcttgaatgaactacggcaaagtagttaaacttcccatttgttggctgtgatgtctgtgaagcaggaatcacagtatctgtcagagaattaccttcaagtgatgttgaaaggataaaataaggggaagagttttaactttcttaggaggccatcacagaaactacaaagtatgatgtgaacttccataggaatctcccctaagtgactgtgcatatagaatgtctgaatatctgcaaaggtcagagcctgctgaggagactacagtcttcagctgtaagaaatgagcttttaactattcacaatagcaaagacatggagtcaaccaaaatacccatcaacagtggactagataaagaaaatgtggtacatacacaccatggaatactatgcagccataaaaaagaatgagatcctgtcctttgcagcaacatagatggagctggaggccactatcctaaaagaattaatgcacgaacctaaaaccaaattctgcatgttctcacttataagtgggagctaaacattgagtaaacatggacacaatgaagggaacaacagactctggggcctacttgagagtggagggaaagaggaggagggagaggattgaaaaactaaatatcaggtactatgctgattagctgtgtgatgagataatctgcacaccaaactcccaagccatgcagattacctatataacaaacctgcacatgtacccctgaacctaaaataaataaaagtaaatacataaacaaatacatacatagataaataatgtaacatctgaaaaacacactagagcagagtgcaataaaaggaggcattcctgtaaaggttagaaaaacaaagagaaagagatgagcttttaacaatggaaatttgcttcaggacccctgaaacctctgtttctagtaatttacttcctaaatataagtggcatttatttccagttgactcacacatgatattcctgcaaggaatgagcattttttcattggcttcgttctcacttaactgtctatttaatgcttcacaccaattgtttaaaacagcctcttttttgagtagctgaacttcaactccactccctttgtccccagcctaaattcctgacggctacttcagtgccccttagccctatgctgtctttgtcatgaagggtgaggaagcagtgtttattcccccagcgatgggtcacctgcccagctggagtgacctcagccctggcctgtctgagccctatactggagcacttggtctccatccctcaacgggaggtgttggtcatataggggccacaggaaaactgcccctttgccctctgaaggtttgctaaaaatcagctgacaaaggcaactgagaaaaggcacacaaatttattcacgtgcgtggagccttacaaaatagatctcaaagaaatggctggatggttgatgcttttacaccatcttgaggttacagaaagaatggggccttgcctcctggcaacacaggttaggagaggggagaagaggacgcctggctagcagaggtggtcttgttatgcagatgagacctcctgtgtagcagtccacagagagaagagatggtgaatgtttcttgcagacctttaaaggtatgtgtctctcagttcatctttcctggatcggacaacggaggccttcagagaaagcctggctgcctcaatgcagattctctctctctctctctttttcttttctgagacagatgctcactctgttacacaggctagagtgcactggtgagatcttggctcactgcaacctccacctcccgggttcaagcaattctcgtgcctcatcctcccaagtagctgggattataggcgtgcgccaccacgcctggctaatttttgtatttttagtagagacatgatttcaccatgttggccaggttggtcttcaactgctgacctcaggtgatccacccgtcttggcctcctaaagtgctgggattacaggtgtgagccattatgcccagccagattttctctatagattcaaacctcctctacaaaagacagttttgcagggctgcttctgtttgcagaccctgtgaacatccatctcaaaatatgtcaaagaagagtattttggggtgaaatattttggttccttcagtgaccatcttctgagattatctgctgacattctgatccactctgaactcacccttcctgcctctgccggtaccctttcgatgctgtatttaattatattctaattgcttcataggcaccaagcctgtttcctcaactctcctggttaagagccatcctggtaataaaataataccaacgaagataatagccattttttgtgcctctcttgcaggcactgagcttggcagttgggataatcattccatgtaataatcacgtggaaacatagtgggaatatgagatacagaaagctgaagctattttctcaagtgcaaagggctggtgtatctgtttcctatgtccgttgtaatcattgaccacaaatttagtggctcaaaacaacatgttttttttttttaatttttagattcagtgggtacgtgtgctggtgtgttacatgggtatattgcattatgctgaggtttggggttctaatgatcctgtcatccaagtagtgaacatagtacctgatagtttttcactccttgacctcctccctctttcccccctagtagttcccagtgtctactgttgccaactttatgtttatgagtactgaatgtttagctcccacttataagtaagaacatgcagtgtttgattttctgttcctgcattaattcacttaggataatggcctctagctataccatgttgctacaaaggacaatattttgttcttttttatggctgtgtagtattccatgatgtatatgtgccacattttctttatccaatccctgtcgatgggcacctggattaatttcatgtctgctattgtgaatagtgcagcaatgaacatacaggtaaaggtatctttttggtagaataatttattttcctttgggaataaccatgaattaaatgggtcctcaaggtgttggcagggctatgtttcttgctgaaagctctaggggagaatcttattccttgccttatccaacttctagagcctgcctgcattcctgggcttggggtgcccttctctgcctttaaagtcagcagcatagcatcttccagcctctctctgtgattacacccctccacttctctgactccctctttcccttgaaagaaccctgtctacaaaaagagtcagactctgtaaaacgtttgaagagattcattctgagccaagttgacacagccccgggagatcctaagaatatgtacctaagttgttctggctacagcttgatttatacattttagggagacatacagcattagtcaatatatgtaagatgtacattgttcagtctggaaaggtagcatgagtcaaaatcggggggtggggggtgaggaggcttcaggtcataggtggactcaaagaatttctgattggcagttggttgaaagagttgatttaaagacctgcagtcaatagaagggagtgtctgggttaaaataagggggttgtggaggccaaggttcttatgatgcagatgaaacctccacgtagcaggcttcagagagaacagattgtacgtgtttcttatcagactttaaaagataccagactcttggtcagttctctcccggatcagggagaagaccccaaaagagaaggagattgtctacagaatgtagattttctgcacaagagacagctttgtggggctattttgaaatatgtcaaataaatatattttggggtaaactacttcaatttctatcagggcctgctatctgtcgtgttggtatcttatggctacaaacagtctgttttgtcagtcttaaggtctgtgttttaatgctaatgctggtcagttgtacctgaattccaaaagaaggagggtaaaatgaggcatgtccaatcccctgtttccatcatggactgaactagtgtttcaggttaaacctttagaatgccctttgctgagaggaggtgtctattctgttagtcgaggggcttagaattttatttttggtttacaaccctatgattatattagatccactcagacaatgcagggtaatctcctcatctcaaaatccttagtcacatgtttaaagtcccttttgccatataaggcaaaatacccatttccccaggctccaggctccaggaatttggatgcggacacttgggggcaccattattttgcctgccacagctggtgtaaagtagaaatggaacttgaattccctgactccagagtcattgatttgaatctttggtgactcaaatctttgttgcgttgagtccctctgattacaaagtttttgttcaagatgccatacagtgctgaccatgtcacatatggtggtgactgtatcatatatattccttttttcaatacaacatatactatattgctcatggaatactcatagatggaatctatgtaattagagcagttggttcttctacattgagcacgaaagagtccattgaagtgagcattgaaaggattgaaatctccctgttgcctcttacctcttttttgatcttttaggaggaaaagcaaacaactgggaaggaggtatccgggttccaggcatccttcgttggcccagggtgatacaggctggccagaagattgatgagcccactagcaacatggacatatttcctacagtagccaagctggctggagctcccttgcctgaggacaggtactctgatgccagggtggttggtattgttgagctctgatttcacagcccagtatgctctggtttgcctgcataatggtgtggggaccaaggcctttggccccctggagttttcctgaaaatcacaggtttgaggcaggtcaattaataggataaaaggcatatacatttacttaatgtgtacacagcaggcttccaaaggaagacccaaagatacaggggaaattgttcatttttttgctgtggttcagcaaagtatgggcagtgtgtagaagtaggattggagggaaaggtctgacctcatgctaacggactgagtggggaaacccagccaggcctgtctatctagatgcttcttggcctctctgagcagttttccttccttctgggcatggggcagggccctctctggaacgggggtcttatgacctacagtcaaacaaagtaggtcagaggatttatttatgggcagtttttacacagaaaggcagggggaaagttggagtcatatttttaggtttgatgctggctttggggatcaggggttttggttcttacgacctgcattggggaagagggattctagtttctctggcgccttggggtagagtgggactgagagacaggagggcaggagaaagtcagaggaaaactgcactgaggccactgctgaggccctcggtttggagtgtcacgatgcctccagctgtacttgttatctctgtccggtctggggccttactggtgggtttgccaatgtaaaaacccctctgccaatctctttatccagagggaaataaactcagaggcactgaaggtttttagtgaccaggaatgtggacgggtggtgtttaattcagccttggtctttcggcatcgtgctgacgctcttctcgtctgttcaccccaccgtagcttgccattgtgcagcttggccacaacctctttgacctccaactttgggatcccacaccttttcctttgtccacactcagcagccctttgctgtaacagggagaaatgcagccgggtccccagctaaggccccatttcccagcacgtcttcactgagaagttctaaatgaaatgtctttctcttaaatttaaatacgacttcatatgacattgccagtggtttcttcctaagtgttattaccaatctgaagagttttaagtgaagcacactgattaattgttttcattagtttggtgacagaccaggcgaatgtcacgcaggcggctgcaaatcttgtttaaattcagctgtaatgagaaggaagaggaaaggggaaaggaaagacaaaaacagccacgctgccaaagcaagtccagagatgggtttcctcccctcccgctgtattcgaccttgtttccttactggtttcaactctgctttaggtatacacccttcctcaacacacacacagacacacacaccaatgagaaatgcagcgttgacagttcaactattctcaaactttgaggtctcaaaaccccttttcattcttccatgatcgaggaccccagtgatcttttcctgatgtggattgtattgagcgacgcttattatattagtaataaaaaatgaaattttttaaggcaccaaagtactccaagctcacattccattggctaatacatcgatgatgtcatcatttaccctgtggccacaaggaatgtccattgtacactcctaaaaaggtgatagtgagaaagacaaagagtgccttcctattgttataaaaataacattggcctcgcagacctcctgaaagggtcccagagagtctctggatcacgctttgagactagtgggtgctatggctaagagtggagattctagacctttctagacctgcactggttgaattcatattctttttttttttcttttttttttttgagatgggggtttcactctgtcacccaggctggagtgcagtggcgcgatctcagctcactgcaacctgcgactcccaagctcaagcgatcctcccaccccagcctcccgagtagttgggaccacaagcatgcaccaccacgcccagttaattttttgtatttttggtagtgacagggtttcaccatgttgccaaagctggtcttgaagtcttgagctcaagaaatcctcctgcctcgacctcccaaagtgctgggattacaggcttgagccactgagcccagctgagttcatattcttgtcatcactgcagggtaagcgttgaactttcctgggccttcactccttctctggaaaataagttcaataataacactgactttacaggatcaataggaggattaaaaacctccttgcctgtaatgttcagtacaaagaaggcatgaatgtttgccatttcttgttttgcctatcattttgaggtagtagtcagatgtacattattagtacagttctttcctcttccacatttaatattcatccgaggtcataaaatcatagagtatgaggccaaaaggggaattgtaagatctcctactccagtcaaactattcttttttaacactctagtgatggaaaacatggcagcagtgtctcagaaagtttttcctatataaagccaaaaatcccattctctatttcacctcctccttggctgtagttcttacctttggaataaaggttaatacttcctcaagtagctagaacagagtgttcagccaatctcatttattacgtttgtctctcatcacccataatgttaaaaccatcactgctcttcactttcataatatcttggaatggttttctacccagtgggggaaaagcaaggtaaggaaaaagttcagaggcaaagaggaagattcataaagggaaatcttactgcttctaccttctagccactctagtctgaggctgatggaggccaatctgtgtttcttctatgtgctcaatgaagaagataacagcctccctcttagaagacccaaggattttgtgtgtgggtttgtgtcatcagtagaaccaactctcaatattgaagattcccctctgtttctgattcctttcatggacctcagaggtgcttgctgacctcatttttttttttttttttgagcagagtcttgctcatttgcccaggctagagtgcagtggtgcaatctcggctcactgcaacctctgcctccacctcccaggctcaagcgattctcctgccttagcctcctgagtagctgggactacaggcgtgcaccaccatgcttggctaattttttgcattgttaatagagacggggtttcactatgttggccaggctggtctcaaactcctgacctcagctgatccgcctgcctcagcctctcaaagtgctgggaatacaggtgcgcaccatcacgcccagctaatttttgtatttttagtagagatggggtttcaccatgttggccaggctggtcttgaactcctgacctcaggtgatccacccacctcggcctcccagagtgttgggattacaggcatgagccacgacgcccggccagttgacctggttttaaaccacagatgttgcttctgtgttgaggtcctagctcctggtactagtccagctgtaaaatgcctttgtcatcctagagacagcacaggttagaaaacagaaatgtgcttccaagtgccttatgggaatagaattatcacacagtaccttatttaaagcatattgccaaccaggtacagtaatattcttatgtatttgtccagaagactttgaatatctaaagtagtgttttcccccaggggtcacttatcaatgcctggagacattttttattgtcttggctcagggtgctactaaacatcctgcaacacacagcacagagccctactgcaatgattatcttacccattatgtcagcggtgctgacgtcgagaaatcctaccctgaaatttattattgctcttttatggaaaatgttgttataatggaaaatcccatcaaaacttttcaataaaagcatctagacaataccctcacatctatatccatctataaatgtgatacacagatgtctgccctttagaaaatagtcttaactccttcctgctcagagtggtgcaaataagctttctcagctccctgctagagagatattaaatttgcatttctcaggagaagaaactcattcagacggttggacccaagctgtttgatgagcacttaacaaagtgcctttgcttctttctgcgttttgtttgaagaagataacttctgttcagcagacctccattcttcacgcactgtcctgtaattctcaggaagcattttggatctagtgggagtccttcatggccaatcaaagcatggtgggagatcagaagcccgtggatccaaggtttctacttaagccaaaagaaaggtagtccggaggaacacaggaaagattgttgttgttgttgttgttgttctgtttttgttttgcagcatcttaacactgcagtgagaataattctctaattcaaccctatgatgtgcttacgtgagatttctctctggcagtgaatttttccttcatatgcacgttagtgattcattttcattcagtggcatgacttatcagaagaaatttcagtgtccatcaccctgggcatattcagaaaaattatttccctccaggtctccaaataagctgattttggaaataaatggaggacaaccttttgtgttacaaaaggcagcaacaaggacttacaaaaaagaagaatcgaatatctaaatgtattaattcattaacatgaaaattctttctgtgggtctcatctttgcaagcagatacaatattgccatagtatgagtatgaccatgccccttcctaacaaggtattaacatcagtaatagagaatggcaacaagccatagttggttacaccttttggaaaacatcaacattttaaccatagacccttcagctgggatgcaaggaaacagagtgctggcaacctcaagaatcaaattttagaggtgaaatatttagagcttgtggtccataattaaaacaaaatttgacttcattttttaaagttacaaaaacaaattaatgctttaatgcttaacacacttttgtctaatggagacaaggaatggatttagctgacttctcccagtaacttttgctgacttacagttgagccactagagaagaccttttcaatagagtgatacagatgaaaaagtcagtgagctgtatctgctttacattagttttgcagaactaaaggtgactctcttcatgggaacaatcccaagtttgtgtgtgtaaccacttatactgatcttgctttctgttcaactatggcagagggtttaatgtttacaaatggaaacatatttttctgaattgtgataataactttctgaatacttaagattccctttaatttattacagatatatgtactttctcctaaagatgtttccttaactatgactgtctacattgaaatcattgccatttgtatatcaaataagctgctcaccaacattgtgccccaaataagcttctctgttagtctccaagaccttaccttctgtatcaccccaaaccttttctttctcttatgatccttcagtccttggcctggcaatttggccaggcaaagggcgcgtgggaaggacatcccacgtggagggacgaggatgttgaaagcctcagagctgagagagagcacagcacattcttggaggaatgacgtcaatagggttcagggaaggtttccagaacatgccctttttaattatgtaaaaattgtctgtatggtatttaacttgacctgaaattttgacacaagggtaccttgcaaacaacctgttaatagcgctaccatcattgtcagtcaggaacccaaggagaataatttcaccttccaaattaaaaacactcccaaacactcccttttccaccaagagccatgagggcactagggcagaaaacacattcagttttttttagcattggctgttatgcaaacatgctacaaaaacttgaattagtttgcaagaaaaatcccgttagactgtttccagagaaaacagcaatgctttgagtcactttgaaagtggattggcccatctcccccagaacacgacattctaaaagcatttttgtactagcagcgttaatggaaatgtgctgttctctgggttattgccatagttaactgcgaatcccacaagtggtttaagacaatcccaaatatttcgatagcttagacaccacttaaaagtttagctcaacagggtcactttccatttttcatggcagaaatgaggcttcctttgacagaccatatttctgcagcactgttaaatggtggctttccatagcagcgtgatttatggcctgcctctaggaaggaccacgttaggtgtgggatattaaaaaaaaaaaaaaaaaaaagtctatctccactttggaagaaaaatagaaaaataagtttgcagaataaactttgtgcccctcctttaaaaaaacctcaaatatttcatttttaagtaagaaaaaataattataagacttggagtcttattttgttttagttaaatccccctttcctataatcatgatcaatttcagttatcaaatactgatcttggccaaggccggaggagagcttgaagccagaagttcaaggccagtctgggcaaatcgctccaaaaaaaaaaaatgaaaaatagctgggcatggtggcatgtacctgtagtcccatgtacttgggaggatgaggcaggaggatcgcttgagcccaggaggtcaaggctgcagtgagctatggtcgcgccaccacactccagcctggatgtcagagcaagaccttgtctctaaaaaaaaaaaaaaatcgaaaaatactgatcttaagacagcaattccatctctcatgttcttatatcacaatatcacatgatgaattttgttggcagatggaaaaaaaaaaaaaagccagattcaaaaagtaaaattctagcttgtgtcccagaaaatggggatttcatcttgcttttggggagtcattgaaagacattctccctgcttggggaaggatagaaatcctctgtccctcgtctctccccttcaggtcacttttcaccactgggggcttttcctggtctaattctcatgcctgcccacttcctctcttacttcttccttcctttcagctttatttgggatctcataaaggcctgagtctttcttgaaaggaatttgaaaagaaccacgcacaatgactgccatttcgggatggaaacagtatttcagggcacacgctgtgtctcaatagaactctctctacggtgtttctttttcttcccctcgtggttcacaggaaccttggtttgagaagtgagccaagccagtcttttgttcttatttttacttatgataatagaatattttcagtctgcagacttctgcagagtgcatgattaataacaagggttgagaccggagaagtgctaacaacaaggctataattacattataggtttttagtgacaacaaaataaaccatgggagaaagctcaagggacataggacctcttaagcacacttaccaaaattgtacagccacgccaaacttccagtttctaaacgccttgtaacaagagatggcagggatgtagtgtttttaatcagagaaagaaaatcctcaagttaaacactcaccctttcaaaataattatctgcctctcattttgatggcaatggcctaatggtatcatggcttcaatttctcatgtagctgttaatttatgtttaatgcaaaacacaattttataccttattcctttcttcaaactataagtaatcttattttgctcatcaccaactgcatatgtcttattttcttggcctagttagatacccagtagtagaggagatatattttcatttgggaataatccgttccctggttatttaatggtatcattattattatatatacattaattcattctaaggagaaatttgcattcattgcagtctacgaatccaagttgcctcatgcaatatagtatctttttattttaatcccaaattgtcaggtgcccatcttttcagcaggcctgtatgtcatgaataaagctttccctttgatcaggcaatagacagaaaattgtgttttggagaagcaagaggaagaataagggtatgaatgccagatcagctggatttcaatcccatcagttcttactcgtcccatgaccttgggcaaattacttaacctttctgtgcctctgttttctcatctgtgcagtggggatgacagtagttccagctcatggtgctctttgcagatgtaatgagataatgcacggacagagctgggatcagtgtgttgcacagggcacccaggtggggtcagtcttctttgtattaattacgactggagctccctcatgctcttattggttcagaaggacatttgagaacacaggactgattcacgtcttgatgcctggctgtttatcccacaggatcattgatggacgtgatctgatgcccctgcttgaaggaaaaagccaacgctccgatcatgagtttctcttccattactgcaacgcctacttaaatgctgtgcgctggcaccctcagaacagtgagtaaacagacctttccacgctcctcatgctccgtgcaacctatgccatgggaatagataaaactaaagggtaaaaaggtggctctgctcaatggaggccaacaggtgcctcaatgtgcgcccatgctttgctttgtcctcttttccctcctcctcctctcttttcgttctggtcacatagttgtccaggtaggaggacatcagaaggccatgtcattcacccacctgaacaccacccacagcttctctatcccagcagagaaagctccctgttctcaacagggcgctgtggccggttgctttattgcatgcacagctgcccagcttcacttcctagcactcctctcacactgaagaaagcagcccctgtgctctgtgcattgctgtgcttacacttgcaggctcttctcctggaaggatgtcttgcctcatccttcttggagggtactcctcaatgccccccaggccctgctgaaatgccacctcctctgcatgtcctcaaaacattcccctcactcttctagcaagccactaaaggctagagaaggaatgaagagcatttaaatgtttatctgacttactttcccagcctaaagatgatggatcgtgactcactgcatctgtattttgtgcgtcatgcatatttgctacatttagatatttaaagcaaagttaaaatgttcttcagttctatctcattttctgaactgggggttcttttaattgtgcaattgaacaggatatcttgtgggttttctaatacttgttttatagtggcatttccaattagcatacaggaacaaatggtttataatcttaggtgtggttgttgatttttatggctgcatagtattccatggtgtatatgtgccacattttcttaatccagtctatcattgttggacaattgggttggttccaagtctttgctagtgtgaatagtgccacaataaacatacttgtgcatgtgtctttatagcagcatggtttatattcctttgggtatatacccagtaatggtatggctggatcaaatggtatttctagttctagatccctgaggaatcgccacactgtcttccacaatggttgaactagtttacactcccaccaacagtgtaaaagtgttcctatttctccacatcctctccagcacctgttgtttcctgactttttaatgattgccattctaactgatgtgagatggtatctcattgtggttttgatttgcatttctctgatggccagtgataatgaacatttttttatgtgtctgttggctgcataaatgtcttcttttgagaagtgtctgttcatgtcctttgcccactttttgatggggttgtttgtttttttcttgtaaatgtgtttgagttctttgtagattctggatattagccctttgtcagatgagtagattgcaaaaattttctcccattctgtaggttgcctgttcactctgatggtagtttcttttgttgtgcagaagctctttagtttaattagatcccatttgtcaattttgtcttttgttgccattgcttttggtgttttagacgtgaagtccctgcccatgcctgtgtcctgaatggtattgcctaggttttcttctagggtttttatggttttaggtctaccatttaagtctttaatccatcttgaattgatttttgtataaggtgtaaggaagggatccagtttcagctttctccatatggctagccagttttcccagcaccatttgttaaatagggaatcctttccccatttcttgtttttgtcagatttgtcaaagatgagatagttatagttgtgtggtcttatttctgaggactctgttctgttccattggtctatgtctctgttttggtaccagtaccatgctgttttggttactgtagccttgtagtatagtttgaagtcaggtagcgtgaaacttagaattacagtaatattcctatcactaagatacctggcagtcaatggtaagtggtgagcaatttacacaattattgtatgttctagaggtacctgttgaggctggactttcagttccttctttggaggtaaaatgaaattccccttttctctaaggggctttggagctctgcttctagaacctaggactgccccccccacccgccccaaaggaggggtgtgtaataacctcctaggtgctaacttcttcttaaacttagggtgattccattccattttccaacaaatctttgtctcttccccactcacctagccaatttacccaagacttatcatttaaagaaaagcctctcttttatttttacaacttttccataaaattacaacctttctattagccacagaaatcacaccaggtttatgcttcagagtttctcctttaagtctggcagttttctcatgatatgttctagaagacaaaaaaacaacagaaacatgggcttgcgattttacttctggaagcattttattcacatatctcatccatgtggccacaattcctagtttccataagaatactccttcttttttagatcagtttatagcatcaacttctgagctttgtaataaatgagagctcaaggactcttaatttcttttcatatggagccggcaagaaatgtgaagaacaaagtttctgtgactactgcatgttcgaataagtctgtatcatgtcctgaaccttgcaaaattgtattttaatagagccaaatccccagttagagaagcgggaaggaacatattggatcagaggctggaggaacacattatgtggaggagtaaagagaaaggggacaggaagagacagaaaataggagtgagaaaaacaagacccagtttctgataggcaactggccccgggataaaatttgcttcttagactctgaatgcaattccttcaactcttctgccttgaactggtaacaaaaaaaggagaaatcacagtatctgaaggctagaatcatttatcgagataaaggacctcaggaaaacaagacgtttatgaatcatttatgatttatttttcagatgctatctgaaactcagcaaccatatttgctgtcttggcttttgtgtatggcttcatgtttagtcattttgtattttatgtgttcatttttcctagaaatatgtattgagcacctactgtgtggaacatatcgtcttagcgctggcatctgtcagtgagcaaaacagacaaagttccctgctgaagagtagcttacattttagagcatgaggcactgctagctgtacaatgtgctgggaatacagggatgcgtaaggaaaacgtgactctcatccatatggagctttctgtcacctggggaagacagatcttaaactagtaatagttgagtgtgactgcataggtcatctcagatagactttggtaggagcttgccaataatcactagactgtggaacatattccatgaatcttagggataagagggttgtcgcctgacctcagaatactttattagaaaatagaaaaaaagaaatgtagtattagggtttagtagcaggcagtggtatgctggaatcagctcctgatcgttcagaaatcttgccagcttgttattaaaccattgtctgttttcatttggctgtgttgtgggtgtttacaccacggcaattggcaaacacaacaaatacaggttgcctttctccctcagagccctagattaacaacagtttgttggtatcagtagaactgactgcagatgtttttaagatgcagtttaccatttgtcttgattacttagaggattaaatgttataattccaaactcatgaaatactgattttcaaaaaacttaatgctaggatttcatttccacccttttaaaacatgaatctcttttaaaatttatatataatgtcttcgctataatttagttgtctcagtaaattgaatgacataatttaattatgacctgatatcattattcctattacattttataagaactcatgaaagcatgattataacatggataacttttcttgcactaaaataagaattttgagttaaaatttaacattcaatgggtatgaaaaattttggctttaatgtttgacatatgaattaatgttattaaaaattcaccacaatgacaacttgattttatggatggaattgatcttagagggtaggtggatacttggctccaggatttttaagctgatgactgtagtctgtgagataaatattcacattaatggagagtccccaaaccagctggtcataccaaaatccatgggatagctgtagatatattctagaatgcaatgcaatatagtacatagttaacagcttaaagcgttttgtacagacatatatggaatcttagcatcatgtagacaagaaagtcacatatatttaaaatgtcacactttagtcagaaacgggatctccatgaagctataaaaattacttaggggaacggggcaccaataccattatttccctaggagaaggatgtagacatcctcacattggactagcagagtttcataaatcctggctccatattctattcaagtttgttggaaactttttcccaacaacaaaaaataaataaataaagctttattttaaaaatgacaatactaggaacatttgaatgattctcttctagctattgtgaaatatacaatcaattaatgttaactggtgatggatatcccaatttccctgatttggttatatgagtgtttcaaatgatcacaggtaccctgaaaatacatacattgaatatgcatcaataaaaagtaaataattaaataaaattacagcaaacagccatagggtaatggaattcattccaaaggaatgtgttcctttccggctttctgaaagataccttcatttcaagctcagtaaatggtttaaaatcaaaaccagcttaccgtggtaacataaagaaaagtgctcgcatggctcactgtctagcattttcatttaattaaaaaattaattttgcctctaaaacacacctaataaaagagaagaaattctcataacagccacttatgagttaacagcatcagaaaggcagcacttggctttcatcatcactagtaattttggtgagtacttgtcagatgcccttcctcatctaatcctcagaattaggatctaaagtgtcagaaatgaaatatcgaaggctgaagctgacctaatgtgagatgcagcatttccaaatttaagctcaccaggatctatcctgtgtttcagctgaccttatgaaaggacatattttcatcctactctgtaactgttgtagcaattaagaaaaagcacatatatgtaaaccatttcaaggataacttttaagtcttaggatttattttctctgtgaacacttcaaatgctgcattgccacaagcttttaatagttcaggcatgcagctattatttcactcatgtgcctgtgaagcccagtacaaggtacaacatttgtacttgtaattgtagcaacacaggatgatggtgtcctgggatgaacagaatttgctttggagatctaggaaaaggagtgatttatgaggttagaaaagatttcatagaacttttaattttttattaaatttattttatatcattatcatctagacacatcagtaacagcttaacttcccctaacagtcatttccaacagtggaaaaaaatcaccacataaatagattttgtgttttccaacatagcctattaaacatatattttcttatggaacttcatattaccttatagacagtatcagacaatatttgagataaacgttcacttttcaaccaaagttgtagtatgtctgatctaagattacactaatactgtggaagaaaaattcctggtcattacttttgataatttgctacaatgcaaacttacttccttatagaaacaaagtaaatcaaaattgaattttctttcttgaatacaaaaaaaaaaaaaaaagcgccaaaaaacttggtgtggctgaatgatcaaatgccctcttccatctaagcttggcacccagcttattctgatctttttgccaggggtcacttctgatcttttccccttgcattctccgtcctaccgtttcattgattttctacagtattttacacatctcttttccctgacttcaacacggggtgtctctcagttctcccgaaatgtctgcttatgtctctaaccccccgccagatttgctttcatatgctctcagacctggtgttttctaaatagacattttagttctaaccagggcatgcaatatttagcaattttttgtgtcttccttactttcgtatcttctgtacaaaaatgttttgtaggtggttatagacgtttccgtttgttaatctcatgttcttgaaatttgtcatctctttttgtgatcattatgtatcttttgaagacgtgcttgatgacagtaaacactgatgtttgttgcatatttactgtctgcccgacagtttgtcaagaacattgtatttgatatctcattagaagagattatgattatattagtttcagatttggctgtaacaaaaaacaataaaaaaaaacagtagtttacattagagagaagtttatatctccatctcatgggtgacatccagaggcgaatggtctacaaaatctctggggtgcagaatctttcaagcggcttttccacctcctgtagaatgtgacagcttcatcttcatggtgaatgatggttgtgtctaccctaaacgcatacaatggcgggacggatgggaaagatgagaagaaaaaagtgcatggctactacttcccaaggaagatagtcagactcttctcagaggccagaagttggtcacctgttcacacctagcttcacaggaggctgcaaaggagagttttgttatgggtgttcatgtacccagaggaacactcaatgactgtgggaggctggcggatcagctagctatctctcctcccagtgttattttttcccaattatagatggggagacagagaggtagaaggtcgcattactggcatacagttgcaaagttgatggccaagttgggatttgcaaccaacaccatttgcttttgagtctgtctcccattaatcgaaatgtcttcccctaagacaatatgttcttttactcacaattataaatcatgattcctccacctaaccgtgtatctggacatctctgtgcccccatgcactgagtccacgattcatccacatcctcttattccccaaatgtggacatccttggcatcatcaggtctcatactccttccactggctccatgcctggtcctcgtcctctcagctgccctcctccctctccatgaatgttctttcctgggggccaaatgacttatgccccctgcacaattcctgatgactgcccatttttgacaccaagcaatcccaaagcaaatgtacttccaagctctctgccttcctcactccgttatctgccatgatcagacagtaatctccagtgcctcacagtagtctgttggtccttcaggctggagatggtgcagagccattgtgtgatttcaggcaggatgctccgggtaggtcccgaggggactgtggagtgtatttggcttcttgtctgctcaccctggatttcataatgacagctggttcctcccctctctttccatcccttcctcctaataaccatcatctctttttttttttaaatttatccaacaatttttttttttgagatggagttttgctcttgttgcccaggctgacatgcaatggcacgatctcggctcactgcaaactccacctccaggttcaagcgattctcctgtgccagcctcccgagtagctgggattacgggcgcccaccaccacgcccagctagtttttatatttttagtagagacggggtttcaccatgttggccaggctggtcttgaactcctgacctcaggtgatccaccccgcctcggcctcccaaagtgctgggattacaggtgagggccactgtgcctggccccaacaatttttattgggcctctattctatctaagatactaggcactacacatttaggagatgtgggagatatagtccctgccttcagagaggaaataatccagccagagaattggagacctcaagtgttgactgagtgatgaaaagtggtgagaggaacagaggaagactggtgacttccagctgggaattcagatgggtgcatggaggagaacacagcagggctttgaaggacagctagaatatcaatatggaggcaaggaagggaaagtgagggaagagtctcatatacatcctacacccactttgttccaggttatatatttctgtcccttaatatgcaaaacccaaggcttggtaaaagggagtattttgtcctcaaatactcaggcatcagttgggaaagcttgtgttgctctcaaattggctggctgtgaaacagatgcacccagccaccagagctgcttcctcatccttctcactgttgttgtatcgtgagctctggtactgccagctgcaggaagcaggcagaacttatctactgtcatcgattatatatcagccaagggctgaatagttagggggtttgtgctatggtaaacagatggcagtgaacctcaggggtcagaaacagagcttggggccaagatgcttttggtgagtgtgcatgtattaagttagaagacacatgatctatggaggctcaggtatggacacactgtaaaatctttgggtgtaagaaaagatttgaggcattagtgtggggtatctggatgagactagggtaatgtatggaacaattttttaggtggatcgcaggagtaggagggcaccatgagatgggttttcagacatcagttcagtggatgacattaacttttctgtaaacttactgagggggcaggcctagggttctttgtgtgggggttcctcacaatggaaaaatggaacagtatgtgaaatggttcttgaagaacttcaagatggcaacagaggtacatgctgccaagactgaaaacccaaaatatctgtgtataccttctatgatatatacatgcagtcttccaagcacccaaaataaatctcgccaaaactaccagttgaacatcattcatcaagggaagtttaaatctgagtgatacattaagagccactgtgttgaaaccatgtagatttattaatagttttccatatactttaagaatccttagcagaaaaaaaaatgtcttacgacatgtattacagtagcaacagattgaagggcagatggaaactgaattgtttcttgcgtaaattggctgcagctttctgttcacagctaactcatgtatagtctctactatagacccagcctccttctgacagcatcacatataggaaccaatttttaatcctcaaagcaatgctaccagggaagaactattattatgaacatttaacagaggagcagactgggacacagagaggtgagagcagctatgcccagcatcacgtatgtaagaaactgcagagctcggggttgaacctaaactattgatgctcagagctatgcccttaatcaagtcagtggcaggaaaaaccttggccgaagcacctgccctctagctagtgcgttctctctctctcttccccgcctaccgccagcaccccccgcccctcccgggactcctctgtctatgcaagtctcacatagcatcaggctaagaaaggcaaatgctcttttctaaagacattgctatcatcctagaacaagagagtcttcgggcccctggcaccaccccttctccatcatatttgtcctggaagagcacagcaactctacctgtctctgctttttctatactgcctatggatctttggtgcctttcctgtcctttagagctgttcattcattcatgcagtttatcaccacgccttgggacttgtgaggattgtctgtctcagtccagcttctggctcattttatcaaaaataaagtttgtcttattttatagcttagctctcagagggttcatgtgtagggagtggcgaatttgtgctatgataactattagccctgacatttcaggggctcagcccagcaaacatttattctcactcttgctgtagaacagagcttgtcaacctgggtactagtactattgacatctggggccagatcattctctgtgctggaggctgccctgtggattctagactgtggagcagcatccgtggcctctccctaccaggtatcagtagcaagtctgccccactgcagctatgaccacaaaatgtgtcttccgacacggccagaggttcaggagataactgtgttcagtgcctgtcatggtgggaaggtgggggtctaggaggagaaggttctgccatccatttgtcagggaccaccctgacagaggccccatcatctcgagtgtcaccagcagaagagacagctcctctgtgctgtggctgggaaaagacataccacatactgctcacgtttggccagaatgggccatgcggcctttctgacttcaaggaagctggaaggtgttctggagcgcttgaattactcagggtttattatccccaaaaaggaggtgtagtcttgtttttgtggcctcagagttccaggttgggggcaccttgctttagccgctgtgggttagaagcaggggccgtaagggcacactcacgttgtgtgatgcctctgagtgtctatcatgcgcgcagtgtctttacttgtgccgaacaggctttccagacctggttttgttttgtctcacgtgatggctctgagacttctgcaagacagcagtttaaacattcagagaggcctggaaatgagtgtcctggggtctggactgtgccgagctgtgttatggactgttgtgactgctctaagtagagaattcagaatgcaagatgtgagaggcttgcgtcactatgagaagccagaagcacttggggcccttgggataaagacagaatgaggccttcgaggacgttgttaaaatttgtaggcgatgtagcatgaccctgttcccggaccaaaccgagggtaggactgctatttctcgcagcccaacaaaaagatgcagatgaactggggagaaagagagtttttatttctgtaaccggttacagggagaaggcctggaaaatattgcccagaccaactcaaaattgcagttttccggagcttatatatcttctaagctattagtctatgtgtaagtgtgcattcatctaaagatataagtgatgaacttcttttaatctataaccaagatctgagtcctgaagaccttcctctggagccccagtaaattggcttaatctaaatgggtccaggtgctggggtgattacccttatcttgtctcctgctaaatcatggaggtttggggagttccttcagatctccagtaaacttgtttgtggaggtctggggagtttcttcagacccccagtaaaacttgtttaatcctaaacgagtcctgttaagaatccttcgttatcatgtcatgcttcaaggcccaggagaggcctgggcaaaactcctgatgggcttttgttccattccagcctttgtatgaggacactggctctttcagcttttaatagtaacttcaccactcggtcagtgccgaaacagatgtcatggaggcctgcgttagtgagacctggcctgccacaacccgactccaagacgttaagagggagcttgtgctagatactaatattgattttaaaaaatattttagtacataacgaaagttctggtttgcgccctctctatttttgttcttggggagcacatatgctcattttcggggcttccttgccagggctcccacttcctgtggctgagtcgctgtaatacgaagtaatagaaatcacaacgtctcttctgttccagggtcagaagcccctgtggtccccaggcaatcccagggaacccagatacctctttatttctctttgttcacagcttagtttatttttaataagatagctgttttaggatcctatgtggaggatgttgaatcagtttctggcttaggcatcaactttttctcacttcaattctatttgcctttttgtcaaatgacaataaactttcttctctcatgagttgagtcacattgtttagtggtgattttatataaaaatatgtttcaccagatgggtgatgatttcctaagcattttgttctagcacagtgacataacagtgctatatcatatgtcattgatatctttgaccatcacttgtgacaattcgttttcttaatttgggggaggatttttaaaatctcagtagaattattgtcctcaccactacttagactacttaaacaagtaaaaaaaaaaaaaaaaaaaaaactgtccactttaatttccctgcattctttataccaaatttaatcattccttttccaggtcattggatctcagttataaatgagtctaagttcccagtttggtcaaaatacttatcgttttcagtggtgagggagaaacagtcttttatcagagcagttgatgataatttttaaaatacagtagtgaataaacattttttaaaaatttaacatttttctagtatatgaggatactcaggatgaagtatgttatcaagataattttggaatacaggactaaatatacctatgaaaaatataagatgatgctgggcatggtggctcacacctgtaatcccagtgctttgggaggccaaggcaggaggattgcttgagcccaggagttcgagaccagcctgggcaacatggagacaccccatttctacaaaaaaatttaaaatatagctgggcctggtggcatacacctgtggtcccagctacttaggaggctgaggcaggaggattgcttgagcccaggagttcaagactatagtgagctatgatcataccactgcactccagcctgagtgataatgcaagaccctgtctctagaaaatacaaatcgaaaatataaattaaacaaaagaagatgactctgccaggtgccttctgttttatctagtgactgagctgtgctatttatctttgaaatgacacctttggagatgtcagttgctgggttcctggtgaataatagaacaagcttccaaagtcggggttgttaccttgtgagccactgtacaataaaaagtgcagttctagttctctcttttcagtaaatctaaagtggtccagagaaacagcacagagactaagcaatctacctttttatgaaaagtttttaaaaatccaaatgaaaggataaaaaggcaagcaaccccagagcatgctaaataattctttagaataattaattcttagttctacacttgtctgaactacccagcaacaccactgccattcccaggccggggtgcctgcatctcttgactgggcctgatgtcaatctgatcttccagctcacacctgaggaggattgtgctctagtagtaatgacaggatcatttgagtggctttcaaaagcaagtggaaaatacaggctctttacatgaatttattccaggagcctgtattctcctggggttttaaacacaaagaggcttgactcgaatgtcaagttcaaaacgccctctagatttgcatcattgggagcatgagcaagagaggcttcctggctcgcttctctgtgtacccactttctctctcggctgaccctgatgaaggattctaagtggctgcaaatggcaggctctgtcagcctgtctccaaaaaggcttctgaaggaaatttctcataccctggaagaaagtgtgggatgagacgagtggatgggaagcatcttaaggttacttgctgcctttttaaaccctgctggagatggtaaccaagtcctggaattcttcctgcagcctggcgtgtctgtgtgtcagcttgaccttatctttctgaagcaggtgcactgagcccatgtaaagtgcacagatgtcatgtcctgctctcgcagaatcagctatgccacagactgcagtcgtctcattatgaatcttctttaatatattaatctaaacgtattcacctcgctttccctgtctttctcagctttaaaaaaaacccacatacacaaagaggctgacttttaccatcactaaccttgtccaaggttaggggcgatttggggacaacacatgccctagtgactgttggtttaaaccgattgcattaatcagttttgcattttgatcagttgatcatgaaatgcctataattacaaaagtcacacatgccattatatgcacaaatgatcgggatgacttacacaggggtggagggcttcctaggaggaatgcctctttggttttatgtaaaagctgtaagggcattcacgttctgcacctgattctagtcggttcatgcattttaattctctgtttttatctgctacattttgcctacccatgaaacatgtttaggcctctcttagaaggtgtttgagagcagtcagctcctcagaaaatgataacattgtccgataagtaggaaatgaatcaattatttcataattattcatttgtttgtgaattagtttttcctagcaatttcaatattttggagtttattgaaatacagaacttacattttaaaaactaaccatcctattctggtgttgatgaattcccctaatttggaattcctagcagcttttaaaggtatacgttgcatgccattatattctaatttaaagatttttagaaaatgtatagagttgagcagtctactttcagaacatctccttcatcgccaaaagatcatttccattccccatttgtaatccctcctcaccatcacttctagcctcatttaattcttttttatttttgtttatttttgtgggtttgttttttgttttgttttgtttttttgagacggggtcttgctctgccacccaggctggagtgcagtggcatgatcatagctcactgcggtttcaactgcctaggttcacacaatcctcctgccttagcctctggagtagctgggactacagacacgtgccaccacacccagcttttttttttttttttttttaatttcttatagagatgggctttaactgtgttgcccaggctggtctcaaacccctacctaggctcaaggctcaagtgattcttccacctcggcctcccaaagtgctgatattacaagcatgagccgctgcactcggccctcatttaattcctttttttttttttttttttttttttttttttttttttgagacagagtctcattctgtcgcccaggctggagtgcagtggcacaatctcagctcactgcaaccaccacctcccaggttcaagtgattcttttgcctcagcttcctgagtagctgggattacagggacctgccacaacacctggctaatttttgtattttttagcagagacggggtttcgccatgttggccaggctggtctcgaactcctgacctcaagtggtctatctgtctcggcctcccaaagttcatttaattcttgattcgacattttttggactttctggaaactgagaaaataaactgttaactatggtcctaccaagtttgacgctgttcctgctggctgtgtgtgtgggcgtctatgtgtggcttcataatctttcctgtacatattaacattgtgtctgcagccttatgatatcttcaccttcttaaagcacatggcagcataatttccgcatcactttttcatttgtggtacatacaaggatgcttcatacctaatgccgtttccatccttttaaaccacaggcacatccatctggaaggcctttttcttcacccccaacttcaaccccgtgggttccaacggatgctttgccacacacgtgtgcttctgtttcgggagttatgtcacccatcacgacccacctttactctttgatatttccaaagatcccagagagagaaacccactaactccagcatccgagccccggttttatgaaatcctcaaagtcatgcaggaagctgcggacagacacacccagaccctgccagaggtgcccgatcagttttcatggaacaactttctttggaagccctggcttcagctgtgctgtccttccaccggcctgtcttgccagtgtgatagagaaaaacaggataagagactgagccgctagcagcgcctggggaccagacagacgcatgtggcaaagctcaccatcttcactacaaacacgcctgagagtggcactggggaaacataactccatctacaccttggatttggactgattctccattttatcacctgaaggcttgggccagagctcaacagctactcaactggaggggtgagggggataaggtctgtagtatacagacaggaagatggtaggtttatgccttctgtggccagagtcttggactcatggaaatagaatgaatagaggggcattcacaaggcacaccagtgcaagcagatgacaaaaaggtgcagaaggcaatcttaaaacagaaaggtgcaggaggtaccttaactcacccctcagcaaatacctatgtcaacagtataagttaccatttactctataatctgcagtgatgcaataaccagcataataaaaaggcaatcacataaaaaagagtttagtcgtctaaacataagtaactttaaggtgaatgaaagatcttctttaggaataatagatgatggtaagttccactttggttattggaaggcaagtcattattactggtattagttaaaacacatatcaaatgcttgctcttcatcatatatatagttatgcatacatacacacacacacatacagtatattctttcctcaaaagggttaagatgtctaaaatagggacctagaagcttaacactatttaagtaaatacagtagaagctcacaaatagatttctttgcacaatgattttttgcaaaattttacagtaataataatcccaaggcaaatctctcctgaactgctttccattccataatttgtagtataattcttggattccactgttttctttggggaatggaagttctgaattaaaagcccactgtggagatgctgtggttcatggaatctcttccagtgtaattcagaatcattggcctagaaagtctctgatatttggaggggaacaaaaatcactcacaagcaatccatgatctatacacataagcataatttcctttagttctagttagtcatcagagaacagtcatgtatgcaagttttgtgactgagaaatttctgtgcttccaatccacaatgagatgcatgattttgttttcatcccatttcccccaagcccctgtaaatcagggaaaatgcgcaactgatcgcctaggagagggcctcgtagtggcacagctggagatagtttcaaagtctaaaccaccagcccatcctgaggaaagcctcctatggaatgtaaagtgcaatcatttcttcagatataagactttccccaacaatgtgattggattcctttatggcaaaatcgagagaagctgccatccacctgcttatgcatttatctcttttgtggacttgtctgaccaccttctatttgcccagagtttgctcaattccaagacagtgcccatgaatgggacacctgtaatgtaacccacacagcggtttgcagagaatgttagccatgacttgggctttctgaaagttggctataatttctctatccctacccacaaccctgggaagttggagcaagaggggcatactattgggctgggaggatttgacagcatttccccagttgccctttaagttcttctatttcaaacgttaattttgcttctctttctaaaaaaaaaaaaaaaaaagaaagagaagaaagaagtgattcctaccccctacctccagagttgttgaaagctgaaaagcatacaagattcttccttttaacttggatttctcgttccagaaattgtgggataatctgtattcttgctttagaaaacattcttagagagggtactagcttactgatgatgtgttaggattgctactgatgctgtcatgtggaaactatttaaaggcactattataaatttatcctataagatgacaatgtttactcaaagtctaacatattcaatgcaagtaagactttctgaaaacacttgatgatgtggaaatgctgcaggattaaataacttgaagagcctttatagattatatgaatgcctatttgtgtctagaaccagttatttaacctgtaaaatgtcaatagcaaatgaaggatgaagtatatctctagatgcaaatacattgagtttaaaagtgcctcaaaataattgagatcacatttcaggacatttggaaatcaggtcgatttgtggtaactgtagtcatcttaaatttcaaaccatttaccatctgaaagttttgatttgaatgtaaaacaggaaattggaattcctttgtccaggagaaacctcacaaaccttctttaaggcatagttttgttgtttgtttgcttgtttgttgcaggctgtaaggcatggctgcttgtttacaaagcatctcattcatattacctgtggagttgcatatccaaaccttagtgagttttgaagctttaagcaaattcttttaaaaaattcttgtatttctagcattactagatattaaaagttaagcaaatagattaatgacgtatacataggcatcatttcacaaggtcagtaatgctgcaggaaaagcaaaattgcaatctacgtatctatggtactaaggaagtcctgtttttcaaaaatggaagcccacttctcagatttttctgaagggcatacaatgaaaagtgaaggggaaacacacacacacaaaaaaacaagtatttggcttgtcacaggaatctgattgcattaagtgaaaggattatttagaatatgttaatgcaaagctaaaataaaattttccttggcaattaaaaatgctgtgcgctaataccctgctttctatcgtgactcaattcaacaatgtggggaatgtttactacatttccaacttgatgtcaagcaatggggaatacaagttccagttctgcaaagattcgtcaactttcttagctcaagagagaggctgagaaatgcagagaagaataagacataaaatagctccgacctccatgatccgagagtgggaaaaggcccgattattacccataaggcacactctctaaggccttttaaggggcctacaaaaatgttttattttataatcagaagaaaaggaaatgaacattggggattgaaaatcatattggtatttgcaccaacatagtcataaaatagtatgttaatatgtttttactttatatatttatatattaaaatatatttaatatgttttgcctttgtggcccatgaaagtcttactgggccctggggaaggtatcctaccctggtgaagcagctgctttgctctacaaatacctggggcagaaatttgatttgaaaagtattattctctcttctctttgtttcaactggattcctttggaaaaccaaactagtatcagaacaaaccccgaaacagtaagaaattggagtgagaagggcatggtattgggactaggatcggctctcattcgatcgagctattctcttaaaatgacaaaaagtgtccataaagaggctgctggagagtgcgtggccatagggagccgacatgcccgggaggaaaggtgttgattacatggatacttctaaaagctaaagccttgttgccttctctttaatgcctagagaatgggatgtgtgatgcaaatgctcaaaacctcttaaatcatagctgtctgacctctacggacctcacatccatctgaggcttcatggacaaagattctccacttggccaaactttagccaagctcctcaaccttctcccaggcccaatctgggcacttccttgtaaaatctagttttggcaagaagtctattaggtcagtttagcaagaacacctaacccccccatatctgttcaacctcagtatctgatcaggctcctcagcctccaccatcccccaggtgatgtctggtcaactggcctgccttcagctagaatcctgttaggtcggtttagatgaatgctccctgatatttcctcttggtaatcttccatccactgcccctgaccctgttccctgtctataaatccccagttttccatggtgtattcagagctgagtccagtctctctcccctactacaagtccccattgctgtggtccccgtacctgtcatgatggtcctaaataaagtcttactgtgctttaataggtagcattgaaaaatttttttctttgacatcattcatgacaacatgaaacctattgggacagcatgactgtgcagggtctttagagctcagctttctgaggccctgagcattcttggttttccgacatcgtgaacctgttctgtgttgcaagatatcactcaagccagtgttgcttaataccatctctttgtgtaatagatctgaataaagtaattgtaatacaccaatattttactttgttgagtattattttaatgggagcctttccaatgaaggaaacatcagctttccttgttagaatgcaagcagcttaaaaactacccatgtctttctggaaaggaaacattgccatgtaactatgtatcagttttctaagaacttcatgggccttccatataggagaccctcaaatctgggggttcatctgagagtggttctactcattaagttcaaatcctctaaaggattttttggtaagtgtatctttttttttttttttttttttttttcacagagtctcactctgtcgcccaggctggagtgcagtggtgcaatcttggctcactgcaaactccaccttctgggttcaagcgattctcccacttcagcctcccaagtcactgggactataggtgtgcaccaccacacctggctaatttttgtattttttagtagaaatggggtttcatcatgttggccaggctggtctcaaactcctgacctcaggtgatccacccaccctggcctcccaaagtgctggaattacaggtgtgagccactgcacctggccatggtaagtttatcttacctggcaaacacatcacatcttcaaagtagcaaattgtataatttcttacatacactttacacaataagcaaacacagtcacttttatattgaggtctgggctataaaatttgcttcactgagtatatgagtatctaaggtttgaaactaaattatacatggggattgtagtgtttttctaaaggtaaaattgttaatgaacatatttttagaaataggtactttgaattgcttgtcaatatttatactaatttaacaatgggtgcaaaaataaatacacaaagtaccatatttacaaagatatgcatattctccagtgcgcagggcccaatggttgctacatttggaatagaaactatctcatggttcaaatatacagattcatctcagtgagtgctgagcaagatgatattttcctgtttcccttatagtaatgttggcaccatatgagccactcgggcctggccataagtttcctgcataatcctctatggtgagagtccccacccccaggccacagaccactaccagtccatggcctgttaggaactgagacacaaagcaggaagtgagcggagggcaagtgagcaaagcttcatctatatttacggcctctctccattactcacgttaccacctgagcaccacctcctgtcagatgagcagccacattagattctcataagagcaagaaccctattgtaaactgcacatgcgagggatctaggttgtgcgctccttatgagaatcttatgcctgatgatctgtctctgtctcctgttacccccagatggaactgtctagttgcaggaaaactagctcagggctctcactgatcctacattatggtgagttgtataattattttattatatattagaatgtaataataataggaataaagtgtacaatgaatgtaatgtatttgaatcatccgaaaccatccgccacccccagtttgtggaaaaattgtcttttagtccctggtgccaaaaagtttgggaactgctgctctatgggtactctgcttgttgtcattgaatacagaaaattgagataagagctcagaggagggcctaagggatgaatggtaatatattagtccgttgtcatgctgctaataaagacatactcaagactgggtaatttataaagaaaagacgtttagttgactcacagttccacagagctggggaggcctcaggaaacttacaatcatgatggaaggggaagcaaaaacgtccttcttcacatggtggcagcaagaagcagtgcagagcaaaggggaggaaaagtcccttataaaaccatcagatctcataagaactcactatcacaagaacagcatggaggtaaccaccccccatgattcagttacctttcactgggtccctcccatgacatgtggtgattatgggaactacaattcaagatgagatttcagtggggacacagccaaaccatatcattctgcctctggcctctcccaaatctcacgtcctcacatttcaaaacacaatcatgctttcccaacagtctaactcattccagcattaactcaaaagtccacgtccaaagtctcatctgagacaaggtgagttccttctgcctatgagcctgtgaaatcaaaagcaagttagttacttcctacatacaatggggatacagacattgggtaaatacacacccattccaaatgggataaattggtcaaaacaaaggggttaccggccccatacaagtccgaaatccaatagggcagtcattaaatcttaaagccccaaaatcatctcctttgactccatgtctcacatccaggttatgctgatgcaagaggtgggctcccatgaccttgggcagctctgcccctgtggctttgcagggtacagcctccctcctggctgctttcatgggctggtgtggagtgtctgcggcttttccaggtgcacagtgcaagctgcaaacattttatgatagttctttggatttcaaaaagatgatagttctttggatttcaaaaagatgctttgatttactggtactgttttaaatagaagtcctgtgcattaattctttaaaggctatcagctgtgtgaaggtggaagtcagataaacttaaagataaaaatatagtggagtctaccatcaattaattgtggcccaggattgattataagtgattctgcaattctagtataaatgagtgaaaatgcagagttgattaatctgagcaacaaacataattattacgactattactaaatattgaggttcttttgaaatattgtattttgtttcactggattctatgaggataatagatttcaaaatatattacacatatggaaagatgatgttgtttttaatggcatttgaaaattttgaattttccaatgaatatgtttttataatatattatttgaattccctataaactttgtcacttttgaaatactttttaaaatagtgcctgtgtagtactctagtagatgcaatattttagttctgttgatcagatcttagtcttagcaaaatatcaaacaatgacataatatttaaagccacgctatttcatcaacctttgaaataataccatgcaactcgtgtttaatatttctaattagttcatgagattcttgcatcttgtgcttttctttcaaagtcaggttgtaaactatgctgttaatgcaaagtgtaggctctgtgttaaaatctgaaggcattctgcagcaaggtttgaaagtacccttgtctagtgcctctcggactgatgtgcatgaaggtgacaagtactataggaaaaggctggggaaagtcagagcttgaaataattcaggaaagggcactggtggcactggtggcattttatcagacaagggaaatgcatcgggtcagtaactactaagagaaagccggatcagacaggccatccattagagcttgtatcagggagagctgttcacattgtcacatcaggggcagagacaaagtgagctctgtagcacatcccattgcactgaagggaagaagagggcagtgtctgggtccacatgcaggtgttacaggcagggatatggatggtggttgatgagtctcatggatcccagacatggttctaagtgcttcagtggattcgtctatttaatcttcactgtacatctgttagatagctgttattattgtcctcttacatatgaggatccaggcacaaaaaaacagtacatacattgctttatgcttagatttatggaatgcttttttggttaataaaaaaagaaatggatagattcatgaccttcatatatgactgtgcatgctgtgtactgcacaactccaggaggcagcattaacataatccgcagtgggaagaacattttctaaatttgtgcagtgcacaacctgtgccaccatatgtagcaatatccattagatagtgatgttgcaaaaatagatggatatgtaagtaatggacacaactgactaccttgatttttctagcaagggacacaggagtacggtttgtaaaacccatggatgaatctatgaactaatgtattgacatgagacattctggagtgaaaagggtaatccaagcgtacagatcattaaaatagagctaaaattcaccaagagttgatgtattgcgttgagggaaaaaacggcacatagttttgtggttatctgttggttcactgttccctgggcatcaccacactgtctgctaaaggttttcagcttactatgctgctcagacaaatggtaggactgcactctggcccttcgtgagccgtgaggagacatgtcacaggctacttcagcgctacagcatctgtcaccagcactttctcaacatcccacacagaggctgctccctccgggtggtctcagagttaagatgacaccaaacagagtccagataacttaggagtaatacacagtgtgaacaagaaagaaagctttgttgctgaagccactgagatttggatatttttcctgcagcctagatacattcatcctgagcaacttatattaccattctgtttctgcaaaggaatgagtattacattttgcaaaatatttcatttcccatttttatccctcagggagtttatagctaaaggatcctgggatattttggaccatggaatatccgaggcttaatcagacttggaaaaataattcagatagttggaggaaaggaaaaatgagaatggctttgggccaggtaaaaacaaaacaaaactaatgttgagactcactgtatcttcagaaatatacacatctactaacttttactgagtgaatcttagggaggtgaatggcacttcatttggtaacatcttatgccacacggaaattgaaggattgtacaacttcagatccctatgtttcaacaactatagcaagccctgcattttaatgtcactttaaatgtgtttaaaatatttaatcctacttaattgtatgttaaattttttgacaatccttttaaaatgaaaataatatctagtaggaacaataatattcgtgtgcatcctacttattagtgctttgaatgcaagtaaatggtcttttgaccctttctcatttaaattgttcgccttttattcatcccagtcatgctgagtgaattctggtgtttaaaaaattatatagtgctattattttccatgacaatgctttaaagggtaacttgtgtgaggaagcatatttaaaattttattgtattatttccatcacaacaaagcaatgttaaaccttttccagggttataatggctccttttgtgtaaagttcattaaattcaacagtgatgacacttagaagagagctaccagccccaaatgagacaaggacttctgtgtcaaaatgggagaagggaatggaaaggcaagagaaagattagtaggagacacgtaggcaaaccttagtcatcccacgtctgtttatgatgcagttatcttaaagataaaatagagggtgagagaaccaacatgctatcagtctcagggtgacaattaccctgtaatagtctatcttcaactatcttagataatgcataagaaagtgcttgatgaatgattccatcctaaccactatttaagctccagggcagagaaaagaaccagaatttcagatccttacccctcactgtcttgtgtgtctaaaatgtgcagagatctaatatcagctcatcacttaccatggcataaaaataaatatttctctgcaaaagttcatctcggcacctctctgctccacagaagttttctaaaaataagagaaatcccttttggagatgcagagatttattctagaaaatgacaatgctcttggattatctttcagtgagatttggcaatgagcagtgtccctaacagctagatgacttgatgccctttctggaatataatggcaatgacaaatctatttttgcttcagcccaggcagctatgttaatgtgcactctgtgagtgctgaagacacttagtactgcccatccattttgaaacctttaataagaagcctggagttagatctgtcctctttccttctgttgtatatcaagagactaacctctgtggctaagcttccaatgtcgcccttttacactataaccacagaagtgtgcatacaatggagggaaaaggattagactttgcaaattcacattgccctatgtcaccaattttgaggattaagtttcaacacaaaataattcagttccataacaaaagtcactctagtgtctgagaagggtagatggtgaagacagaggtggctgaattttaaggcattattgtgattaaatgcaattatcttacataacacattttaattatgccaataagagaggattacccaattacaaaatgttttcagcaggaccatattaacactcatgtgatgtatctttcctcctgtttaactgtagtgtgtaaggataaatacaaattgaaatagtactctaggctatttcctgcttggtcaattaatatttttctgaaccataaaatatggatttgccaatttagggagttaataacattgccctagattttcttttatcttggcagaagaacagagttcttttcagcatggaactcagttctctgattactttgtggtccattttagttgccaataccttagatgttacaaaagcaagacagcttcatcaaatatgctaaagctatttgcaagacagctaaaatatgacatgaaccgctacaggagactctttgcattttgcatttttatattaaatttgataatagtgtagatcatttatttataatttgcatggaattgcattgtgctcatgctgaaaggaaaatgctttcaatctgcccattgaagcctcagtaatttggaatgaaaacttagaataaaataatctaaggcatgttttttgagagagactcacatgaaaatttaaattttaaaacctaaactcatctatgtgctttcaaatagagtacaagatagaaagtgcattgtaattgctgggcatatttttaagaaaaatattttattgtggaaaatttcaaacaaacacaaaagtagaaagaatgtaatattgaatccccacaactttattcccaagcgtcaataattgtcaccattttatctatcttcaaacacaatcatggtcatgatattttaaaattttggattgtcatccatgaacagaaaataaggattttaatgtttcatgatatactgcataaattgctatgacaatgtgtttcttcaaagtatatatattttcataaaggtaaatagtaaaggagttaaatttaataaagacataaactatattggtatcttctgtgtgtcaaaccatctcaaaacttagtggtctaatgctatacccacatatttaactgctggtcttgtgggttgacattttggttcagctgagtggtttttcttagatgactttggctgggcctgcttcaatatctgacattggttgatgaacaactgggctacctggtttatgacggcctcatctggaaaggcaggaacgcctggggcctctctgcatgtggttctctcattctccagcaggctagcccagccagtcctcaaggctataattctagtggttacaagatcagcaagagaggaccagcccagtgtgcagataccttgcaaatctatgcttgtgtctgcttgctctagagcccaaacaagtcacctggctaagcccagctgcaagggtagatataaagagaactcttaaagggagtagctgcaaaggcacattacaaaacaaaacaaaacaaaagaaaaaacaaaaaagaacatgcatacaaaggagggaagattctgtggccagttttacaatctacttcataaagttaaagtcttatcaaaaggagatgaagttgacatagcaaattaggacttccgaaaactctcttctctgtgaaatcaataataaagctagagaaagttgtcagaaataacttttacagaactctggaaattagcgaaagacttattacatcccctgggaacaacggtgggatctcagtaagaagagtgtgctcgttggcatttgagcttaccttgagcttaccctagtgcaagcctgtattctccaactgaatggtggctggaaaaacagcagcccgtgggttctctagcagggagcagagggagcggagtgtggctggagctccaggaaatcttcattcctaatgctggtgtatttatctgtgtttgacctgatatggagttgcctagtacaaagaaatattttctctgagggagtgaagccctgatacgtataatacatggataaatgtggaaaataatgctcagtaaaagagcctgatacaaggaaacacaacatctaggacccatttatatgaaatgtccagaacaggcaaacccatagaaacagaaaggagagatagcctttgccagaagctggagggaggagggataaggagcaacctctcatgggtagagggtttctttttccagggatgataatattctgaaattaggtgttggtgctggttgcacaattttatgatagaaaaaccactgaattgtccaggttaagatgctaagtattatgggatgtgaattgtatctgattttttaaaaaatgaaatccaccatttcaattaaaaaagatacagtaggctgggcatggtggctcatacctgtaatcccaaaactttggggggctgaggcaggcagatggcttgagcccaggagttcgagaccagcctgggcaacatggtgaaaccccatatctactaaaagtacaaaaatgtggcaggcacctctaatcccagctgcttgggagatggaggttgcagtgagctgagattgcaccactgcactccagcctgggtgacagagcaagactacatctcaaaaaaagaaaaaaaaaaaaaaagaaagaaaaattagcctggtgtgcttatgtgtacctgtagttccagctattcaggaggctgaggcaggaggatcacttgagtccaggaggttgaggttgcagtgagctgagattgtgccactgcactccagcctgggcaacaaattaagaccctgtctctaaaaaaattaattaattaattttaaaaagtaaatttcttttgccatcagttattcaaaatggactctctagagtgtcatcattgcaaaattgtccaacttctatgccatctttaggatggattcctggagtgttgatggcactttctttagttcgccttgttggacaaattcccatgtctgtattccagctactcttcctgctttgaatgctcccttctctatgcaccttagttacagtcccaaaattatgaaccacagtttatcttagaggtctcagctccatcgtctcctctgtataaaactcacttccaccttggaacccattagtgctgctgttatatcttttgtaacagatgatttcaactaggtgtgttttaaactgccaactcattcagaaagggaccaatttctattcatgtttgtatccaaagtgcacagcatggtgccagacaccttagcaggaatctttcatcttctctgggcacagtgaaggttatgtccccctcaatctctgtaacatttagtccagaccagcacccactgtcatttttcctcctctgcccaaggttgtaaaggcaacttaaaaacggagttgtcccaaaggagttgaagacttatttccatgcaaaaacctggccacggatttttatagcaaccttattcacaattgtgaattggaagcaatgaagatgtccttcagtaaatgagtggatgagtagatgcgtggtacatccagacaactattattcagcacctaaaagaaatgaattgtcaggctacaagaaggcatggaggaaacttaaatgcatatcactaagtgaaagaagccagtctcaaaaggctcatactgtatgatttcaactatgggacattctggaaaagggaaaactatgagaacagtaaaaaacaaatcagtggttgccagggggaagaaggaggggtgaataggtggagcacagaagatttttagggtagaacacagtgaacctaccctgtgtaacattatataatggtggatccatgtcattatacatttgtccaaacccatagaatgtacaacacccagagtgaaccctaatgtagatggtggtgatgatgatgtgttgatgtaggttcatcagttgtaacaaatgcactgctctggtgaatgaagttgatgatgggggaggctgtgcatgagttggggaagggatatagaggaaatgtctatacctttcacacagttttgctatgaatgtacaattgctctaaaagtagtattaactcttacatacataaaaaataaggttttaactcataataagcatacacaccgagtggtgacacttgaactgtaagctggccacctaggtggactcattcagcttttcctcggttctaagatatagagtgtactcttctatccagaatgtgcattttgtatctgacttgaacctgaaccccaacagaatgccaccccaagtccaatgagcctatttcactttgcccatgtgaacaatactccactatggggcccaccgtttaatgcaatatgaacagtgctccctggacttgtgtactatagccatctgctcctccaaatccttcctttgctcggaatctctggccaactctattctatccagctcatagctgtgtccccacccaaatctcatcttgaattgtaactcccacaattcccacgtgtcctgggagaaacctggtgggaggtaattgaatcacggggacaggtatttcccatgctgttctcatgatagtgaataagtctcatgagatctgatggttttaaaaatgggagtttccctgtacaagctctctctctctttgcttgccaccatccatgtaagatgtaacttgctccttcttgcctttcatcttccaacatgattgtgaggcctttccagccacatggaactgtaagtccaataaacgtcttccttttgtaaattgcccagtctcgggtatgtctttatcagcagcatgaaaacaaactaatacaataaattggtaccagtagagtggggtgctgctaaaaagaaatccaaaaatgtggaagcaactttggaactgggtaacaggcagaggttgcaacagtttagaggggttggaagaagacaggaaaatatgggagagtgtggaactccctagagacttgttgaatgactttgaccaaaatgctgataatgacatagacaatgaaatccaggctgagatggtctcagatggagaagaggaactcgttgggaactggagcaaaggtgactcttgtgatgttttagcaaagagactggtggcatttttcccctgccctggagatttgtggaactttgaatttgagagagatgatttaggatatctggcagaagaaatttctaagcagcaaagcattcaagatgtgacttgggtgctgttaaaggcattccattttataagggaagcagagtgtaaatgttcagaaaatttgcagcctgacaatgtgatagaaaagaaaatcccattttctgaggagaaattcaagccagctgcagaaatttgcataagtaatgaggatccgattgttaatccccaagacaatgggaaaaatatctccagggcatgtcagaggtcttcacggcaacccctcccatcccaggcctgaaggcctaggaggaaatagtggtttcatgggccaagcccagggttcccatgtggtatgcagcctagggacttggtgccctgtgtcccagctgctccagccatggctgaaaaggcctaacctagagctctggccatggcttcagagggtggaagccccaagccttggtagcttccacatggtattgagcctgcgagtgcacagaagtcaagaattgaggtttgggaacatctgcctaaatatcagaagatgtatggaaactcatggatgcccaggcagaagtttgctgtagaagtggtgccctcatggagaacctcttctagggcagtgtggaaggcaaacatggggtcagagcccccacacagagtccctactgaaacactgcctggcggagctatgaaaagagggccactgtcctccagaccccagaatggtagatccactgacagcttgcaccatgcacctggaaaagccgcagacaatgccagcctgtgaaagcagctgggagagaggctgtaccctgcaaagccacaggtgcagagcttcctaagactatgggaacctaccacttgcatcagcatgacctggatgtgaaacacagagtcaaaggagatcattttggagctttaggatttgactgccccactggattttggacttgcatggagcctatagcccctttgttttggtcaatttctcccatttggaatggctgtatttacccaatacctataccccattgtatctagaaagtaactaacttgcttttgattttacaggctcataggtggaagggacttgccttgtctcagtgagactttggactgtggacttttgaggtaatgctgaaatgagtagagactttgggggactgttgggaggtcatgattggattcgaaatgtaaggacatgagatttggaggggccagaggtggaattatatgggttggctgtgtccccacccaaatctcatcttgcattgtaactcccacaattcccatgtgtcatgggaggaaactggtgggagataattgaatcatggaggtgggtttttcccatgctgttttcgtgatagtggataagtctcatgagatctgatgtttttaaaaacgggagtttctctgtgcaaactctctctttttgcctgccaccatccatgtaagatgtgacttgctcctccttgccttctgccatgattgtgaggcctccccagccatgtggaactataagtccattaaacctctttctttccagtctcagggtatgtctttatcagcagcatgaaaacagactaatacaccagcttatcccagctctaactgacagcctcaagtgcacagatttctggccactcttttttgggggctctttctcaacctggctctgaataattaaccttattctcaaactttcaatccaaactttacttgtctcctccagtatggctttatagtttaaacttggctgagaatttgccccactattcatagttaaacttgtccctttgaatggaaattaatcccctgtattcattctcattctcactagctcctgtaactctcttgtccccatttctacatgggcatttatctgaaactctttatgtctcttacctaagatgcaatgacttttgcaaagcaatctagataaaattatttaaaaattgagtagctaacataacctttcaaagaagcatgtatttttggactctctcttatctgaggtgcaaatcactctagacaccattactgagctcagctgccattcagtggagtctgaattgcctgcataaaaatgactaccttacaagaaattattccataagaatcatcatggtctaaatgtatatatccaatacatttgtgtaatttttcattgacctaaaaatctcactttataagtgactgttttgatgtcatcaacatttgtatccacttcttttttataggacgatgtcttatctttctttaggctaccctgaaataaacaaaatagctgatggaatttcctgtgttcgcagattccaggctttccacaggttctagacctcaagtgatacattggtatatttggaaagatagatttttaacaataaaaaaatgaaaatgcagacatagctagttctaggaataaatatactggagccacaaggcaaaatctgatttttttttttttttttgcagatagtacaggcttaaaataactttaacccatctatgaggataatcacaggaatagggccttggcctaattaaaattacatattccaaaagatatataacatagctttcagttatccaagacatcagatacttggtggtttgtcagtgataaataaactttagctttataagtaaagccttaaaaaggacaaaataatttgtgtgtgtttgctcttatgcgtcattcaaattgattggttaattattcccttattgtctgagctgtttggcattttgcaaacagttttcacaaggcttgatgttctgaagaaggtgtaaattttccaaggtgaattagaatgaatgtgagctaacttattgatgctggcatcatgaattaaataactggttgttattgacttactgaaccaccagacatgtgacagaggaactcaactctatatagattcttaaatgaaagaacttgatcattttggtgactcaaaatgcagtcaaatttcttagtcatatgtcatgtgattaatttatgtaagcatttacacacattagtatttagttttaaaagtatttctgaatatatggagttcgatggatgtgtttcagaactaacctttacttgcatgggtttattttcattctgttgtcgtttcttgatttggaggcagttattggtggtctttggtcttaacctctttgatgctagtgctttcttctgttgaatactgtggacaggaggaccacgggcatagaccttcaaaggagtatatcaactctggctgaggtcccgcaggctttggcttgaacatgtccatgtgtcagtcagctatttccacaataatgctacataataaggtagcctctaactcaatgcataaaaatacatatttcttctcatactcatttttttctgggagtcatctattgtggctttactccatgtgttacattcagggccaagcttggaggcagaggacagagcacccagagggcaagaagaaacacaagctccttttcagatttaagcctgtaagtgtcatttctgtctacatttatttggtcagaccatgtgtcagtgaagtatactctcatggagcttgagggagactgtactacttagatttttattgctgtgtaatgaattgccacaaacttagcagtctaaaacaatacccatttattatctcagttccgtaagccagaaatgcagaggagcttaactgggatctctgctccagttcttaccagaatgaaatttatgtatcatctaggacttctggtctcacctggagctgaaggttctctgccaagatcaatgattattggcagaattattttacttctcacactgtccacatgggttcctccatcttaatttttttattttttttgggacaggatctcactctgtcacccaggctggagtccagtggtgtgaccacggctcactgcagccttgtcctccccaggctcaggtgatcctcccacctcagcctcccgagtagctgggactacaggtgttcaccaccacaccaggctgatttttttttcttttgcattttttgtagaaatggggtttctccatgttgcccaggctggtctcaaactcttgggctcaagcaatcctcagcctcccaaagtgctgggattacaagcattagccaccacacccaaccaggttattccatctttaaaacagcaatggaaggtcaagtccttctcacacttcaaatctctctgatagtatcctctgtctttttcttacttctaagagctcatgttattacactgaatccaccaggtaatccaggataatctccaattgagtaggaagcttattaagtgagcttgagtaatcttattcagtcagaagataagttcaactaattcagcttaagttattcaacttaagttattataacttggaagatacattcaactgattagtaaccttaattacatctgcaaaatcccttttgctatgtaacctacttaaaccacaggagcagcaccaggaagtgaaagtcatgatggtgaaaattctgcctaccccagaaacagaggcaaatatttgctgaacaatgtactacctcaccctagccctattctgacctaaaacatcaccatgacctccccagtgttcttgctccatgtgaccaattctcttctgctctttcagggaagtcctaattgggaaatgagatgatttcaactttttaaaacatctaattggttaccagcatgggcaacagagtaagactctgtccctacgaaaatattcaaaagttagccaggttggtggcacgtgtccatggtcctagctactcaggagcctgaggtgggaggatcacttgagcataggagtttgaggcttcagtgacctataatcacaccactgcactgagtgttaggcaacagagcaaaactctgtttctaaaaaataaaataagatatacaaaataaaatatctcattggctaaaatgtagtcacacgaccaagccacagaggaggctgggaaatgtagtctttagcagactagctgcatgcgcaaataaaaaagttctataattgtgaaagaaatgcagaatagatgttggcttaacactgcaggtagtaaaggctgccagtgttaagccaatatctattgtaatggcttatttacattctagtatgtcatcagtcttgcttacattacatcattttattcttatactatatccatgagggagtgacagttttctcaattaacaactgagaaaaacctatgatacttgagggtattagtgtttagtgggtgggtaatgtagggaagaaattctaggcagaaggtggtaggggagatgaggaagacagggtgaaatattattctacagtttagcaattgcagtttctttaatgttcttgtgtctatgtgtgtgtgtctgaatttgtgtgtgtttatgtgtctgtgtatgtgagtatgcctttgtatgtgttaattatgagggctgaaaatgagagctgtggttcaagagactagcattgtaaggttttaagaagggggctaaaatatttctcagaaattaaacattggagctgtttctttgttgcacctctggtgtctacagaacccatatggatcagctgggtgaaaggtgacatacataaaaggcatggtggctcacccctgtaatcccagcacttttggaggccaaggtggaaggatcgcttgagcccaggagtttgagaccagcaacacagcaagaccttgtctctgcaaaaaataaaacaaattatatagctggtcttggtggtgcatacctgtaattccaactacttgggaggctgaggaagaaggatcagttgagcctaggagtttcaggctgcagtaagccatgatggtgccactgcactccagcttgggcaacagagtgagaccctgtctcaaaaaaaaaaaaaaaaaagtaaggtgttttgtaattaaaatgagtcactcaagatatcactgcccagacaagggatacccaaaactattttactcgaagggaaaaaatatgtaacttcatacgatgttccataaaactgcagaaatgcttccttatgtttccccaatttatgctcctgtaattcaaacagggaaagtaatgaatatgtgtggagtttcccttccagaattgaaagcatcctttttgcaaagggatcatgtctcttcctgggtgaataaggatgataggacccttctccagaggggctcatccctgtttctcccctattcctgcctccttcctttgcacagactgtctttgaagtgcctccagcatcatgtcacaaggcaaatgtaagtcgcattaggactataaatgaattggaggagtagcaaatgcaataaactggttgctgtcttgagatatgacatctaaaccaaccaatatatctcagaggaaagacggcttttcctccttcctccttatttactctgaggcactgtataaaatgctctaccatcaaagaaatgatggcagaacagaaagtggaggtgctataaatttcatgcttggcagcttgcactagatgtatttcaaggtaatgactctacctagaacttttctagaatgacccctgtcaaagcccctattcagaagctacattcacttctgaatgaggtgacgagaagcttggaataggattagataatggatacatgtacaggctgctaagatgtttatggcctgtgggatttgctgtgaatgcaggagctgggccagtccaatttcttgccagcagtttgaaattgggaacttcagaaatggagtcagtcacatgtctgggagagtgaaaaccgaaacattgtgattctgcaaagatacggcttcatttctagttccttgggtgctaggttgtttctggtttcctttctctggatttcctgacgtttccatgatgtctcataaaaacgtgcacttcttgcccaacttgggtttcctcaagagagtatctgatttcacaagaaaaacaacaacagtctcactttacacaaaaattagctaatatgcactgactgtttactaggtacccgaccatattctaaaaactttatggatattgactctgttatttatcaaagggcattattaggtattttagctacattttaaaatgtggaaaatgaggctaggaaaggcacattcttcagtgtgactcagatgccacaccctcagcctctatattgtgtgacacatcagagattcacgtggaagagttaagttatatgttttactgaaggaaatgtgaattctgtaccggatgtattttatgtgttagttggtttatttataatataaggttctcagctgtcctgcaacagccattggactgacagtacattaaaatgtaagtggatcccaatccaggatttcagttaattcaattgatgactgctattggatattcctgaagagagggtggatctagagggaaaaaaaagagaaagctgtgcatatgagggaacaataatgatgacaacaattacaacaataatgtaaggaacagtattaagtgaccaaggaaaattgctcaatagactgtaactggaccaggagtaggtctgaatgagttgagtgaaagaagaagagtaaaaggtcagagcagaactcactcctgtgagtaccaggggccaaagcctcactcacattcttaccctcatacttctccaagtcttccttccctgggcaagatctcccccaccctctggtctcacagtgaggcagagaacatagtccttgaagcttgacaaacctacatttaaaactccaagtctgggctggatgcagtggcacatacctgtaatctagcactttgggaggccaaggtgggaggattacttgaggccaggagttcaagcctgcagtgagctaggattgcaccgctgcactacagcctgggtgacaaagcaagaccctgtttctaaaaatatacatgaaaaaagttaaaaattccatggctgccagttttgcgattttttgcgcagtttctcttctgtaatatggacatatggacacttgtcactttggagggtcatactgtaatataatgaatacacacacatatgtaaaagtgtttgcagtatctgtaatgtatgcctaacactcatttttcaacattcattggtcatccacctattcaagtgtcatggaatccttggagtgttgcttcaccagccagaaacctctctggccagtgacgccttctgcctgggtatttcttgcacctgctgggctcatttcacccacttggcctggcaggttgtgcttggcttgcactaccagcccagatctcatactcgccaagtgcaagtcaggtgcggagtggcaaggggtgtgtaggtgagcgagcatggggtccagccactgcatgcagctaggcatgctggctgttgcagtgggtcaggcagctccaggtgccaacacaggtgccagctccatgccaggctgtggctggacaagatgtactgcacacagcttctgctgtgggcactcccatctggacaagggaaacgtggtggtgtcctgaagcttggagatgccaggaactgcagaatcccaaagagggtgtcacagccctggctctgagagcccctgggtctgggctcccaaaagggaagcagctcttctcttcttctcgtcatctgcaccgttgtgagcggaggtgcatgtttcagccctgtttgtgttacagctcttttagtgctgttattcagtgggtctcaagtttttgtctcgtctccaggaagaatgaggtacacagacaactggagggtgagcaaggcagagaggagcttcattgagtggcagaacagttctcaggagacccaaaatgggtagctcctttccacaggcaggtcatctaaatgtctatgcagccctcagtggagaggagacctgcagtgggtagctcccctccacagacaggtcaccccaatgtctgtgcagccctcagtggagaagagacctggagtgggtagcccctatccacaggcaagtcatcctgacatctgtgcagccctcagtggagaggaaacccagaatgggtagctcctatccacaggcaggtcatgccttcatctgcccgaatctggctgagtccggggtttttatgggcttcagaggggaggaagtgcctgctgattggtccgtgggcggccatggccaggccaaggaaaagcaacattagttctcactgtggtctgtggaactgacagcctggcctcaggtcatccctggcttgaaggtaaggcctcaccagtgacccacccctttccacccagaagcctgtctgcctcctgctgtcatcgacctgtcatccatagtgcccatggcacccagactgtttacgccaaggggaacctgcaggcccacacagagctgccctcagccccactccttggcctccctcctgtggtcatcagtgcctaaagcccagagggggctgaggcagcaggaggctggtgtgtcagtgctgcctcaagcacacacacacccaggtgaatcgtgacagcatctgggcttgacctcaactttgctgcaaaatcagactggatactgggagtggggagaggccaggcagttggagaaggcacttctgagcctgtggagggaggggagcttcccagctgatatggtttgcctgtgtcgccacccaaatcttatcttgaatggtaactcccacaattcccacatgtcatgggaggaacactgtgggaagtaattgaattatggggacaggtcttccctgcactgttctcttgatagtgaatgagtctcacaagatctgatggttttaaaaatggaagtttccctgaacaagctctctttgcctgctaccattcatgtaagatgtgacttgctcctccttgccttctgctataattgtgaggcctcctcaaccacgtggaaccataagtccattaaaccctttttcctgtataaattacccagtctcaggtatgtctttatcagcagcatgaaaacggactagtacaccagtccccaagagcacagggatgcccaggtctgcagccatggctgggtggctgcatctgtgcctgtgagggtggggctccacccctctaactcagaagggggtggggctcccgcctgttcccagctcccactggctccatggagtgaacagctctggccacgtctcccccaccacagccggcatcatggcagtggccactccagacaggtctctgttgccatcacaagcatccttagcccatcctcagatggtcttttcatccataatgcatgtcgtattctattccacatggcagctgttcataccgtgttcactgtttttgagtttctagtgctttacaccatccctctctctggactcttacttgattaagaacatggaattcccttggctaacccattttcaggttttctacctgtcaactcaaatattatccatgtcattatgttttattttatttctttgttgttttgtttgtttgtttgtttgtttgtttttgagacaaggtctcactctgtcacccaggctggagtgcaatggtgcagtcatagctcactgcagcctcaacctcctgtgctcaagtaatgctcccacttcagtagcccaagtagccgggactacaggcatgcaccactacacccagctaatttttccgactttcagtagagacaaggtttcactatgttgcccagactggtcttgaacccctgagctcaagtaattctcccaccttggccttccagagtgttaggattacaggtatgagtcactgcccctggccatttatttctgtctcagcagactttttttgcaagtctcacctgttgtgctgggctctcaaactcttgaactcatccactgtcctctctctaggaactttttccatctggaattttcttttgtaacatcagccctttcctctccaccatcccctcccaccctgtgtccgtcttcttaggaagattttctttgaccctccttccctgatacactaatgcttcatcacattcttggttgcattcaagcctttgccacatcataacacagtagtgcatgccattgattttacttctacctatccagctcgcccttcaaccatggaacatcccctctcatacagttgtccatttagagctcttctttccaagtagttgcctactcgagtgacctcttttcacgttcattctaatggaatgctcagtgctatttgacactgctaaccaatgcttctttcttccatgtccccccttttaagaagttttttagatttaggtggtacatatgaagatttgttacatggggttattttgtggtgctggggtttagacttctattgaacccatcacccaaatagtgaacatagtaaccaatagatcattttcagcccttgtcccccttttggggtccccagtgtcagttgttgccatttttatgtccatatgtacccatggtttagctcccactgctaactgagaacaagtgatatttgactttctgtttctgcattaattcacttagaataatgacctccatctgcattcatgttgctgcaaagaatatgattcattcttttttatggctgcatagtattccctgatgtatatgtaccatgttttctttaatcaagccaccactgatggacccttaggttgattccatgactttgctagtgtcaatagtgttgcaataaacatgtgtgcacaggtgtcttttttataaaatgatttgttttcctttgggcagatacccagtagtggatcagtcttccttgttgggtctaagacactatacattccaagttctcttcttatctcattagatcattcattttcctttgatgaattatctgtttccccactatttctccattatcctattcttgctgcctttatattaagtgtagggatttctcctttgacctgtgtctcccctgagtttatacttactcctggttgtaaatattttcataaaaatgacttccagttccttcccctccactagtttccacctttacctagaatttccctcagtattataaattccttgctagacacttaaactcaacacattccaaacaaaatgaatcaacttcccctttccctgagggaggaaaaacagatacagttgtaccctttcttttggttcattgtattaccatctttcaattcatttggccccaaaatgtggaagtcaccttttgtttctttctcaacgtttcattcaatttgtatcgagttatgttgattccactttaggaatatctcttgaacttgtaaacttttattgattccaaatggcagtctcttagttcagggtcttatcatatctgatctatattatttctgactgatcattcttcctgcagcttcctgctcatgctaatctgttctacagacaaatgcaagaactatctttcacgacactcattcttcgaccttatcttttctgtctccattggctcttctctctgtgtttcttaagcgctggctgtatcagataacttgccatttcctctttttgtttgtggccatctatcttggctcatgttagcagatcctgctgtctggtatgacctttcttccttcccctctactgaagtctgtattagttttctgtgggtgccataacaaaataccacaaatgtagcagcttaaaacatcacacctttattatctcacagttatataggtcaggagttgaggtgagcttggcttgtttctctgctggaatctctcagatggctggaatcaaggtggtcagtggcctgacctcttatagggagactctgaggagagcccactttccagcttactcaggtagttggaagattcagctgtcgaactgaggtccccctttcctgattggctgtcagccaggagccattctcagctcctcctggctacctgcgttccttatcatggtgcctcctgcatttccaaaccagcaacagtgcattgagtctttcccatgcttggaatctctctctgacaattccttctaccacgtcttcctctccgactggagaaatttcctcactttttagggtgcatgtgactagattaggttcactgggataattcaggattatgtccatctcttaaactctgtaaacttaaatccatctgcaaatgtaattgttatacaacttcacatatttgtaagttccaggtattagagtgtggacattattgaggtggagagtggggagggcattttgcctaccacaaaagtgcagtaatttctcagaatataaactctatctctgtaaagtgattttcacttagttgcgtccttcggggtattaccctaaccttgtacttgttaatgtcctctgacaattgtgcagtattttattataggaacttatttacaaatatgtctcctattatcaataataaattacatgaactcagaaaacataccctaatcaccttgacattcctatgcagaatctcacagtgccttatgtgtttttgtcaagtaaactgagtatgttccgtaataatttgctgaatgtttattaagcttttgctatgtctgaagcattgttatctttagatgagaagcaatttgaagacatcaggtagagttaaacatgataggtgaactttcgtttgtgttacatcaaggcacactgatgtatatagaggaataaatacccccacatactcaactgtattaattgcatattgacacataacaaaatgccacaaacttaggggattaaaatagcacatatttattactttacagttactatatgttaggaatctaggggtggcttgattggatcttctgtttcaaggtcttccacaaagctacagacaaggtgtaagccagggctggggtcctacctgaaagtttgggtgaggaaggagttgcctctaagctaatgtggttgttggcagatccagttccttctcagctatttggagaagtctcccttagtttgttatcacatggtcagctccagcatagcagattgtatccaccgagtgtgaaagttgagatggcaagaagatctgaaagcaaggcaggagttagatgttgtgtaacctaatgatgaaatagatacaccatcacgtttgtagtattctattagttagaagcaggttactaagcgagccacacagaagggaagggattacacagggtgtgggttatcaggaggcagaaccattggaggccatgtgagcatcagcttgtcatatgcacccatgcagagacacagatacataagcagattaaatcattcagtagatggaaaaacatgtgcattaggaggagagaatgaaagcagctgatcatagagtttgttgggattgtgaccaagaaattagatggaggggctgatattttgaggaaagtgatttaggagatgagagaagatgaatggaatcctttatttataaaagctcctcctcaaggctaaagttagtagtcttgacataaatgatcaagtaatgccccaatggttaacaaccctgtctgcccacttctgaacatataaaagcataacatattcctgtgtgcagaaatgaatacgtttctagaatggtggttcttaaatggtttggtcttaggacttcttttccatcttaaaaattattgaggaccagcttcatccatgtccctataaaggacatgaacacttggacacaggaaggggaacatcacaccccggggactgttgtggggtggggggcggggggagggatagcattaggagatatacctaatgtaaatgacgagttaattggtgcagcacaccaacatggcacatgtgtacatatgtaacaaacctgcacgttgtgcacatgtaccctaaaacttaaagtataataataaaaaaaaattattgaggacctcacagagattttacttaggtgggttatgtctattgatgtttaccaaattagatgttaaaactgagaaatttaacaatgtttatgaatttatttaaaaggcataataatcttatttcaggttaacataaaaacaggtttattaaaaataactatatttcccaaagcaaaaaaaaattgtgagatacagaatattctatgtttttgaaaatcttttcaatgtctgatttcagtaatagaaagctggatccccatatcagccgatgtactcaatatcttgcaatatattgttttaatttgtgtgtatgaagaaaatctgtcctctcgcagagatatagtttgaaaaagataattagataattgtggatattcttctttaatactataccaaaactcaacacggatagtttcttaaaggttcattaaaaagtgtaattggaacccatatcaaaaacctttctgtcctttgtaacgttaaaacccattgttttatcttacatttagcatgcatatttgacccatgcaagattttggaaaaatattggtttactaagttatgcatgacttgcaaatattcatacatttcattatacaagataaaaaaattcacatttattgatagcaccactcatttgattagggaagaatttaagtgttgggaggtcatcaagctcctggcatcagatgtaagatttctatttttttattttttcttgaaatcttgaatcatatcctcaacagcaaatactgtcagttgttttccatgaagtgaaaggctcactttgttcgtgcttcaaaaaatgtctgccaaatagccaagtctgaatttccatagattgactgttagtctttgaaatataagtggtagctactatttcacatcaccactgaaatagtggaacgtgttcttttcctggagacaacatctagcttcattgtatagcaggagagctttctgtgtacttcccatctcatcatgcagaatattaaaaagacatgtattctggaggtggttaagaaaatcaaaattttttatgtgaaactagcatcccttgactgcaaccgcatggtggtgatgaataagtagtagtaccatgtgggatcactgcctcgatcaggtctaacatgccagccgtctttcctgttgcttgtgcaccaccagtgcaattgttagcaaggtaaaaagaagccagtgacatctcagtattatgatgaaaatagatgtgttctccagtatcccttaaaatatctccccaactcccaggggtctgatgtacaacgttgccattcactgcactgcactatagcaagcagcatgttcaagtgaccctccaagaggagattacaaacatcaagatctacttaactcacaactccactgtactccctatcctcagctacaatttagctaaacattgtcttcctctccaatcacttctctagataccagaatgaagcaaaacttctcaacttaggaggaaacttaatactggctacttctatatgagccaaaattagatcctcagagcttcctgttttgttatttgtttttggttttgattggttgacttgaatttattcttttgattgtagtttggtgaatgtctgtctgttcaatgagacccaatacctctttgaggattttgtgcctttcctaattagttatgccaccctttgaaatattcaacactttaaagatctttgttaaataaaaataaagaaatatgtgtcatgtaatcaaacgatggagaaaataaaggtacagtttagtgtataaaccccatagagaatgcagctgtctttgtttctgtaatagcaaaatagcgaattgaaaataaaagcaaattgacacaatctttcaattctgttctactaaaacacaccttgaaaagctcattgaaacatataacagaggcaacattagcaattataaattaaagcagttcgagatagagagagagagaaatagtggttaaaatgaaaagtgattaaataacaacctaactcttaaaagcaagtgttctataattgctcttaatcaatccagtttgcataggggaaatagcttaacgtgtagaggtgattctcagtgctcatggcccagcagcatttccatcttaaagcttgtttggcacaatgtgggttagaaatttgtataaatgctttgattatggacaattttctatcccaggtgttatcactttacatctgcccaagacctgatttcccagattgtaccagcgtggctttccatgatgaagcaccaacttgtatgtcttcacagcctgacagagatgggagagctttaggttctactaacaaggatgtggcaatgataatgggggattccttcactttcctctgagcctcggttcacttttctgtgaactgggaataaaaacatctcaaaattgttgtaaaagttgaaaatcatatatatggaacactttgcacacagcagataataagcataactattgtttttattttattttattttatttattcatttattttgagacagggtctctctttattgcctaggctggagcacagtggtgtgatcacagctcactgcagcctcaacctctcagactcaagcgattctcccacctcagcctgccaagtggctaggaccacaagtgtgcaccaccaggcctggctaattttttaattttttttttttgtagagatggggtcctactgtgttgcccaggctggtctcaaactcctgagctcaagcgatccctctgccttggcctcccaaagtgctgggattacaggcagaagccaccatgcccggccaactgttgttttcataagggctattctgtgttatcacatagccattttcccatttcactgatgtctgagaaaactatttaaaaataatgcaattatcctcataatttacctcctacaaaacacattctccaaggcatttcatttaccactaacaaaccagcttttaccctcactttgtttgctcaccatgtcatggtaaaagatgaataagtagttgtacagtgtgaggtcactgccttgatcaagtctaacatgccagcagtcttgcctgttgcttgtgcaccatcagtgcaattgttagcaaggtaaaaaaggccagtgacatctcagtatgatgataaaaatagatatgttctccagaatcccttgaaacatctccccgactctcaggggtcttaagcctgagcttcaggtttgtgatgatcaccttttcttgataaactctttctggataaaggtgctccatgtctggtttccttgttgatggttcttcatagcctacatgtctggaaccctcagagaaagtgaggtttgctaacatgactatcataattctttcatttgcaacactagcaacagatctcaggttccaggataaatgtgctatgacgtggtgatcctccagagagtctaccttgaatattcactaccaagacctgcttcaaaatcattggcccgttcttgcctttcctttgtgtgcagcattctgagaggagttgaaagagaggaagacaagaatgccttagttactttctgtggctcttgtgcattattaattttcttaacaaaaaaaaaagccatatgcatgtcaagattgattagaatccttaatgacatacttaattttaggagtgccataccatgacttccagcaaacagaagtgactgttgagaaggaatgattcaccacctactagctatactaatagttacacatgaatatcgtgtctaatgatctcagtcaagctgcctcgtaactttatgtctgcgcatccatttacacttgtttttcctaattgaaattaattggaataaatatgtgtcaaatagttaaactcagtaatctaattttaagaaaatgattgcactctttttcctgttaatgagcctggctttttttttcttcttatcaatctgtcctttgataggtcttttcatgacaatggatttttcatatcccaggctctcaagtccctcagaagtgtagtaagtcaggtgagattcaggatctgcctgctaatggggaaatagttggtcagttcagtcacgttgccaaagtagttaaggcagagagaaagcaaatccttcatactaattggcagcatgtagctgttccacgtagtaattatttcatagatgctgaataaatatgtctgaaatgaagagaactgttagaattttttgaccttgtcattctgtactgaaataaacacaaccacggacaactaaatagtctcagaatgttttgagagcttattgcacgtaagtgacttattcataggcaaggctgtattgctgtgtcatcacaaaacctacaattggcaatgaccttggaattagtaggtatgattactacatgtaaggtgcttagagcaatgtcctgtattttctaaggactacatattatgagtatcatttgggataacctctgtggtcatccagaaattctacatgcagagtttggaatgcatcacatgacaggatcggattcttcttctacactgttgtgtgctcatgtaaatcaaaatacttcatagtgcccaaagttccaatggtttattgccaaggagaaacaagttgcgtgtcaaggggaccatcttgaaaccaacatattcttcccacattagcacttatgcagattaatttaaaaatataatctgcatgttggtaattctatctgaatgtcaattattattaatattattactgagtcagtcatgtagatttacacatggtaattaacacttttcacatattatatggatagatgcatggccgatgacatggaaaggctgtagctttcacaaatcttcctagtggcgatggacataccagcataggctgtccctatgtgccaacttcaaaaacccagcttggtctcttgggaaaactggaatctaattggatactttaagtgtttttgcatggagctgtcagcatatacatcttgttgcagctgtgaaccatcaaacatgtgtacaactagacttaaaaaaatgactgctacacatttgtgtaaagttggtagatgcatttacatgaaaatcaactggtgggaaattcatggaaataatccaagcagaatagaaaactagggtaggtttgtcagtcatctgagtaagtgtcatgattctgtgattctctttggctcaggattcagtctgttgaatgaatttacaaaacaaaaaacaaatacccaaaagcaaaaagaaagctcgttgcaatagccacagacttccaggccaaaaaataaacatatgacaaagtatttcacactgcattataggtgcatgaagaaacaatgaacttgcattattgtttgtgttgcttcatattattgtcaaaacctctatttcctctgctgatgggggcaggcagaaaagctcaagcttcaacttgccagtcaggataacagtctcttccgatcttatattttgggtaaatattcagtcaattcagaattcaatcttcatcaggttagagtcctcctccactccatctcaaacgctgcttcccatcctcatcataaaatagtgtctgggttcaggagaagcctttcaatgtttgtgcatgtgagagtgtgacctgtgtagcgaggtgccttttttctctgtctttctctttgccctgctgaagcacctgcagctggcatagctcagggacagttctctgaatgaaagggatccccatcttggcttcgctggtcctgttgctcatagatttcgactcttctttccattggtctcttgttttgggcaccccagtttgcagtcctccaatatggagtaatttcactccccatctgaaagaaaggcatgccaaacactgtctccagctgtcttctagggaggaactactggctctcacatcaagtgagtgtagagtttacgggagagtcagaggggtagctgtttgggagatttccctaaaagtatttctcaggagatgtttctttgcctaggcaagggatgccactaatactctctacttggattcctctgcctagacttcaggagtttctctccttctctttgaggttctcagcttaaagaacttaacccacccttcatgtcaactgcctggcttttcctctccctcttctcatctttagttcatccttccaatatcaaataacttatttcacctttatgtctcttgaggactttctttatatgttaacttctgtgcttctttaattgcttacagcaaaatgccaggattgtacttccaggttttactttggtttatcaagaaaaatgttatggacttagaaagccttttcttttgctgtcaataccttgcgtgcaaaacgagaccatctctgaagattgagacacatccactttgcaaacccaaaatgcagcaatgagatctttattctaggcatgtgtgcctccttctgaaggaatcagctctcctggttcaatgggttcagtgggcagagtttcatgaactagggagaagaaaacatattttggtttactgtttcagatctattgtcagctttatatatgaatatgtgtgtattttttattgaatcaccaatttcccatctactactagttattaaaataagccagttttatatgtttataattaggaaaagtagcagttataaactgtaataccctaaagggtggcatgatttgagagtgtgaataaactctaaagaacagaagttgcaggccgagtgcggttgctcaagcctgtaatcccagcatttgggaggccgaggtggggggatcacttgagctcaggagttcaagaccagcctgggcaacatggtgagacctcatctctacacacacacacacaaaataaataaataaaaattagccaggcatggtggcgcacacctgctgtctcagctactggggatgctgaggcaggagaatagtttgagcccaggagccggagtttgcagtgagccatgatcacaccactgcagtccagtccagcgtgggagacagagcaagactctgtcaaataaataaataaataaataaataaataaataaataaataaatatcagaaattgccaatctcatccttgaagacaatgggcagaatctctttatagcttatggtgtgctcaagtcctcaccccaaattccagtctttatctaggcccttccagccctttgttcttgggatcatgttgttattcagccactccagggtttgtcaacctaggagaggaatgaaatataccccaccaactatcgcccatcaagttctggaaggaaagagaagagcagtgtgggtctgctagctctggagatcctagtttgtttctacattgggcctcattcctcactctgctctgatcctggtgttgccttgatcctcactttgcctcctagttcctgccttcctgctgggctagaatattcccactccagttctctgctcttttagcagggtaggtactaggaaggtaggttatcagtagttgtgggaggaagatagagggtgtaacaccatgcactcatatacacacctccctccagcactaccattgtaccccaagacatgtgtccactgacttacccacattggcttaggaagggctcctgaaccctaaaaatgcttaagagagcaaaagtggcataaaagagactgagctttggaatctttggttcagattcctagttggtcatacactagctgtgtgaccctgggaaaattactccatctgttaaaatttcaccttcctcacctacaaaatctgaataattttcacctgcctacatgacagaattcataggagagtaaatatggcatgacaaagtgcctagggcatggtacactctcagtaaatgctgatttttcctttccttctggaggcttacctgtaacaacctattctcagctgccccatgacccctgacctcagctgcatgtctaggctcaaagtgtcttatacagtacaggtgctgaaatccagaggtttacatgcaaattggactgcataatttctgtgttttttttttcagtgtttatttcaacattagtctccctaatattcatggttttcaaggtcagtggaaaatcatgttgattcgtatgactctggatgattagagtgaagggcttttgacttcatcacttgtagctgcttaatggctgaagaattaacaaaggagaaaatagtgtgaacatgccaaaggaatggtgattagagttgcatgattgaaaagtttgacatgtgtggggaaaaatccatctactgccctgtcctttaatgctgtggcagttttgctcatatgcatgagtaaaatgcaatttctaccagtagaattcacttttgctcagaggggaaaaaatgcatgtgtcatagtaggatctgggagttggaattcaaaaggtataatctaatgagtgggtaaagagaaagacccaaagagaaatgtttgagagtgaatggagaggagaaaggagcaggaggagacagagagagagagatacagagagaaatagcttacagaggtatttttatctggtattgtttactgggaaccaaattgattcaactactgtatacccagccctaaacttttgcctcaacccagtccactgagacataatcactggttagctttgaaacacattttctaatttcatttcttcattgttttgcacacttcaaggcatcctagcttcaaccagaaaccaaagaacatctgcaatcacagccggacacattttgttgcaaaagtcaacattgctgaattccagtcctcttgatattctgagcctctcagatgtcaggggatatcttgtttttcaacatactctattgaaatgttatacacggctcatgaaaaatatgccatttgatagacttcataaatccatctgctataacagccactatgataaaggtcaactgtggagtgtgagggcatttcctaatcctctccattttcattctctttaaccctgtcagtccatgaagttgctactaaagcttgatgctgtagctatgcatgctgcctgtaccttgtttttagattcttatcagcgtaaatgtgcatgggatccttatggctactctgtaaactcctaaatttcccgtccttatctgaggaagtgctaggtactgctaaagtagaaaagtcagagccagaggagatttttaatataaaataaggcccaggagaagagcaatcttagtcatgctagatatttctgaagcataacttcttagtgggagataggaagtaaggaagctacttgcagtctctcagctgggggcctcttctccatggatagcaattcagagatggaaaactatagttctattctgcaactaagaattatttcttatgggaccctgcatttctttttcctactccctatataatcccctccaacttcagataatctcaagcctgttcatcaatttaaaaaaaaaaagtactaaaaaaagagatttctactttatttttggctcactctttaagttatgcacataggaatctacattttctagcctccaaagtgacgtggatggtagggacagtaatggaatgaaaaagtacatctggttgagctaatcaatttcaagcacttgactgtttttgctttttgttttcccatagggggaatccagaagcctttctaaaataatatgagaaggcatgctattgagaaaattcctcaaacatgagtgtgagggtgttgacaaagcctaggaagagagaaattactcgttatgaataggggttctatcttttgctgataaaaaatcaggaggaaagaagaaaagcaagaagttaggggaaagacaatgccataggaggtgaagaatagatcaagacattctttttcctgtattttatatttctcatgtataatttcattgcatttaatccttctattatcttgagcgtacagagagtctgtaacatctattggaattacgcatgtaaagtctgtgttctaatggaagtaaaatttgttttctcagttaaaaatagagacaatttttttccaggccctctcacaagagtctggaataaatcaacatgtttacaaatacaataaatgtgctacaagccaattggggatttgtttgttcacattttcccaatggctttggacaggcggttcaaaaataagcacaattctccatggaatttccactgagtaagagcttgacaaatgaaataaatccaagtgctgataagagaaaacatgtttcttataatggggaaggtgtatatacacatacatatatgtgtatttgtgtgtgtacatatatatttgtgtgtacatatatatattccacaatttttactaaggtagtatattgacattgctttgctgtcattccagagtattgcaaaacgaaatggattccccacatggcatgtagcttacatattgttggtgaaacaaacaggcatgactctaacaaatttttcctctaacctgttcttatgacaataatgacatctaacattccttaagcacttgtgttgagctacgtatttataaattaacacagactatataatcttttcctagtggtagaagcagttttctcatttttcagattaggatattcataggactaattcccttcaaataataaactgttctagagagagggctccaaattaagccaagaagactttatgctgacaacttatttctattagaatactagagaattaattcacttattcattcactaatgcatccacttctttgggcacctagaacagcgtctagcacaagatgttcactcaataaatatttgttgagtgagtgaatgaatgaatgattgaatgagcaactctcatgtataatcagctaggctcagagggctgggaatgaaaagttgacgccaatagggctgatatcctcaagtctgataataaaaatctgccttgcaactaaatggcagcaattagagacagttgttataacatgttaaaagggaattcttggagaaaaatataacttaaggtatgaccagaaaaggttagtggaagagagatttgaccctcagtatggggctcaagaagccaggaatcatgaaagggaaagagaagaatagaagaaaaaaatagttggaaattcacaaagggaagaattgcaaatagaaggccaggccatggcaagaggaaattcactgtattattcaagtgaagaaagtgtcctctcaaaatcttagatgaaaactttggaaattcccattaagccaagtgtggtgggcagaataattcttctacccaccctgaagatgtccatgttttaatacctagaatctttgaatatattcctttacatgaccaaagggactgtaactctgcagatgtgatgaagtcaaggaacttgagatgtaaagaggatgtcgaattattcaggtgggcttaatatagtcacaaggtccctataattgaaagagaaagttttagctctttgaaacccatttcagacttatgactgccagaacagtaagcagtacgtgtgtgttgtttcaagcccatgtttttgataatttgttacagcagcaagaggaaactgatacagtgagctaatctagaggggcacacattgtcttctcaaattctttttttttttcttttcttttctgagtgtcttcacttggcataataaacacccttggtagctcaagagcattaaaagctgtatactgattcacatttcttacctgagaaacttagcagagtggtgtttaaggtatttaaaatgttgaagatagcctcaccctttgaattgaaccttcacttgaccttgtgcctctcattggtacagtgcccaggtaaaatgattcatattgcttttcccaccctaagggcaaaatcatcagctcacatattacaaggaagatccaccacctgtcatcttcattctggggaaatacagatgtgcacattatttttttcacagaagtatggatatcagaaaagcctctcaatgagttttcaaaatatataggaggaaacagtctataacacatcagttctttacattgagtctgttaacctttgccttgccaacctttcccttcctcttttcccagagaaaccgatcagttctttccacagaaacataaaagacattagctcacaagacagcatgtgttttctttttttgtaagctatgtttgaccacagcatgtattttcttatctttctgcaatgtccgtgatgaaaaatgactgtattagatcatcaataattatgacattttctgagttggataaaaacccactatcaaacggataaccttcaaggattcaccagaaaacatggattatatactgcaggttttttcttttactttttttttcctttttaaaagtgatacatacacagttcgcttttggtgggcgggtggggcagtggttgactgtgaaaacatcacaggttctttagatttctatgaaatgaggagatccaactgtgttccaattttaatgtaaagttgtcgggatttctttccccttaacttcaaccctgcatgaacctgcatatacaaaaaggtgtattagagtcgattcttgatttgaaactagggcttctgatagaaaagaaatagtagacacacaatgactgaggttcagccttcttgatcatggggcataaatcaaaccctaaaatccagacagtcttatctttaattcactttacagccctaaagagatgagtgagttttgatctaacagaattcctattttccaagcccacaaaaaaattttgttcaggcctgagtttgaataagtgctaacatttgtattatttcactgtttgtaattgtccacaaagacaattaaggtaggaaacgagtgactgttttaaaaacatcagcaggtagccacatgatgaaatgagttcagctggttttcatttgctcacatgttctatcaatatgatttagagttaaagacttaaagacctcaaacctgaactttctttttttctttttgagacaaggttccactctgtcactcaggctggagtgcagtggcatgatcacagctcacggcggcctcaaattcctgggctcacgcaatcctcccacctcagcctcctaattagctggacgtacaggtgcacagcaccacgcacagctaattttttaaattttttgtagagatggggtttcaccgtgttgcccaggctggtctcgaacttttgggtcaagcagtcctcccacctggcctcccaaagtactgagtttacaggtgtgagctcctgcacctggcctcaaacctgaactttccgagataacagtactaaaaatgtcatgtattctttgattgaataatgacaagagaaggactaattaggacaacatagaataatatcaagtgcaactcagagatccaacatgaaaagaaaggcaataggaagagatgttcttcaaggtgtattaagtgcctataagggccctagattgttagtaggagtttcatggagacagcaaagtagaagtcagaattggggtgagggtatttatgttggataatatcctagtatgagtgctaagaacttatgggcaagaaagtgtccaggaaataaatgtgataaaatattccgttctagaaaagcccagtggaaaataaagtgttgggttgatgtattttactgtagtaggatgaagtttgagctgatctgttagtaagggagagttagaaaggcaaagctgttttgagcaaagcagttcagaggacaagagtcagtagagtttaacaaatcacaatgacattttgtgatgagagaacaacagtggaatatggtttttaatcttgcatccaaccatctttgaatatatgctgtgattggtcttgctttttatttttattatccagtcctatgatgtgcagtctttctgtcaatgttgtagttttcgaatttaagagggaagtatctccatgagaaataagaagtatccgatggatgtgctaacatctcagaggatttttgtttggctgcagaggacaaggctcccagagttggaaaaccagggtgaaaatggagaataaatgtatttagtgctggaggaggcagcgtgtcctctttgggcagggtctgtgagatacagtggtagggtgcctcatgaatgcaccaggcttcgtcttgccagaagctgtgtgtctagcagtagagaggaaactttaacaccctatgttgcttgctctaatactctcaccataggaggagagagacccatctggaggctgcatgcagcggcctctccccttcacttttctactagcaaagttgagcaatggctatgatcatgagctagaaaagagcttagattaatcttcttcatatatatagttctcctgctggtctttcactatgcatcctgaactgccccctacccccaccacactcccagtgatgtgaatgcctacttactattccaagtaacaatacatgttttggttttggactcaggccgtctaaacttccatatgagatctttcctttgctgtccttgcaatgttggaaggttctttaactgttctctaggattctttgttctcatctctgaaacagggcagatggaatgatacctctctcattgacttgttgtgaggatcagaatgagatggttcatgaggaatgatttgcacggtgcctggtggtagtgataggcactacccagtggtggtcatgatgattatgatacatccatgaattctaatactgtgagctccgttgatggtgaggaataatctggcagctccaggagggagtatacattgccatgccattgttctctaatgcaggtgtagaggtctccttatgatccctaatcattctcttgcttctctagagcttccattgaccttcctccttcttcttcttgctttgtgccctgggaggatgaccaatgtgggctatgtcagtggatcccatgtctcctgtggtgtgggcaatgataagccctgttgttataggaacaataggtttatatacccattacacagtaacataccaaaacaccaaagcagcagggtttgcaacaaggaaagagtttaataatcacagggtgctaagtgaagagatgggaggggaccttcaaatccatctccccaaagagatcttggctgaagcttttaaggggattgtggagggcaaggggctagaacattggggtcattgttcagcgtaagggggttgaaatcatcaggatgtggcaactgcattctttgggaagtcaactccttgcagggtcctttagaccagctggcatcagtcatttttttggtatgcaggtcctgaaagaatatcttaaaggaaaacttaacttttcacgatgcttaagttgttatctatagagcagttatggggagctataatctagactcggacaatagatgccaaaccactatgaggaaacaggtcagagagtgagctaacctagagattaatgctgaatatgctgcaagcttgctttatttttgtttctaccccccccccgtttttctttgattatttttgtaaagtttatggggatggtatcactgatgggaaatccaaggaagggtggagaataaagataggtgcctcttcccccagcgtgctccctgtgaggacatctagggctgggatgacctcaacagagaagacacctggtgtcttcttgaggtggctgctagaggcaaactgctttccttccagatgtcaggagcctgaccctcaccaagacttcctgcatggtttatgacctccctacacacatttctacttaataaattaaaacaacacaatccttttacggataatcctaatttgaacatgccctttgtttctctttaggacttttttttcctagtatgccctataggcagacacactttcgaggtgatgaattcctgaacgattcacagaatgtgggtttgtgaatgccagcctttcaggataaaatgtgctacttgaaacagctttgtgcagataagtgtatgatatctgttgcacagtagggtgactatagttaataataaagtgttatatatttcaaaattgctaagagagtaaatgtcagatggtctcaccacaaaaaaataagtatttgaggtgatggataggttaatgcacttgatttaattattccgtattataaacatatatcaaaacatcacattatactccataaatatatacaattataacttatcaaacaaaactttaagaattaaataatttagttaattgaataaaaggctttgtaatatgaaagcaccagtaaatgttgaggtctggccacagaatcattttactgagctgtgttttaaggttacgcatcaggttcatgctctgtaagtatggttttgtttttgtttttgttttttgaatctcactctttcacccaggctggagtgcaatggcgtgatctctgctcactgcagcctccacctcctaggttcaaacaattctcctgtctcagcctcctgagtagctgggattacaggcacccaccaccacgctcggctaattttttgtatttttagtagagacggggtttcaccatgttggccaggctggtcacaaactcctgacctcaagtccacccacctcggcctcccaaagcactgggattacaggtatgagccatcgcacccagccaagtatggttttgaacatgaacatagtcagcaactcctcactctattatttattattttttattttttaagagacatggtctctctctgtcccccactggagtacggtggtgtaatcatggcccactgcagcctccaactcctgggctcaagtgatcctcctacatctgcctcccaagtagctgggaccacaggtatgcaccaccacacctggataattttttctatcttctgtagagatggggtctcactatgttgctcaggctggttttgaactcctggcctgaagaaatcctcctgccttggcctcccaaagtgctgggattacaggtgtcagccaccacatctaacctagcatcactcactttaaatgaacacatatcaaatgcatagtaacagtcttgataccgtatgtatagtaataagtcttttaactataaatgttttttatttgcgtagatggttcacactaaaaatttaccattaattccaatttatgatactaagttgtatgtctggccatataagtatagcaaacatactacttctgtatttaggtttgctatttagttcagaacatttcactttaaaattttacacaaatgaaatagaagaaattattcaatttctcccagcaactgcagggaaatcccagcacattatttccctggttttcaaacaccaccatgaccaccactgtattgctgttcatcatagaggattatcattgattgtggcccttctgctggagataaaagttctcttctgatcatttcataatagcccatgatattagatatcagtttgggtgctggaatgactgcagaaaggtcactcataatagcgtgggggacaagagagtagcagtgctgccttctgggtctgaactgaagctcaattcagggatctcctttgaaatactttgggtttgttctgttggcccatggaagaacctgcaaaaatgtgtctttaccgagaactcaaatatgtagccctagttcattgacaggagactatctctggtgcagtgagtctcccagggcagtttcagaacacaatagttcactctgaatttattcctcccttaatcctctacccatttctggaaatatctgcctttccctcgaagtcaggtatattaaaaaacctagcaatagcactggagaaaacctcttgaaatgcagaaaatagagtgtcaaatgcaatcaggcatcaatagaaccagccatccatccccaaattgatgcatccaagagcactgtacatagtttttgtgtgtatttaataatattttgtccaatagtttttgaggctccaccaatggtgagaaatgccttagagactgcagctttgatattctccagttgtctttaagcataagacagaatataaagataaagcatagactccatattaaaagctcaccttaagttctataagagattttatctgaaggagtaaaatgcagaaaatattagatgaggaagtttctgtgggaatgagaggcttggttagcccttcatgttgtatgtgaaagaattccacctatattcgtgctattgaatggattttcctttccatcaacagacatattgtaaatgtagccttaataatcaaggcactcaaaactgtacgactctccttttcttggttgagaagcctaataaatgctctgaattaatatttagaagaagaggtgggatttacacattttctcgtcattagcatagcaaagataaatgtttccattctttatgaacctatgtatcagcccagttttagctactgaacttgactataagttaaggtctttgaatatgtagcatgccagagtagatattgaagcctctgattccttaggaaagagtgtttgtgaaggagtagtggggatgggtggtgtattattatctcttgttgcgcaacagataaccacaaacttagcggcttaaatcaacacccatttttctcaccatttccatgggtcaggaatctgggtgcaacttacctgggtcatatgctcagaatatctcagggcttcaatcaaggtgtcattaagctgtgctctcatctgaagacttggctggggaagtatctgctttcaagctccattgagttgttggcagaaaccattttctggtggctacaaaattcaaggcaacttgcgccttcaaatccagaaactgagaagagagtcagagagaaagagagaaaggaggagggagagtcaaagagaagattctgctgcttggagattctgacttcagggtagttctaggtccttattttactgtatttatttttcagacaggttctcactctgttgacaaggctggagtgcagtgacacaaccacagctcactgcagccttgacttcctgggctcaagtgatcctcctgcctcagcctcctgagtaactgggactgcaggtgtgcaccaccaaacctggctaatttttgtattttttgtagagatggagtttcgccatgttgcccaggctggtcggaaactcctaggctcaagcaatccacccacctgcctctacctcccaaagtgctgggattaaagatgtgatccaccatgcctggccaggtcttcctttaaaggtacatctaggtcaggtttggtggctcacgcctgtaatcccagcactttgggaggctgaggtgtatcacctaaggtcaggagtttgagaccagcctggccgacatggtgaaaccctgtctctactaaaaatacaaaaattagctgggcgtggtggcacgcacctgtaatcccagcatcttggaagactgaggcaggagaatagcttgaaccctggaggtgggggttgctgtgagccaaaatgcacgcaactgcactccagcctgggcagcaaagtgagactctgtttcaaaaaaaaaaaaaaaaagaaagaaagaaaaagaaagaaaagaaaaaaaggaaaagaaaaaaaaaggtgtacctgattacatcaggcttatccaagataatatcccttttgattatgagaacctcaattatttctgcaaaaccactttacttttgccatgaaacataaccatgggagtaatatcccattctctttgccatattctataggttagaaggtcataggtccttcccacattccaaggagaaaaccacacaaaggcatggatactagagggtgaaaatcctgggggccaccctagaggttcccaccacagacggaaaatcaaccactgctcctgtccactttgagctgaacctggttatccagtcagcagtttacatttgcaatacatttagattcatttcgatgaatactgtcctaagacctttctccatagacacttaggagaatcctccaaaatctccggtgggaaaagaagatgggtagtggatctttccattaatatcacgtgaagttgtgtcctgattaaagataaatccaacgtagatgacaattctagcattttacttctcaccatcattctctctgagcaatgtcaacaaaataacagattctattctaaacagccctggcctgctttgaactgtatgtgaacctttgggacatttactgtccatccaattgcccgatcataaagatttcacttttctagatatttccaatacagcaaccaccagacttaaaaaaacaaagtctggttttcaatccagtgatttagtggcttttagtaacagggcacacaaagccatttcctgtttttggttcttcagcctgtaatctagaatgattaaactgatacttgcttctattctcttcatcttctgagacgtgattttggctgcacttgaaggcattaagtccacaatttttcagagtctcctatttatgcaccagccactgggttagggactttcacatgcaaagagaagcagtttggtgatttctcaaagaacttaaaacagaactttcattcaacccagcaatcctgttactgagtatatatccaaaggaatataaatagttctgtcataaagatacatgcatgcctatgctcatcacagcactattcacagtagcaaagacatgaattcagtgtaaatgcccacgaagagcagattggataaagaaaatgtggtacatatacaccatggaatactatgcagccaataagaagaatgagaccttgtcctttgcaacaacatggatggagctggaggctattttcctaagcaaactaatacaggaacagaaaaccaaatcctgcatgttctcacgtgtaaatgggagctcaacattgagtacacatggacacaaagatggaaacaatagacactggggactacacgatgggggagattgggaggagagtgaggatcgaaaactacttattgggtactatgcctatcagctgggtgatgaaataatctgtacaccaaacccccatgacatgcaatttatgtatatgataaacctgcacatgtacccctgaacctaaaataaaataaaataaattttttaaaaagacatcccttagtgatctttggaaatcattaatttttattcttactttacaggtagggaagtggtggtcacaagtgtcttgactgcctcaaggtcattcagttaataaggtatcttaaacccaggtaggtttgacctaagcaccgtgatctctgatgaacctgtattatcaaactggggttgttaagcccttggaagcctattaattaagccatgaagccagaaagcctcattctggaaactattccacattataacaaattcttccctgttagtttgcactacatcagtggttctcaaccagtggcagtttggccccacctctctaccactggccaggagacatttggaaagtctgaagacatttctggttgtcatacctggggggcagggctgctgctgtccactaatgggtagagaccagagatgctactaaatatcccacaatgcacatcacccctccaaaccccctcagcaaggaattatctggccccaaatgccagcagagccaatgttagtaaaggctgagaaactccacactacattttgacttaataaactgtttctcaaacattatttttagaaaaagcaaaaaaaaaaaaaaaatccctttgctattctgctgtagttctacatatataaatactgcattcagcactgatggccatagcatttaatccagttcatttttatgattcttgtctcctttgccttttcaactctttgtctatgtttttttcctgtgggtaagtgttttgctgctacaaatttgtttattgttgcttgttatttctctgtggtttgctatttattctgcagctctgggatacttattaggggtgctatataaaataaataacaataatgacaatgtttacagtacttatccctaacaattttccgggcatcatgaaagaagacacagagaaacaaatgacaaaggagttagtttgcatttttgcgtttttcctataaataagtacagaccagcttccctctgtcgtgaaatatttatagattactttttcagggtaagtttgcgataagtgcttgaatgtgtttcacccttggatacattcaatttgtcttcattttacagtttattctgttaattagaaaaggttataagattaataactagtcattgctaatgcattcaatggactgaacattgagtgtgatgaggggttttctccccctaaagggacataaatgatcagtttatatggatcccatcaaacctctgatgaagtgcactgcacacaaaatgtgctcaagattacaatggccttttggtgattttcaaaaccatccaaacatcaaaaatgcaattatattctgtgtgcataataaattaactatcatgggaggggctggttgctattaattgagatggagcaaatcatgtgagtgggactctagctgaagatgtgtaacaattacaaatgtattcaaaataccaaaactttatacttgtgtagggttttactattgccaaaggattttcacatagatgcattttgattttcacaatcaggtcttgctttaaaaaaaaaaattttttttttttttttttttgagatggagtttcactcttgttgcccaggctggagtgcaatggcaccatctcagctcactgcaacctccgcctcccaggttcaagcagttctcctgcctcagcctcctgagtagctggggttacaggcatgcaccaccacgcctggctagttttgtatttttagtagagacggggtttctccatgttggccaatctggtcttgaactcccgacctcaggagatcctcccacctcggcctcccaaagtgctgggattacaggtatgagccaccacacccggccttaaaaaaaaaagtctatagcaattaaaaaagtgattcaacctcatgaagtgggtagaaaactggaactaaacccatttctagtgactttgagtccattcctctttatattagaaaccacatctgttttgggggaaaacagaatattaacaaaattatatagcttgggcataccatacaagtcatttagtaaagaaaaaattatttgtggattcagaggtttgacaaaaaaaaaacctctgctgaaatgatgatactctcatccattcagctgagctcctgcctggtctgcagatgcctttgaggacttcaggcagaaatgcagaagaagctgtgggtaattgatgtccagtagcttgaccatagctttaaaagcaccctggggcaagcaagcaatggaaggtacttcaccaagaaaccacagagagcttgctttgtctgtaaccatcttctgagggattttgtctggtcattttttctcctaatacaacctcacatcaacagaaaaggtgcaagactagtaaaacaaaacaaaacaaaacaaaaaactcctgtcctgtgaaaaatttaattagatttaccagtcataacattttgaccaagcttttttgactatctcccctccgcgtgtgtgtgtgtgtgtgtgtgtgtgtgtatttacacactttttttctgaaccatttgggaccaagttgtagacattatgccccattagctgtaaatacttctagtatatttcctaagaactagaccctttctttcctaaccacagtgcaaatatcaaaatcaggacattcaacattcctagaatgtcattatctaatccacaatttacattcaaattttgtcagttgtctccatcatgtcttttaaatcttctccaatcccttctccattccagcacccaaaccttgttcatgcattgtatctagttgccatggcttcttagtcttctttaatgtagacaagcttctccgactccctttctcttttatgactttgacattttgatactttgaattgtagctatgtccctctcagtgtgctgcatcaggagacatgtgatgtcgatttgtccccttactggtgatgtaaaactggatcccttggctaaggcatcatctgacagatttctccagtgtaaaggaatgaattttcattttgtaatgaataagtaatttgtcctaaggtgctttaagatatagctcctgagaaatgtctcattcactatgggaacagaaaatgcacaagatgattttcaacaccttgccattccagaatgtaacaagtacccaaataacgacagggaaataacaaaggacacaggagccggtgtgaaggcactcctatcagccaatcctgcatgagttgagcaccaaaataagtaatgacaggaagggattataactcattgactaaaataagagcccatgagtctaggctgataagcttagatatgtgaataaataaagagggggaaggaaattattttctgaaaatcaagaaaaaaatgtagaaggaatgatggaattaagaaaatcaccattttatgatccataattgtttaaaatagaatgaaaggcaaagggagggagggagagaaaaagagagagagggagggatggagggaggaagggagaggcagacagagacaaagaaggagggagggagaaaaagagagagagaaggagagaggaaaggacagaaagagagagagaaagaaagagagagagagcaagcaacagagcatggcagatgaccccaaaactagaatttctggagaatcctaacctgtgacccaaggcatttcacttcagtgtggtgctaggccatgcagcttctgagatctttccaaatttctaacctcatgtaaaccatggttacctgaaattgtctttctccagcaagaaggaccatccctggcaaaaaacaaaaacagaaaacaaggtagaaaaatggatttatcaagttttacaatgcttgtcatatgaccagaaacacatttttaaaatatatatatatttactaaatctttggttatccagaaatttaagctatctagaatatgccatgctgtgctcatttctagaagaaaaaggtttcactgtcaagttactctgggaagtagagatgataggcgtccagtaagtgaacttgagctctgtcttaaggtctgagaagtctacctttcctgtctctcccacaataccacctcaccatgccctccaaactcagctgttgttataatatgatattagaaatcacaagtttttaagctattttgtccaaagaaaaaacaaaatgaacaaatgaaagtgtttttcataatcctgacacatccagttctttactcaaaatctgtctggtccatgaaaatatatttcccctaccatgaaatgtctcttatactatattaacctattaataaaatttgttgcccccaatgacttctgtttcaaataaaggaaaataaagattcaactagtttaccatcaatatattgtattaaatatcaacaccttactcctctacttatgtagcaaagctaatatggttttgtcaacataatctaagtataaatgtaaaaaatctgcaaccctgctctatcagttcattctcacattgctataaagacatacctgagactggataatttataataaaaagaggtttaactggctcatggttctgcgggctgtacaggcttctgcttctggggaggcctcaggaaacttacaatcatggcagaaggtgaaggggaagcaagcatgtcttgcatggtgggagcaagaggaaaagagagtgaggaaggaggtgccacacactttcaaacaaccagatctcatgagaactctatcacgagacagcattagggggatggtgctaaaccattagaaaccacccccatcatccaatcacctaccactacaatgttggccccacctccaacattggggattacaatttaacatgagatttgagtggggacacagagccaaaccctatcacctggcatctgactttaactgttcgtgacaacttgagacccatagaaactctagaggatgctgcaatccatgttgtatccacagcaatgttgctgaggtcagcagcaggtggagatgtgactaggtcaggaatattcatcagtaattggcgtggagcagacattttgctaggtattgaagatacagataaacagcatatggtcccctaccttgataatctgaaaattcagtaggtgagctctccagaaatgtagatcttactcgtggggacatcatccactatctccgctccatcagatcctcatgtccattaagtttgtccacgactctttgagattctcctgggagcccccgactcatctctgaacttcacaccaccaataccctatgtgcctcttgattttctgcttcctctagaacccatgctcaatcatctcaacccctctgtgaatatcatcattgccacggctttgaatgtttctgtccatatgcccagtcaccaagtgggagaccttggactcattgttgatgtctccttcctttcttctaactccctccttcttcctctcctgccgtggctgcattgcatgtcatcaaacccatgaaattgattcttttcttgctatttccttggtgtagaatgcatggccttgtgttgtagtgaattgttcatacatctgtttctctttggagactgtaagcttgttgtgtgggtcttcaataagtcttgaaataacaaatgcatattatttaccagtaatcctttgaacaaggcttccagaagcaatagttcatgttttcttgggagtgatttgttaaaaaatgtttctgcttattattaataatttggaggtgactacattatggtacataatttcagaaaacagatgcaacacgtgctaaatattcatggtttgatttcaggattattttgcgtcattatgttcaagggtctgatttgctttgcagggtatttgtatttgtgtaatcctcagtcatgttatattaaatgtttccaacatacttatacctcatgcttaccaggtaattaaaaacttttaaagcacgataaatttaaattgaaaaggggccaggcatggtggctcacacctgtaatcccagcactttggaaggctgaggtgggaggattgcttgaagtcaggaggtggagaccagcctgggcaacatagcaagacctcagtctctacaaaaaataaaaagactagctgggcatgctgacctgcacctctagacctagctacttgggtggctgaagtgggaggattgcttgagcctaagtttgaggctgcagtgagctgtgatcacaccactgcactccagcctgagcaacagagcaagatgctttctctaattaattaattacgttaattaactgaaaaggtacaacatttttaaaagtgggaaagtgactgctagtaatgttctgcttattagtaaaatacagtactatctttttaaaggaaatatcacactgattttggaaatatatatttttaatattctgacagtaaaaaatatttaaagtttttacataataagtaatagtaccgccttaattgaatgttattttttctgtctattttatactttacatatcagagtaatatttagaaatgttctttatggtaaccagaaattgctcttattttctttatcccattgttgatgtaatatttagaaatgttctttatggtaaccagaaattgctcttattttctttatcccattgttgatgtgcagttgggttagcataactaaaggaaaaaatgtgatagtttctcatggcctgcatatggtggaaaagaactggaatttgtggtaaggtcaccttaaatttctagaaaatactacttagccactgattgtttttcccctgcatcgagttcatactcaatacagactcatgatagttttgatatctcagaagaaaaatttccaccataattgttcatcttttcaaaactatttctctattctcacatatttttaatagataagattcttttttaattttcgtgggtacatagtagggatatatatttatggagtacataatatgttttgatataggcatgcgatgtgtaaaaatcacatcatggaaattggggtatccatcccctcaagcatttatcctttgtgctacaaaatccagttatacccttttagttatttaaaaatgtacaattaaattattttgactatagtcacccttttgtgttatcaaataccagatactaataatcacatcatggagaatggggtatctgtcacctcaaacacttaccctttgtattacaaactatatgtactctttcagttatttttaaatgtacaattaagttattattgactgtagtcaccctgttgtgctatcttattcattctttctatatttgtatacccattaatgatccccacttcccctcccaccactacccttcccggccactggtaaccatccatctactctctgtctccatgagttaaattattttgatttttaaatcccacaaataaatgagaacatgccatgcttgtctttctgtgcctggcttctttcatttaacataacaatctccatttctatccatgttgttgcaaatgacaggatctcatttagataagaattttagaatcagcctgtacaccttcataaaaaatccttttggaattccaattgtgattgcactgactatatagattaagtctggaaacatattatgcttctccgtatcagtcttcttttaaaaacgtcgataaagctttataggtttgactgcctctccacagttaattccttctatttgttgcctcttggagtaactttgaatcactccaacaccataggtgtgttctcttccttgtaggtgtgtttgctttctatctttctgggatccgttgaaattcctggtctgttgatgatattctttcttatctttcatgctatgctggtttctggaaggaaggagtgttttgctttttgaatatagtttctggcattctattggatttgttgcaagagggaacacggccacatgtgctcccatctgcttcttgatcccatttcttagctttgcgtggcgtatgtgtgagacagacagacagtttgcaaatagtgaaaccaacacatcaaggacacagacaactagggagcaagctgaaaacttagatcagacgtcatgtttctagagaagaggtgaaagactgttttaattaatagagtatcttagcctcctctcaaacaacatgggtgatatggtttggctgtgtccccacccaaatctcatcatgaactgtagtttccgtaattcccatgtgtcatgggagggaccaggtggggcggttaccctcatgctgttctcataataacaagtgagttttcatgagagctgatggttttataaggggcttccccctctgctcagcactcacttctctcacctgctgccatgtgatgtgcctgtttcaccttccgcaatgattgtaagtttcctgaggcctcccttgccatgaggaactgagagtcaattaaacctcttttatttataaattactcagtctcaggtatgtcttcatagcagagtgaaagagggctaatacaatgggtattcttcagtcttggttaagaacatcaatgtttcaccaaagggaaagaaatcaagaaggaaaagtttgagagcacagcatttttggagctagtgattttaattgaagaaaacggcagaataatatagagcatagtagttacgcgtgaaagcatgccatgaagactgagtgatatccaatatactggatttgaaagggggatttttggatggagccctacaattagacattggaatgcaagtgaccactctacagtcatgtgactttggaaattttttatgactttcattattgtttacatcgtactgaaaatgataatacccagcaactaccatgaagtattagtagagtatcacattaaattttttaaattaaaaaaacctctatgagaagtagaaacaacataaaccaacaaaaataagcaacaaatgattataaagtaacagtcaagcagattccaattttgcaaggcattttctcatctagaaggaaaagtgagggcaaattacttcagttgttagatcttcgtagaatatttggtaatgacttggcatgttatgaattttgccttctgaattatcactattggataatacatgctgggcttgtatagttacagattttgtgacttcaggtggattttataattttctagaaaggaatttaaaaaacttttatttttgcccccatacttaaagcatgtctataagtttgggaatagaaggactttcatcaaaattatgttgcaggctctatacgtgtattacccataataaatactgaaaaatatggtacattatttaggttgttgatgcagcagattatgttatcttgccttagatatataaacccttttctgagatcatgttattatttctacttttatttccaggttgaaagatccgttgaaaaaaaataagacttagtaggtaactatcagtgtactggatatggcagtctagatttttttaattaaaaaattagtggcttaaagaaacacacatttattatctcacagtttctgtggatcaggagcccagtcatggcttaactggaccctccagctcagcatctctcagaaggctgcaatcaaggtgttggctagggctgcattctcatctcaagacttgactggggatggatcttctttcaagctcactcagttgatcttattggtaggattcagcttcttgcaagctctttgactgaaggactcagttcgttgtgcactcttgactggaggtcaccctcagttctgtcacatgtagcactccaatatgtaagttgggtgtctgcaacatggcctctgtatcatcaaagccaccaagaaagtctactagcaaaatagaagccacagtgttttgtaacctcatgatgaagcaacatccattactttcacaatattctttttttaaaagacttttaagttcaggggtacatgtacagggtatgcaggtttgttacataggtaaacatgtgtcatgggggtttgttgtacagattatttcatcacctaggtattaagcctaatacctatttgctatttttccttatcatctccctcgttcctccctcctccaataggccccagtgtgtgttgttcccctctatgtatccaagtgttctcttcatttagctcccatttataagtgagaacataagatattttgctttctttttctgcattagtttgctaaggataatggccttcagctccatccatgtccctgcaaaggacataatctcattctttttttatggctgcttccatggtgtatatgtagcacattttctttatccagtctatctttgatgggcatttgggttgattccatgtctttcctatactttcacaatattcttatagaagtgaatcattaggtcccagcccatacctgaggggagggtatcacaagagattatgaatatcaggaggtggggatcactggaagccatcttagaaggctgacttccatagatgcctactctgattcattaactgtcaaaattaggaccagcaaattaagtgaattgattgaggttttacagcaagataggaaaagtgcaaagaatggaagtcttcacctttgcaatttgcccaaaatccatctactgccttccaccttttggcatacgtaggtccaaccactgtgggaggatgctaactacttagcacacacttatctatgcatgtaatgccttctgacttccaactttagaatcacagcctgtagaaaaacttaagtaggttgcccacactcctgttacatctgctgtcagtgaatagaccctacatgcattcctgaccttcaaaacacaatggcagcaaagagatgaaaaaaaatttttttaatatgcttccatgtcaattttacaaaacacagactgtcactgcctggagcgataaccttgaaatctgagccacagatctgcaaacctattcagccgcatggtttctgggcagtctgaaattacaatgcttttattttttttttccaacattcaaaaacccttttatgattgctttaaagtcaaacacactgccctgttttctgaggatgtgccttactttttcttctagagtcatgtaatcgtccttctttaaagaggactgtgttcgggaaatgacaagttcctagttgtgttgtagactaaccttagagttggccatgtccaaagcccttttatagtgttgatgcaaaatttccttctatttccttaggtaagaattccataacacaggagatttagctccattttgtggaaaactaggcagttaagcttcctgttcactggataatggtgcttcactctctgagtccaatggcggagaatgccaagtggaagaacagggttaaatcatttgggaatttcacacaattttattttctactatatgcctcttgaaaggagctgtaaaaatgatgcctttaagtaatattttgtcaatcacaacatttattcctgttcttcttcctatcacgactgctgacttactcctgccattagcacattctcataattactgtgactattatgaatgcatactaagtaccatgtctgggataaagtgtgggaatactaaaccaaattagatattctctttccttcagggagaagagactctttgtttctataacagagagagtctgatatggaaattgccaaataaaatgcaatgggagaagttgtaggaaatatgagcttgttgcaatgtgggggtgagttgttgcaatgggggggtgagctgttgcagttagctagacaaagaagagaaacattctggcaaagaaaactaaattattttttgaatattgttatggagcatttaaagaagtagtgttgtttctatataactggcaaaagcagtacatactaattaaagagcatgcagagaccaggtcatgccaggctctgtgtgcaaaggcaagaagattgaattttatcctggaaatgactgagggacagataacctcagaaataattccatacaagactaatatttaaggggaaattataaaatggagcacacattaagaagataaagaatggatggacaagggagtttggagataacccctaagacatgatggcacaatgttcagagagaggcaggcagaatggagcagacgctatttctttgaagacattcatggaatcatgagaacttgagctttggggaggatcgtcttaaggggcacaggagcagatattagggttaagcccaggctcactagggtctgatggaagacctggctccataaagtttgggtcctcaagcattccacactccaggtaggagcaaaatggtaatagaataaatctttccccattctcaacccctagaagactgcaagtttttttgatgcaaagtagagagagcttaaattacatttcatattttcccagaatctgtgatgcagtgttggtcaattcagcacagttaatctcaatagacaaataacaaaaatactcaaccaagaatgttatcagagaaatatattaacctttacaatgcttgtataaatgaaacatggaaaattttttaaaaatatttttttctttaaaaatgatttttaaaagattttaaaacaaattctttaaaaatttttgttaaagatgacataaatatcatgcaataattaactgaattaattcaaacatgatctactttcaacctcattttccaaacaatatttcctaacaaacagtatattttatttcacacgattttgattcaaggaatccaataaagttattaatttcatatgaaaatggaaatgcatacaatgaaaacttagttgataagtaaaggttttcagaatgatactaatatgtcaaatcagcacttacgtccctaagcaaaagtcacttaggatgtattatcattgttttaatacactgctggaggtatttgctaaaattttctttatactttttgaatttgttgagaaagagtggctcataagtgttccttctcatcctgccttatcagatactagaatggagattatgttagtctcataaaatgatttattgaatgttccgttctctgttctccctaatgctttgtagatctcattgatgaaaccatgtggatcaagcattttctttcttgaaatatttggactgggaatgcaattttcttaatgaatacatcacttgaggctttccatgtagccccttagtttttaagttgcatctttctagggatttattggcttcatgtttttactattgtctttttaatgtggtacgattctatggtgctctgtttttcattgctaatgttggttatttctaccttctctccttccctacctattgatcagacttgccaatttgttaatatcattggactttttgaagaatcaacttttggttttgtcagttctccctatagaatatatattttttctatttaattaaattattctcttatcttacatttccttccttctaccatcttcttgattttttttgttttataactttctaagatgtgatgagtttactaattttgttttttgttttctttgttaatacacactgttatcctaggccctgatctagatacacctaaaatgtttgatatgtatttttcagatcatttgtttaaaaaatattttccaacttccattttactttattcatttacttgtggataatggagaatttttaaaaatttccaaacatatggggatttcaaagtcagagatctgcattgtgttttcagtcttttgacatatctgaagacttgtgttttggtgcagtatatcatcaatttaagtgaatgttttaggcatggctgcacagaatacgtacttttccatttgtagtgcaataattgatatatgtccattaagtcaaaggtgctaattgaatcattctaatctcctctattgttactaaaatttttgtcttggttttcttaatggctggaaaagatatattaaattcttccttgataattacaaatttgtctataactccttttaattctgtcagtttttactttacatcttttggggctttgatatatttttctcactatatatttcatttattcaacaataattcgtttataaaatatattttgcctgatagcacaaaatatttttaatttggtttttatttatttggtatagatgaggtttcttttctttcatctatttgtttccatcttttttttagattctttgtctctatactagttattgcatattagttgttattattatatattctatgttactatttctcataattagtatttaaaagtcagtagtacttctaactctactccactaagtaaaatttgcttctctggctctttaaaaataattttattaaggtatgatttgtgtaaattaagctgcatccattgaaagtataaaatgagttgtgtacacccataaaaccactatcacaaacaagacagtgaatattccccaaacccccaaaagtttctttgttaatgacagcatctgccccagctcatgaagacaacaacctgctttcagacactaaatatttgcttcaactttttttttacacttttatataagtggaattgtattgtacatcccctcttgagtctggcttcttttactcaataagaaatttgtgatttagtcgtatgtggatcatttgactagtcactgagtagtattttgctgaatgaaaatctttcattactgagtagtactccgttgaatgaaaataccacaatgtgtctgcctagtcacctgttggtggacatttgtattgtttcccatttttggctcttgtgaatccagtggctgtgaaggttcatgtgcaagtctaagtgtggacatatacttttattctcatgaataaacatccactagtaggatagctaggtatattcttactcatataagaaacacaacatctagagaacactgttctctagagggactagttactgttgatctgtgtattctggtcatagaagacaaatgttttgatttccggcacctccaagtcattttacaaccagggaaatgaagaagccaagtcactgaaagatgtacatctcattcctgatgtagaaacactggagcagagtaaccataggagacagtttgtctctgtggtcatgagctgcagggactcaggttgaaccatctccacagcgcacctgcagcacatcttactaactggatgatgctttgaggctcagctaatccccagacgtctctcagatgagaagccaatatctaatggtcacccagcagtcactgaatcccagggtttataatatcccatccatctgtgaccacttctgataaaggaggactattcagattcttccttgggattgggtatgattgacatgacaggagaatacacattccagaattactgttcacctttagtttattattcatatgtttgaattttattaaatacagtatgtatttttcatttagcagactcttttttaaacaacagctttatatttatggaaaaattgagcacatagcatcaagaattctcatatgctgtcttttagccttcctcagtttcccctcttattaatctcttgcattagtgtggtacagtttttcatgctcaatgaactgataatgatacattattatcaactataaagtccttggtttacattatgctttcttctttgtgttgtatagttctgtgggttttgaaaagtacataataacatttatccagcattacagaatacaaatatttttcaatgtcatttcacaaaagagacttgaaaaaagctgactgtaaactaaggcaagctcagaaattacactgtaaagggaatatagatggaaaggaaatgctatcatcacaaaatcctatttttcttttcagtgtactataatcatatcagattcaaagagaaaggtgtaacttttgttacctatgacaaagattataggtataaaacatgtttatctttaagaaagttacagaaagtggaggaacttgtgatctagggacggacttaccatgtttgaaaaatggatttcatggtagaataaataggattagctctctcatgccttcaagtttaggagagcaagctctatgaacttgaaggtgacccactactaaagtaagtcctgttcattgagaactggaagaaacttgaggaataatttttatttttgcattgcagaataagcaagaatactttttatttaatttgcatttcccttttcatataattttgagactcgtcaccaatattttcattacctgtttcttccaaacctgtttttctcctaaaactaatacctcttctgattttttaatattttctgaaaagtttaatatattctgaatttgaatatttatattttaacatgatcttgcacaccttaaatattctttggcatacaaaagttttttttcatgattcgtgagtgagttgtatatatttattactttataagaatgattgtcaatcatccctgccccctgccaaggggacatttggcaattcctggagacattcttgtttgtcacaactggaagggggatgttacttgtatctagtgagttcccacctgtcatgaagggatggacaccacagatgctgataaacatcctataatgcctaggacacccccataacagagtcttgcatccccaaatgtgagtattactgatgttgagaaatcctactttagaattttctctgtctaactctccctttacccccatttgacagctggggcaagtcagacaaacagttttcaggctgggtagtctctatcaattggcatccacacttactagtaatctgaggagacgggttaaggtattaaagagaaggcatagaacttactcaccaagaatcctactatgtataacaacacaacatgttctaacatgaaagaggcaggagacagtatggaggaaggataattaagcaagcattttattggagaaataatatctagtttggaaaactgaagacatgagtgattctgattaaaaaaataaattagattatattacaattctgtttaaagcccttcaaagactccactttcaatgacttctcattttccaaagtctttctttcatgcccaaatctcagtgagttccctcctgtcattctcagagtcctatttgttttccttgcagcactcaattggaagttatatttcttttttaaagtattggatacctctctcctccagtaggctggaggacaatggtagtatctattttacctggcacacagcactttcatcctccccagtaacttggaagggtcctcagaggagggagattttctgatgttatcaaggagaaaacaacaatgtgggcaaacacatgcaggtggaccctagagtgcgcccacatggaaaggtaagcagaaataggctcaacttcatggcagagaatgctgttgtggggtcttattattataatgtcttgactgctaggtggaagaatttagacctaatgagtaggtgatcgggactgaagctcttcagcagcggtaacacaccatggaagctgtttctgaaacctgaaataatcccccatggagattttatcactgagacctaaactcaatatatagaatctttgcacatttttgttatgcatatcacatccctccttcaaaaccatattttttcatgccttttagaaggtgcatagtgtatatgaggaatgtcaacaatgatattcaaccccaaccaagcaccttccttctggcttagtttgtagtcacaatattctcacagccagttgttttctgtggattgcaatgtgttttggttttccagagcctttcactgaaacctgaacaggacaaacatcagtatcattagtagttacttgggtatatttactatatgagtcattacttcaatacctttattatagtgattgtttgggtacctttactatagtggttacttgggtacctttactatagtagttgtttcttcagtacctgtactatagtggttatttgggttcctctattatagtggctacttgggtacctgtaccatagtagtagttgcttgggtacctgtaccatagtagtagttgcttgggtacctttaccatagtaattgttgcttgggtacatttactatagccattatctgggtacctttaccatagtagtagttgcttgggcacctttgccataacaatggttacttgggcgcctttcccatagcaatagttgcttgggtacctttcccatagcaatagttgcttgggtacctttacgatagtaattgttatctgaagtacctttaccatagtagtagttgcttgggtacctattctatagcaacagttgcttgggtacctttgccatagtaatagttgcctgggtatatttaccatagttgtagttgcttgggtacctttattatagtagtggttacctgggtacttttaccatagtattagttgcccgggtacctttacgatagtaatagttacctgggttcctttgctatagcaatagttgcttggatacctttcccatagtgatagttacctgggtatctttaccatagttgtagttgcttgggcacctttactatagtaatagttacctgggtacttttaccatagtattcgttgcttaggtgtcttacccatagcaatagttacttgggcacctttcccacagaaatagttgcttgggtacctgtaccatagtaacagttacctgggctcctttaccatagtaatagttaccttggcacctttaccatagtaatagtcacttgggtatctttgctgtagtggttacctggatacctttgccatagcaacagttgcttggatacatttactacagtagttaccacctctgttctgctgcttttcctaagacactttttctgcctttttttttctcttgctaattcctcctcattctcaaagactcagcccagtcttttggggagccttccttaatccttcagttctgctcttcctggggctctcttctcattgccgctgcacaatcttgaggctaccattcccattacacacttgaccttatattgcatctctgttcctgtggtatctactgggccctgtgactcagtcatgcaaaaataatatattcaactctgaatcttcatggctagggatagcaactggtgcatgctattgagttaaatagagagagtgggagagtgagagtgtgtttatgagaatgctctcttggactctcttcaatgtctttgtagcctgtgactctaatcaccctggatttatttcattccagcatcaatcctttctacttgaaaaccagtaaatatcctctttgtctagataccaactgacagaatgtagaaggattaagaagctgtcttctaccaagcaatgcaaggaaaccaaccactgaacttctaaaatagtaatagagatgccccttccaggtgccatagaaaatactattctttacctactaatatacgtctccaatatggaagattatttacaagctgtcacattaataataaataatatattttcattattttcatccaaatccttgagtttcaaattaacaacatttgaaggagacccgtttgcacagatgaaatttgaattgtagataaagtgacactctggaagggttaggtcacgttgttgcttttcaacactaccaagatttaatttatgtagtgtcattgtgaagagagaaccctaatggctttttaattattctcaacttcaaagagtaaatgagagagaaatcagttcccagacaaaggaagaaaatattggaagctgagtagagataattatgcaggaatgccctagtaaaagtatcttaggacgtaggggtgtagaattcttttctgcacatcaaacctacacagtggaacagaactgtattgtttgttcagttccctattatcaccccacagtcttttttaaagaaaattaattttaatttttattttaagttccggggtacatatgcaggtttgttacataggtaaacgtgtgccatggtggctcgctgcacgtatcaacccatcacctaggtattgagcccagcatgcattagcttttttcctaaagctctccctccctccaccctaccccctgacatgccccagggtgtgttgttcccctccccatgtccatgtgttcccattcttcaggttccacttctaagtgagaacatgtagtgtttggttttctgttgctgcgttactttgctgagattaatggcttccggctccatccgtgtccctgcaaaggacatcatctcattcccttttaatggatgcaaagtattccgtggtatatatgtaccacattttctttatccagtctatcattgatgggtatttgggttgattccatgtctttgctattgtgaatattgctgcaatgaacatacatatgcatgtatctttataatagaatgatttatattcctttgggtatatacccagtaatgggattgctgggtcaaatggtatttctggttctagatctttgaggaatcgccacataatcttccatgatggttgaactaatttacaagactgttatgatttcagttcttttgcatttactgatgagggatttacttccaaatatgtgatcaattttacagtaaatgccatgtggcaccaagacgagtgtatattctgttgttttggggtggagaattctgtagatatcgatcaggtccatttgatccagagctgagttcaaatcctgaatgtctttgttaattttctgtctctatgatttatccctcagtgttaagagttggtgatcatagcaagttatggaaaatttggaaagttatagttacatttttaggcaagcttattgggctgtgaattacgatgaaatagtagaagtaatttgctatgtcagtttataggagccagagatagagtgactttcacacaatggctttggaaaaatccacaagtccaaaataagatgctctaaacaccatctgataatagaaaaacgttttaaacttatgtctgtttgggctcattgtggggaaaaaaaacttggccatttattgctatgtaagactgattgcccatataatttgacctttaactctaaaagtggatgttggggaaaatgtgagtttcagaactagctgctcttaatacatgattatttttagttataaagtataaagcttgtttgagagcccattttcttggagaacatgtaagctgtctgatcacaaacaaaatcataatatttcctaataacaatagttgccatttgagtctttgtagtatgccagggactggatatttgcttctaaaggggataatcccctgagatatgagggatccagtttcccccaagcccctgccccaggaaagtaagaataaagaattaatgaaaagctaaagagataggttatagaagcaataaatgaataggtacaatggaaatgttggtatcattcaggtgaacacaggacacaggaaaaatagcctctcccggacaatcctcacttccaggaaaaactttttaaggagagtcttgggaaaaagcaggcatgtgcatgtttttgttaagtaaactggcataaaccaaaacatagtgtgtcagcctaaaaagagagaaagcaagtgtgaccacccgcagtgtgataaagctattgttttttaaagtaaaatatttcttgtagttccatattgctattcaagtgtaaaagttctcaataccagcctagaatgaagttatctgcaggtctgtagaccccttttacgaattgtatggaagtacttgttctcagactagaagtactcaattctattccctgcaaatgtcaatttagtatcagtcatgtggggaacagtttacagtgtcacagttttcacagcctatttcaggctccagggaacagttatgccatgtaaggaaataactcattcttggtaaaggaaaaattgtaaagtatttagttagaatttttctgcagctgggcatggtggctcttgtctgtaatcccagcactttgggaggctgaggcaggaagctcgcttgagctcaggagttcaagaccagcctgggcaacatggtgggacctcatctctactaaaaaagaacaaaaattagccgggcctgctggcacgtgcctgtagtcccagccactcgggaggctgaggtgggaggattgcttgagcctaggaggcagaggttgcagtaagcagagattgcgtcactgctcaccagccagggcaagagagggagaccttccctcaaaaaaaaaaaaaaaaaattttttttttcaatatccagtaattattttatctccttccaactccttccaatacttgtgatgtatgtgtgtatatgtgtttgtgtgctcatactttctgtctcaagttgtgaacaagaatttcatgtagttcaatcttttatcaaaagcctaatgttacttttttttaagccattaggcgggagtcgtgggtttcaaatacagtaaataaaactgctagtactggaaactgtccacatcaatgtgcccttcaggttgcacataaaaccaccttgaaaagcagagctcttaaacgctgtgtacagaaagctcgtgttgttatgtgttcaatgcttcctaacagatttcgttactaggcacgataagaatattgaaaccatatttgtgaaatacagttaattagcttgagtgaacctttctataatgtatacatagatcaaaacatcacattgtaccccataagtatacacaattattatttcttaattaaaaatacattaaaggccaggcgcggtggctcacgcctgtaatcccagcactttgggaggccaaggcaggtggatcatgaggtcaggagattgagaccatcctggctaacatggtgaaacccgtctctactaaaaatacaaaaaattagccaggtgtggtggcgggcacctgtagtctcagctactcgggaggctgaggcaggagaatggcatgaacctgggaggtggagcttgcagtgagccaagatcacgccactgcactccaacctgggcaacagagcaagactccgtctcaaaaataaataaataaataaataaataaattaaaaaggaaaatatttatctgttctgtggtttttctttcattttcctttagcatctttctagttagacatctttacatttctttttgtttggtaacagtttccattttctgtcataattccttgaatgtcctgtcaagcaacacatgcctgctgaacagtaactgtgtaagaggctgtgttaggctggtgagtggcacaaaattgagaaagacctcactaagcttggtctctactgaaagaggcagaaatgtacaaaaatgaacaactctaccattattaggcagatgttaggaaaggcatatgaaaaggccaagaagtatcagatcctctggctataaaaatcactcagtagctgggtgtggtcgtgcatgcccatagtcccagctactcaggaggctgaggctggaggactgtttgagcccaggagttcaaggctgcagtgagctatggttgtgccactgcactccacgctgggcaaccaagtgagaccctatttttttttaaatcgctcagaaggccgtgaaaccaataatctgtaaacccaatgggaagaaaatgacagcatttcatactgctaatcaacacaaccatggccctttacacatctctctaaatcatgtgatagtccacctacctagggactggaaaatggacaaatgatattagtttttgaaaagatgtaaaatgcaaaagatagtcaaggtggtagatttacatgccagtgtggatgttggggaaagctctcagggatccaagagaatgttttcctcttgcagtaaaacgtcaacatagagagctagtatcatttgttctccaccaaacttctgctctcattgaaaactcagaacatgaattttccacatttctcccctagaatttctacatcctaaataatgaatgcagccaagaggagcatattcaatggcaattaatgagtatctttccattaaactttattccattattaaatgttccagttttatgtcagtggattacatattatgcatggcttatttgccattgctttatgagcattttataggcaaaagggaatggctgttataaagtaggtgggtttaagacaggtctttccctgttctgcccaccctcccatcacatccctcccattttggttctctggaattaaaatcaatctttaggtgctactcacataatgagaactttgatgtatatggctttcctctacaaagcgacatatgttcccattactgagatttcttcctcagttccccgtctacctcccccatttattcaaattctattcattctttaaggcaccgggggcctttctttgtcagtcctgtctgctgtgagtgctctcttgagtgctaagagagtacttgctctttgaaacttattctgctctgtaacttttcatgtgtcaatgtgacaattatactgtaagattttaaggtgggttctacatcctatttattttttttttgtattctcatagtttccaataaaatatatattgttgattgaattatagtcttccccagttatgggaaacatagctgaacgagaggcccagaataaaaatgaaatctgtacatttacttatttattattttttgtctttttatagttgctttctttttttatatttaattaaatttaattgtttatttcaatagatttttggggaacaggtggtgtttggttacatgagtaagttctttagtgatgatttctgagattctggtgctttctatatttagagatgatatggcaattatacactttaacaataggattaaaatacaagtttcttatgttaaccaatgacatttaattaatcactataaggacatgcatcatttatgcaatttcagatttgaaataatactagtttgtatacttacctggcaaggaagataccatgattatgaaataataatagtttctaaaaccagaataagattactaatcagctaaaaatcaataatgtaaaggacattgatagaaaacaatttctatcataatttcagccatttgcaattaaatctcattttataaatatacaaggaaaatggaacacaaagaatggtgactgttgaatgatatgcaattcatccccataaactatttaagtctaaggttcacattcctatacagatataacccactggaagatatattactgagattaaaattcgttctctcccttgccttatgaaaataaagaaggaatcaaactcaattgtaccttgagcatttaatgacaaatatcaataacaatatttgttgtaaccaggcagtaatccatcgagaaataatgaatatgaaaactgataaagaacaacatgaggttgtgtgcagtggctcatgcccataatcccagcactttgggaggacaaggtgggaggatcacttgagcccaggagtttgagaccagcctggacagcatagtgagacttcgtctctacaaaaaaaaaaaaaaaatagctgggcatgctggcttgtacccgtagttccaacaacttgggaggctgaggcaggaggattggttaagcctggagtttgaggctgcattgagccatgatagcaccactgcactccagcctgggtaacagtgagacattgtctctggaaaaaaaaaatgtgaattacagaaacaaaataaaatgagagcatgcctgaggaattgaaggaattcatcacagatctgtgattatccaccaagattaagtatgttatcaatggccttcaaagaaccttcaggaagcatcaactttagatagtgtttgacgatggagagaaaatcagagtgtgagattttggaaaagggttaagagtgtcaaggatggcaggaatgcacacgtgtatctaaagagatgagagataggatgtgcagacccagaaaagaaagagaagaaatcagaatagttggttacatttttggcaggaaaacttctttgcaacaccctgaaggtgaggaaggaaattccagacctcaggcataggacctctttctgtatctcttgcttacatatcagctggggattatgttggatttagattcagtaaacaagggtgggcctgagactgcctatgctgatgctcctgatccgtggaccacagtttgaggagcaagtcatcaggacactctcctacagtgagaggtgatgctgtgatattgatccgtgcagccatgaggatggctgatcagctcccctcttcctggccaggagcagccatatttatggacaccagtgaggtacacaatgtgattattttctatatgaacaggggcaagaaaagggttggtattcatactctcacaccatgttaaggatactgagaaatttacaagttgaggaagagacaagaaggggcaaaaacaaacaaacaaacaaacaaacaaaacccaaacaaacaaacaaaaaaaacgaagaatggagatgccgttacaactatttagaaaattgaaagacatataattttgaaagggaaggctgtttgtctactacaaactctctcatatgtcctaagagggtagctgctccttgaaacttattctgcttaataaattgaccacattttaccatgtgttgatcacgttttccttaacttccaagctgtcatcttgttgagtttgaggtacagactggaagttcaggcaaagatattgaaggcggtatggttggcagaattttggcccccatgagttttggcccttggtgttcctcccatggttatgtgatggcccaagggagtctacagatgtcattgaggttatcatcagctgaccttaaaagagggaggttctcctggcttatcaggatgggaccaatgtaatcaggagtccttagtagcagagaattttgctggctgaggagaaagagatgtggcaccagagacgtcctactgagaccttggtcttagaactgtaaggaacaaacacagttctgcacccacctcaatgaacctggaagcggattctccctcagagcctggagataagaacccaggctgcttatcaccttaattttagccttgtgagactgcccatgagcagaggaacctgctgagcccacccagatttctgacctatacaagtatgagatgataaatttgtgttgttctcagctgcccatttcatggcggtttgttacagcagcagtagaacatgaatacggtcagcaccagaaggtatagaacttgcaatagagatgtaggcgttacctgcacagctggacaacatattgaagtaggagagggaacatgtgatttcagtggagcgagtaaaagaggagaagaaagaaaaggagccttgagaggaaaggaaggaagccaggtttccagctggcgttgacctcacggaaggagaaaaggataaagaaggtggaggggagcaaaagaaagagagagagctgcagagggccagtagatgtgtggatttgcaggtcgcctgtgagctgtgagagcctggtttggcaggtagcgctaagacaaagaacgttcgagcgcgagctattcataggcagtgagatatgaagataggcaggcatggcaggtccactctccttccctttcgaatggtgtgagagttccactagagatctggaatggcacatctgaggaagccagggaaagaggtctttttttttttgagaatgagagaagcttccatctgaatgtagaccgtgggaaaacatctgcaaagtgggctttgaagatgcaagagagtggagtgaatgggtagagaaagacagtggaggaaacctgggaggtgatcaaggcattctgctgttatctcgtctagtctcattcattctgttttagtccatggctaaatagactatggactgacccaccatctgctttataagctgatatcaagctaatctttctttctttccttttttgtttttttttgttttgttttgttttgttttgttttgtttgagtcagagtctcgctctgtcatcaggctagagtgcagtggcatgatcctggctcactgcaacctctgcctccagggttcaagcgattcccctgcctcagcctctcgagtagctgggactacaggtgtgtgccaccatgtccagctaatttttttttattttaattttttgtattttagtagagacggggtttcgccatgttggccagaatggtcttgatcttctgacctcatgatctgcccaccttcacttctcaaagtgttgggattacaggcgtgagccattgcgcccggcccgatcgagcctaatctttttaatcttttttttttttttttttttgagacaaggtctcgctctgttgcccaggctggagtgcagtagtgcgatcttggctcactgcagcctctacctcctgagctcaagcaatcctcccacctcagcctcccgagtagttggtactacaggcaagcaccaccatgcccagcaatttttaaattctttttgtagagttgaggtctcactatattgcccaagctggtcttgaactcctgggctgaagcgatcctccagcctcagcctctcaatgagataacaggcataagctaccatgcccaacccttttagttgtaaataattgtcctcaagcatgttttaccatgtattgaccacacttcctttgcttgcaagcctctgtgtcaagactctcagtccttctttctaagattccttcttggttgctattactcttcatttctgtttgtgttctgcccaaacaacccctccacatctccttctttcccatgcttggtcttcaaatatgccaacagcatctggagactttgtgcttaccactttctctgtgtaggtggaaagacacattgctcggtctttattttcttcaattctcttctcaaacatccccttattagagaggctttccttaaatactctgtataaaatggcaatcccaaattccagctaagaccttattattcattctctaatctctctatcatctatctactatctatgtatcctctgtcactatcttattatctatcatctatctacctatctacgtacctgttatctagctattcatcctatctgttctatctatctacctatatctatctatccatcctatctgtcctatctatctatctatctacctacctatctacctacctacctacctacctattacctagctatccatcgtatctgatgtatctatctatctatctatctatctatctatcatctctctatcttatgtatgtatgtatgtatgtatctacctatcatctgtctatctgtcctatctgtctatctatctatctacctgcctaacatctatctgttcatcctatctgttccatctatctatctatccatcctatctatctatcatctatctctatcatctatcctattatctacctatcttctatttatctatcatctatcttacctatctacctatcttctatttatcaatcatctatcttatccacctatcttctgtttatttatcttctatttatcctctatcttatctatcttctacattaaatatgaatccatgagagcaggactttgttttatgttctcagtggctagaatagtgcctagcacatagtagacattcaaaaatgtttgttgtagagtggatgacttttattggtctgcccagcatggagtcctggaattatcatgaattcagaaagaaaataacataaaactgttaatcctctgtgctccaggtttctatcataatgtatagatcctgctatggtctgaatgtgtgtgtccttccaaaattcctgtgttgaaaccctcatccccagggtgatggtattaggaggtggggctttgggaggtaatgaggtcatgagggaggagcctcatgaatgggattagtgcccttataaaaggactccagagagctccctcaccccttccaccatgtgaggacacagagagaaggagttgtctatgaaccaggaagcgagttctcaccagacagtgaatctgccatgccctgatcatggacttccagcctccagaactgtgaaaaatacatttctgttgtttataagcctcccagtttatggcattttgttatagcagcctgaacaaactagctttttcatacttttcatcttttctcttatagcaaaattgagttcatgcattgttgagaataatatagtatcaagtaccaatcttgtaagacatctcattcttaccaacctgtttttatcattgcttttgaaaccaagcattgataattatcagatgtcaaatagttaatacacttacataatatttgtcatataagtattatagaaataattaatattttctagattttttcctatcaagaaagaagaggaaagttagaaataacatatttttgtccacacaatgactatatagaatcataacatgaaataagtttgcctcttgaaatataccactttgcaaagaaaggcagggtcttatccgttcaccatagtcattgaaaaactgtaagaggaaaataaaagcatcttaaattcttagggcaacaaaattgatcagaactaagaaaagatgattgagttgctttagatttgcatattcaatcagcaagatcatttttaatcttataaaagggtattttacagtaacatcaatcgttgaacatatatactcagaaatgcatacaattaagaaaaaaatcaaacaaacccagacatggcagaaagacataaacatattgactgaagaaaggctgggagtcagagaaacatttccgaagttgccaagtctttgaagtgataatatttcaaggaggcaaaactgaaaagttgtctgttataagtgttttttcttcttgtctaagcatgtacatggcttgtacttttaccaaacaagaaatgctagaaaccgtaaggcaagaatacacatgattttagacagggccactggactgagtcattagagggcattggtctgcaaaaccagatacaatgtagactcagtcattgcctaaattgcattggaaaatatgcatatgggttcctaacattaaatcctttaagtagatatttctttttctttcccttcctggcagataggaatgacacccaaggagttttgacacaggttatcactccttacataaaacgatgatctatatcaataaagcaagaataaacatttacatctatccatctgtaaggtatgaacattggtcttcaaactcaggaaggcggaggctggaagaagcaatccaattactgtccacatttccatgtatctgttgtcattcctgaatatgcacaactaaaataattacagtagcattatttttccttccacatatactttgttattgtttctctttaatatctccaaaagtacctactcagtaaccacagccatatgccctacatacaggagaacaccttggacatgtcacatcaaaagccacaagagaaaatgctgtttttttcaactaaaggattataaatacctggaggattacctggatgatctaattagcattgtctggtcataatctcatgatcaatgcaaactgactgcatttgaatgccaatgttttcatttcaaaatgctaacatttagaatatagtcgaaccaaacgttgcttaacatcctttgctagctgtttcttttgaatttcattttttgcttgtttcagtgacaatgctgaaattagatggtgtaagaaaaagaaacttaattgctattataatttgaacagttttcgaaacgtttggtgctgtatttttgaaagaggattttatctcattgaactagacggtcaagacacaatttattctttggaaacaaatcctgtaatctctgcccagctgggctcaattgtccactggaaggatcttgtcgaaatctgtgtcctgtaagataattggttcagccacagcaatggccagtctccatgaaactgggtaggaaaaacatcctgtgaaatggagttttctgtgggaaacaaagtcaacgccatgtgctctccaagaggcaaaatgcaggcagaggaagaggagatgaatcaaaaataaaaaaggaagattataagaaaaatcataaagccacatgctgctagatcttcttctttttccccctcactttcctggggccatacgatatgcttttcttaagacaagtataaataaatccatggtgctgaaagaaagagcctgaaaacagagatgattactatctattttttttttttacagtgtctcccttctaaacttgctgctgttacaccagagcatggtgtaccctctaccctccctaaacgaggtacatgataagagtcattatttgatagagtcgattttggatatgtttacaccattccatcaacaattttatgctgaatcatatgaaattgccaatattcacccatgacagttttgtatattgttcaacacaatatatctctacaagttagttgcattaattccgaggaataaatgactattcttaaaaaatgaactaggggactcagggcacctgtgtttgcttagcgccatggcttagtcatacttaaggttccttttcccttgtggtatgcatcataaatttcttctgtatctcctctacttctgtacagggaggattataattatacccaagcctttggaagtagtagatgtgttcaggtgactacctcactattcgcaatgaaacatgaatggaagtgatgtgttttgcatgtgctggagtatttaatcacctttactggactctctggccatctcctcccatgatgccttatgttgagacgatgaccttctataagggcagagcaggtctctctgccaaccacattggatgccagcttaagcaagaaataaatctttgttgttttaagccaatgaaatttttgagtggttagatactataatcaacccagtttattctcactaaaaaaagatctctgggggaaaaatatgatgtcaggcaatactcaataatgcttgctgttgatgataagagtagagtcaacatttggcaacttaaaatttagagggcgtgaatggcctttccaaaacctctggccccaggaattcccactcactagaaatcctgtttagaaatatcttttctggggaggttatcaaaactcctgacattatgagttctgaagtagttaaacccttccctgcttaacatttggttaggataaatttcattaagtcaaacccggtagggtagggtgaaagtctttggaatagtgcacagtcttggttttgtcttagcaatagggaagtgtagaaacatcttgagcattaataaaccctcctaatatcactagcaattaataataaatggcactcagaagtgacaatccaaagtcaatatatggaaatggcatctttttggagtgaagctattttgacaggctaaattccaataatattaaacacagctgtcacttcagcatatgtggtgatgactcagttaggtaaaattaggatcatgaccaccgggaaaaattaaaagacagacatgacagaaagaggaaagactggatttcagtagaaaaagaagaaaatgtgcatttatgcagagcatttaatctaatgtttttttttctccccaaggggagaaaaaagtcctttcaagcactgtatttataggtacaattataaatgtagcctaatcctcttttcaattttaagaaacctagtagaccaagtctctgacaacaaacacaatagaaataagcccacgctacacagttttgggtaagataaaacctttttgcacaagacatccagaaatgaacaacataagctttgctcctatttctagctactctttttaagcaagctgtggatttcgcaatcaacttttgctcaagtctctgttttgtgataataaagcccattgacagcatttgttttgcagctctgtgttgtcccaacctaatttgaaattaaaataattgttattaaaatggaacaaaagaaaaaaaatggcatgagatgaattagaattgtttagtatggacaatgaacctggctttcattttcaggaaatatgattttgcacaaagaaaattatttgcttcttgaaagagaaataatagttggaaatgcttgagttattcatatcacgtttacacagaaaaatttcggtcatttaaaatttttgttcatggaaatgaaataattccataacctaggagagagagacagcctatataatactttaaagaaagtcaatgttatgatgcaggcagaatttgtcttctctatcatcccccttcattttgctccccagtggctgtgccttaggttctgtccctaaatagctcaggggttctcaaaagccatgttttcatgccctggaatcttccctttactttgcttcattcacaggtcccactggggccttgtctctactaggatggagattagaaattcctactctaacaaatactcactctgctgatgttagggtactaaggcctctccccagtagagtttgccaggagtcagatttctgaggcttatttattttattttatgtagagattgagtcttgctctgttacccaggctggagttcagtggcacgatcatcgctcactgcagcctccaactcctgagcccaggcaatcatcccacctcagcctcctgagtagctacgactacagatgcatgccaccacatctggctagtttttattttttgtgtagatggggttttgccatgttggctaggctggtcttgagctcctggcctcaagtgattctcctaactcggcctcccaaagtgctgggattacaggcatgagccatcatgctgggcctcagagttttcagagttaatacaaactctaccttgtcataaggaactctagcgccgctgggagagtgatatctctggagagtgatattccacctgacttcttccctgggcttgaaaggggacttttgtgagcaggggagcagtgaaaaaatcctcaagaaaggtgtcttccttgacttaaaggaatttctctgggggcttgggccctgctctgtgtcaccctaaaggtaggagaggaatcaggagataaggaattagaggaagactggggtacaagggccatggccaatagcatattctttggagtgttgcttttgcattccagccagtgtgggtgggtaccacatgaggccagtctaggaggcagagccctgacaccttgcaaacaggtatgcaaaatgcctgcacctttagcgctctgaagctgtcttgtgttgcatgcacgtgatctgctcatgcttagaagtaattattaagtgcttttacttagccaatgtgggcacagcatattaactccaactcacttcaaggcaaagtttattataatcacctacctcctccatcttgcttagtttacttaaaataccacgtgtttgttggtcggcttcacaagacaagctctctttccgaagtcctagcagtcagctctctaaatgtctcatgctcccccttcctccttggtttctataaaggagaatgctgcttctttttatagaagtaatttccctgagaatctgataaaggtctagcatgattctgcaaaatagcgcagtaacaacattattatcacctggtgttttttttttcagatatacattaatcagtacattaagcagttggaatttaaccttaataaagacaaaatataaagtctatttgagatcatagactttgaggtcaaatgtattttgatagctgtgaacatgcttgaaatctgaagtgacttaagttgtggctggtttcaaaagctcttgtaacattagcaaaccctaaccctggaatctgtctttaaactcacacatcagtcctcagggcctgaggtgtgtgtctacatggaataatgccaatatgacttcattccgagggaaatggctgacccaccttttcttgtcagtagtcccttaataggaaggacagaacaaaatcagcctggttacataggaccctgaaattcacatttgtaattatgcaaattcatctattgttgacagaaaatgcaacatattgattgttgctgttgaactttgcatttgaatacttgcaaacgctttcaactaattgatttgcgtatcctataatctgacatcagagagtaactcaagtacaaattgccccacttctcaagaaaagtgcactgctatataattgaagccatttcaggtcttttgcaaacctattatgaagtactgagttttagtctacttttatttattgctgggaccagctgttctctttaagtgcctctctgtgaccccgacatgaaaaaggttgatttgcaagaacaaaatgtatacatacctgcagtgtgtgtgtgtgtgtgtgtgtgtgtgtgtgtgtgtgtgtgtgtgtggtggggatgaacattggctactctctttaatgagaatggaagctaagctttagatgcagttttacgggtccctagaattgatcaaaagcatccatagggagtgaaggggactgaaccagtgacagtgcccttcctatgtgttatgggctgaattgtgtcaccccccaaccctcaccaccgactaatatttatatgttgaagccctaactctcaggacctcagaatgtgaccttatttggagatagggtctttaaagaggtaattgaattaaaatgaggtcattagggcgggccctgatccaataggactggtgtttttataagaggagatgaggacacaaacacacacacaggaacgatcctgtgaggtcacaggaggacacggcatctacaagccaaggagagaggactcagggagaaccagccctgcccacacgttgatctcaaacttccagcttccaggactgtgagagaataaatctctttggtttataagccaccagtctatggtattctgttacagcagcctgaaatggacttagacatctcacaagaagagatgaggacacagacacacacacaagaatgaccctgtgaggacacagggaggagatggcatctacaaggcaaggagagaggcctcagggggaaccagccctgcccacaacttgatgtccaacttccagcctccaggactgtgagagaatacatttctgttgtttaagccgcccagtctgtggtcctttgttataatagcaagagcaaactaatacactataaaaggaccctgtgttgggggcaggggttgacaagggagaagagtgtgtttgggtgtagctgtctttcaaagacaggtcaagagacctaactcacacctgcccttgttggcacaaggacgtggactataggtaattacaaaatgataccctcaggcatggcagtacatagtattatggttgcccagagatttccatgccccagtctccagaacctgtgcagttattacatcccacagccaaagggactttgcaaatgtgattaaatttgcaggctttaaaatagggagatcatcctggtttatctgaatgagcccagtttaatcactcaatccctttaacgtctaagaagagtctgtttgagagatgcagcggaagaaaagaaagaaacgtgtgcatcattgctggttctgagacgtagctggctacttgcgtgcaaggtcttaaaagatgactctaggagcagagggcagtccccactaacagccagaaagactaacagggaccttagtcctactgcaatgaaccagattgtgccaacaaccctaataagcctggaatggatttttcccagagcccccacataagagcccagcccagctgacaccttgatttcaccattgtgagactttcagtagagaacttcatggagccaccaggaattctgacctacagaatggaaaatgaataaatgggtattgttttaacttgctgaactgtgaaattttgttacagcagcaatagaaaactaatacaagtgtattttaccactgttttgggtctctacctgataacctcaaatgattttgaccctgactctacaaagtatggtctgtggaccagcagcctaggcatcacctgggagctggttagaaatgcagatgctcacatcccaccctagacctcttgcatcagaatctgcatttggataagatgcccaggtaattggtgtgcacacccaacaactacctctattcattcagagatccaagcaggatgaggtactatgttttttatttagcaacatcatgagaggtttgcaaaattatttagataaaataaagaagatatacaaatggccaacaaatatgtgaaaaaatgttcaacatcactaatcatcaggggaatgcaaatcatagtcacaatgaggtactagctcactccagttaggacggctattatcaaaaggacaaaaatcagcaaatgctggtgaggatgtgcagaaaaaggaacgtttatacacagagagaatgtaaattagtattgccattatggaaaacagaatggaggttcctcaaaaaaccacaaacagaactattatatgatccaggaatcccactactgggtatttgtccaaatagaaggaaaggaaatcagtatatggaagagacatctacacccctgtgtttattagctgttcacaatagccaacagcagatgaagggataaataaaatgcactatatgcacacaacagagtactattcagccataaaaacaatgaaatcttgtcatgagcacctccatgggtggaattggagcacattatcttaagtgaaataactctgaaacagaaagttaactacttcatgttctcactcatatgtgaaagctaaaaaagataccgatctcatagacttgaaaagtacaacagaggatactagatgccgggaagggaagggggaagggaaggatagggagagatttgttgaatgatacaaaattagagctagataagaggaatagtttctagtgttctctatctgtataggatgactgtagttaacaataatatattgttgtttcaaatagctggaaggaggatgctaaatgttcccaagacaaagaaatgatcaatatttgaaatgatggatgtgctaatcaccctgatctgattagtatacatgtctcaaaacattactatgtactccattaatatgtatgattattatgtatcaattaaaaaattaaaactttttttggataaatctcttagctgtaccacagagtatataatttttcataatctttatccatttgaaacttttaaaatatatgccattttcatgatctgttttgtcgatggtaaagattctgttaatgagatactgacagggaaattcctgggagccaaagtgactttaactggaatcttggcattttccattccaaactcttttctctgttaatactaatccaggcagggcaggccagccactgttctggagaagttagaccaagatcagaagctagggagtattagaaatttataaaactgccttaaaatcctctttcatcctgcaaacctctcctcttctcgaagtctctaacgctataccttctgtcagctgctagcgtctatgatcctctgaatccagccattccttcctctcttattttgccaatgctttaagccttgactgatacacttccctttgacaactgctccagggaatttgtgggccagttaatagctaatcctccatttctctaatctgggttctctcatcctcataaaactctttatgatgcattcccacccagatccttgttttttgtttgtttgtttgtttgttttttgttttttctttttgagacagagtctcgctctgtcaccgaggctggagtgcagtggtgtgatctcggctcactgcaacctcagctacctgggttctagcaattctcctgcctcagcttcctgagtacctgggactacagtacaggtgcatgctactgtgcctggctacttttttatattttagtagagacggggtttcaccctgttgcccaggctggtctcgaactcctgagctcaggcaatccacccacctcagccgcccaaagtgctaggattacaggcgtgagccatcgcgtcccagcctcttagccctatttttatcctacacaaggtaatatcagcatgaatatctccacacttacattttatttttgtttccattcattagcatgctaagtaggcagtttacctatcaactagttgttcaagcaccttgattataaaagattaagcagaaatactgccatggtctggcttctcaagagataacatattcctaattacaagttcctagagtcaaactcagatagatatctgaaaaaaagcagattgactgcagctcaaagagtaagtctggtgactaatccaggtggatttgggagtcactgactgaacaaaaactgcctctaatagcttgaggatattcatttgatatgaaattatcatatgactttagtgcaaactgcctgctgatttttttttttacagtaaacctattgagtgctgcttaaatcttcacatctaaaaaaatagctatcaggagttattaaactcctactatgatgaagacagccatgctgtggtgcagttcgtgttctgtgtatgatgatttaaatacataaacaagtacacaggatgtagtttgttgaaaactacaatggatgcatttaataaagactattactgaaatatgtgcttttcagtggtcacggatggaaggcacagtcactggggaaaggtaaattataccaaaatcaaaaatacaaatatgcgtaacttctgttcatcaatacacaccattaaagaagtgatgcagccaattagagagttggaagaagtgcaacatatgtccaatgaaagactgactgactgaatatatgaagaactcccataagtcaatataaaaattgtagaaaacccaatagaaagatgggatggaataggccctttaaaaagtgactagaaaaccaatgaacatattcaaagcttctcaaacctatcagcaatcagagatatgcaaattgaaacaaccatgtgatgccactacacaaccttcagaatttgctaaaatgaagaaggcaaacatcaaatcttgatgaagatgtggaatgattggaaatttcatacatgttgggtgaaaatacaaattggtcattttggagaactgttgggcagtatttaagtattgtagaatgtattcatattttatgggccaacatttccaatcctaaaaatctgtgcatttgttcaccatcagcatggaaaacagtgtttttggcagcattatttataatcatctcaagtaggactcatgccctaaccaccataaaagttgagccatctctttcagccatagactgaataagaaaacactgaagaagtcttgaattcaaaaaagttctttggactagatattgaagcatgaattgaatttcatccctgatttggtctgagttttgcttctgctcaagttagcatggtgcacatttctttaccttaacatgcctccaagcaccctgcatttacctgtgtttctggccattcattgatgtgtttcgtggtgctcacccagtgcccagcacagaatacatgcctatggaacttcacacgtacttatcagccagcaagaaacaagtacataaaatgatttctcagacagtggaagcatttcctggtattatttttttcctgtggggtttactcaaagagtcgtttcaaaatgtttaaaggagattttattacaagagagagcatctgttatgtgatgtctctaacaacttatgtcggctaactggatttggttactgagaaaagatgaatggattttgagaatgagccttgaagttatttcatctcctattaaaatatgttgctaacttgtggctgggcatggcgtctcacgcctataattctagcactttgggaggctgaggtgggcagatcacttgaggtcaggagtttgagaccagcctggccaacattatgaaactccgtctctactaaaatgacaaaaatagccgggcatgatgacacgtgcctgtagtcccagctactcagaaggctgaggcctgagaattgcttgaacccaggaggcagaggttgcagtgagctgagatcatgccactgcactccagcctgggcaacagaacaggaccttgtcacacacacacacacacacacacacacacacacacacacacacacacattgctaacttgtggtaagagacactccagatagtgaagtccttgtctgttgtctctgacttttatttacttctatgaggaccaggggaggaccctcatctctgaaaacttctgttatgtcccacagtctggtgagaaaaccagccctctgaagaggaggggatgatactgatcattgtttatttaatagtaatgctgtaatattaataatagaaaaccttgaactgtctcctctggagatgtgtaattcataaccctggcataaaattgtcattttaaaaaagaatcttggcatgaaatctttgagtttaattggagggtattatcacaaacaaggggaatgataatatacgccttgtaactgactgagcccttatccttgaacttctaagtctcttcacccatcctcttccgtgatatgataggtagagtccattgtcttccatccttgaaaatgtatttcaagaggtcacatgaaagggaaaactctttgttattctctttttctactctgaatagaaagcacacacaagcttaacctggagcccaggaaggccgagagaagcctgtttctttggtttgtttctgggcttcttgcgttggcatgtgacccagggcatacaaataaatccttgtgattcagttacttcacgtgcataaagaaaaaactgcaataaatattctgaatccattttggatgttttaccgcaaacagcattcaaacccacaactccccttccccttctgtcaccacagccaggtaagtaataagaatgcctggaggttgagggagtgaaactatgcaagccacagcctgtgttcaagaaggctccctgcaacctcacaccttaaccaccatgaaagctgagtcatctcctttctctgtgactgaagccatctttgtactagcttgggagtcttccttgctcttcccagaaagccccactgtgtcataagccttctcatacattctttatgcatgtaatgtcatcagtcttgacctctaaagcaaagtttggatgtgtgcgtgtttggagggaggggtccatcccacctctgtggaatgactacagtgggtattaggtcccagccctgagcaataccataaagagcccaatatcattttgcagaacaagcagaatttactccttggagcaaaataataatgcacttacccatcgatatttgaatgactggctttttaatatactttctaatagcaatatattttatttactgctgtgtccatagatgccttctacatggaattttcttttatctccacagcccaaagtgattctctttgctataaactgccatagcattttgattgtcagtctcttacacaacttattacgttattccttttactgcagttatactacggtactcacaaaatgagtacattgcagagctttggaggcagggttgcctggtcatcatgggacagtgccttatacaatctatgttccctgaatgtataaatgaatccattttgagtgccaatagcaaagacaggagaaaagcacaatgccatttattatgcaccaggtatctatacccacgcatttaagagagtcacagaagctgccctttgctctgccactttccaatagaactggtgtgcaaaacgttgattttggttcactaaccctggacaaatgcgccttgaatatggtttaaccatgtgtcatataaaaatagttacaagacttgcttttatttttacatagtatgtgtagaccagtttgccaagctcattgcatgtaatcattcaaatgcctatgacggtgacactataaggtatatcctattttatccccattgtacagatgtgaaaactaaggatccatgaagctaaggagcccgttgaaggtgaatgttggtaagctgggatgccagatatatgaacccatgtgttatggctttagaatttatggacagttgctgtggctatagtactctgctgtgtagagttgtgacaggcagaccctaattcccttctcttgagcataggcaggacctgagacttgcttctaaccagcggaatatagcagaagagatgtgatgcttcctttgtgattgtgttacataaggttgtaactttcatattgctgggtgcttctctccctcactggcactggagaaatcagctaccatatttcagaggcccacatggcaaggaagggagggccatctttggccaacagccagcaggaaactgaggccttcagtccttcacttcacaaggaattgaattctgccaaaaatgttgcaagcttggaagtggatccttctccggttgagccacagataagaccacagcactggctaacactttgattgctggtggcagtcttgtgagaccctgaagcagaaaatctacacaagccatacccagattcctgatccacagaaaccatgagataataaatgtgggctggtttaaaccactaagttcatggtaatttgttacacacatatagataagtaatgcaggtgggctagtatgattagagagggaagaccagagaacagcttgattctcagagccttttatcactggcagctttattaatcatttttcttctctcttccttctcaactcatcttagagtcatgctccctaaatgaccctgatcataagaataacctggagtgcttgcgaaatgtaccgaattcctacctttacgactcattgacttggtgggggaggagccaaggagtctagaatttcaccgagactttcatgacattcttttgctcaggcaaagttgagaagcactgtcatatagctagggagtgaatcttgaccctggttacattttagactcccatagagtctgaggtgcattgtctgagatgaagcctggggactggtatttttctttctttttttttttttttttttaaaaatactccccatgtgattttaacatgcagccaaatttaagaactgctgatcttcagcaagccctagcaagaagatagcaaatgtcaagtactccatcaagtaagcatgctagttatataatggggaagagggatagaggccattaatgttctaagagatatgtgctttcccacaaaactgacctactccaagcaagactgtcagctcatctttttacgttaaagtgatttattctaaaatgttccaaaaagcacacataattgcaggatgtttgagtataagatgttttttgagtatcaaagtgaataaaagctaccagtgaatagaatggcagaatttggtttataatatctagattattctagaaacttgggtggaggatgtaaagtgtacatattgtaatgaggttgactatctaatttctggggcccagtataaaatgaaaacgtagtgcccctttttcaaaaaaacagcccaaagtgccattaaaggaaaaataagtataaagcatttacctctcttctgcagtctctcacttggcttgtcatggtgttttgtatttgctatttaatgttgttctgagaaaaggaaaattaaaattttaaattattagcatgagtattaccattcgtctttatatgacgtaataccagctttaaatgcaaatagaagagcatttaacttgtggacagaatcaccgaaattacctaatttatgtttcatggtgcatacatgcatatgtattttgttcttaccagaacagtggaaacactacacaaaactaaatcaactgtttttattttgcttctttctatgtgcacattgtacctcactatgattagttactggtaaggaaggacttaatggaaaaggaattacaggcttcccttcttagtcttttattctctgtcatcatttttcatcctaaggagttggctcatgcagggtaacccaggattttttcgttttgcatgtttctcagaacgcctgtgccttctttctgaatttgaaggaagttgtggtttcaagggaaagcatggcctcgcttggctgttagcttactcacttgtaggtgtcccatgcttacattgtcctctttctgaatctcgctgatctcctatgcactgtgggtttaccagaagtctgtgctcatgggccactgcatatgctatccatgaacagggcagtaagtaaaaccacttttgcaaaaatcgttagttattgggacctgagtttggagaataacatgttgggtagcgagaaaggtataaatgatgtgctcatcaaatcataagtgaaatcgtaagttttgattccccctgttcctcctttatcaaataattctgaaatcaattcctaaattgatatccatgtagcatcccaacattatgacatacgaggtatgtttcttacaggctacgttagatgtatctcttttaaggttctctcaaaggcttggagaaggggtagacaaaaatattgctcatctatcctatccccttagcttcagtccatctcaccagaagggacaagttactgagccaaagcgtgggctgatttttagggaaaggacatcaatgtaggttggtagagttaaaagaaatattttcttttcctcttacccaattaaaatttgagaaatagtcttagtacttagcacaagtgaattcactttggaaaacgtgaaggcattttgagcaacagcagtagactgctgcccttgtaagatacatgttgacttaccaggaccaccggacctaagagggcaggcccaaattgcccttacatttttatttggaacatttcctttagaaaacttgtaacttttttcctggtctctttgaaatatatgtaaatcattttgaaagctcaagaagactctttccagcattaggaactagcagtgtcttccttaaggacctgggagccatccctttgaaatgtaaacatcaagggagttatcacctcccgctctcagtctctgtaggaaggtaggagcctaacttcagaagggcctggatcctggttgcaaaaccacctgtgtcataaaagtaagcagactttatttttgctttgtacaaaacaaattaactaacacgatggtcaccccatttatggggtgaactgatggtgaactatgtgtaataaacaatgttgtcaagtcctcttacttgaggactagttattgtttatcttcggaatgtatatgtaagggggttatatttgcttggttctacagagtgagatttctttctatcttcacaatttctaagagattgtggaatatgatatccattacattttgatttaatgcatattcaataatgaaattgttttcttccccttcttcctttgtgaagaggttttctggattgggagaaaattttattttattttttaattaaatttccacaacaacactcatgagcctatcttttctgcttccaaaggagacacctcactacaccttaacgtcatgagatattttggtggctggatctcctaataccttgggtgtcttggtggttggatcgcctaacatcttgggtgttttggtggctggatctccttccctccaccttccaggcatacccagcctggcaccaatgagtaaaacagaactactcactgcccaaatgagacacaaaaacatagcttcctctttgtgttccagtgactgtcacacaagtccaacatcacaagtcaggagatatgagcccttaagggaggtctagccagatatttacgcccaggctcagagagttgaagtttaacatcctcattttttgtagtcctagaatgatcaagtgtgatcttgtgagactgtcttcagtttcagtgagtaaaagggcatctgctgatcctctcccatcttttcatgtattaggttaatatgtggaaacaacaggttgcagcagagaaagaggtttaatcatagagctaccaaatgaggagactagaggaaacctcaaatccctctctccgaggagtttgggtccagggtttataagggttttggagtgggtggaagtgtggaaatcattgacgggtggaagagtgtagggtgaagtcatggatcagggagatgaagaagccatgttctcatgctgatcccatttctctgtgcgtgcgtggggcgggggtgtcttcaaactggttggtgtcagctgttttgctggaatttaagatctgaaaaaagtcttaagcaattcttaaacaaaaacccttctaattttaacatcagagagcctatctataagaacaatggtgattcaaattgattcttaaacaaatccttatgattctagtgtcagaaatcctatctataggaacactgggggtgcaaatggtcagtatctgctatgtaactttcagttacaaggaagggggtcaaagtgcagcctgattaatgcttaattatggctgtatttctatccagaattcttaatcctgtgagggtggtttcaaaacatatcattcttctgtaatgctgtaatgcttcacttagagtttcgtactcaagactgaagatgcacaaagccagtggccagaccacacagggcaatagaactttgccctccagtctttgcaggaatctgcctagaatgatcaagattgggttagcgattgtcagcttcccaaatatttgcccatctttcaacttaggaggaaccagagaaagacaaatatgctcccccacataatcacatgagatgctgtgcttttaagtagcccactggcaggtcccctgatgccaaccacctccacttggggcatacctgaagccttcccttttccactataaagcttttttatttctccacctgccattgagtctgtgccaaacacagttgctagcggtggactcccttgtgaaagcagatttagtcctggactaagaagcctaaatatacccctaagcttttcatttaaatagtgattgcatttctgcaaggcttggattctttatcattcagctttcttgcacaggacaatgaaggtatgttccagatatgaggcaaacaagatcctttttcttggacatggttttaaagaacaagggtgacctactctcagacactttacgaagtatgcatatgtgcatgtctttttgcatgtgtagatttaggtgtttagaagccttaacgatcccagttttaaaagcaaggggatgcctgggaaactagcgcgtatctggcactggataaagaagcaatcagctgtcttaatttgccttctttttttttttttattatattttaagttttagggtacatgtgcacaacatgcaggtttgttatatatgtatacatgtgccatattggtgtgctgcacccattaacttgtcatttaacattaggtattatctcctaatgctatccctcccccctcctcccaccccacaacaggccctggtgtgtgatgttccccttcctgtgtccgtttgttctcattgttcagttcccacctatgagtgagaacatatggtgtttggtttttttgtccttgtgatagtttgctgagaatgatggtttccagcttcatccatttccctacaaagggcatgaactcatcattttttatggctgcatagtattccatggtgtatgtgtgccacattttcttaatccagtctatcattgttggacatttgggttggttccaagtctttgctattgtgaatagtgccacaataaacatacttgtgcatgtgtctttatagcagcgtgatttataatcctttgggtatatacccagtaatgggatggctgggtcaaatggtatttctagttctagatctctgaggaatcagcacactgacttccacaatggttgaactagtttacagtcacaccaacagtgtaaaagtgttcctatttctccatatcctctccagcacctgttgtttcctaactttttaatgattgccattctaagtggtgcgagatggtatctcactgtggttttgatttgcatttctctgatggccagtgatgatgagcattttttcatgtgtctgttggctgcataaatgtcttcttttgagaagtgtctgttgatatcctttgcccactttttgatggggttgtttgtttttttcttgtaaatttgtttgagttcattgtagattctggatcttcaaggagaactacaaaccactgctcaatgaaataaaagaggatacaaacaaatggaagaacatttcatgctcatgggtgggaagaatcaatatcatgaaaatggccatactgcccaaggtaatttatagattcagtgccatccccatcaagctaccaatgactttcttcacagaactggaaaaaactactttaaagttcatatggaaccaaaaaaggagcccgcattgccaagtcaatcctaagccaaaagaacagagctggaggcatcacgctatctgacttcaaactgtactacaaggctacagtaaccaaaacagcatggtactggtaccaaaacagagatatagatcaatggaacaaaacagagccctcagaaataatgccacatatctacaactatctgatctttgacaaacctgacaaaaacaagaaatggggaaaggattccctatttaataaatggtaatgggaaaactggctagccatatgtagaaagctgaaactggatcccttccctacaccttatacaaaaattaattcaagatggattaaagacttacatgttagacctaaaaccataaaaaccctagaagaaaacctaggcagtaccattcaggacataggcatgggcaaggacttcatgtctaaaacaccaaaagcaatggcagcaaaagccaaaattgacaaatgggatctaattaaactaaagagcttctgcacagcgaaagaaactaccatcagagtgaacaggcaacctacagaatgggagaaaatttttgcaatctactcatctgacaaagggctaatatttagtttgccttctaaccttcagaaccctgccaattctgagagtatcattactattatttttttttacagcaatatcccctgtgcacaatgcacccttgcaggatttctgcctgactgtggcccatgcatagtgctcagtggagactgaaatatttctctgctaggctctgttctgcagatgcatttgcagtgagctagaatacgcttgcctgccttgggaagctttgaggcaacaatagcgtgaaaccaatcacagtaattatcacattaactcatgtcattttgttcaaatactttcaacctttaaaatgtgggagctaagctctaagatccaatgctgtctctagcatcctgatgcttgtatagcgtacatttagttaaaaggaaactcattttgaggttataattagcaagaaaaatttacaatctgcaagctcaggttctattcatggacttaactcccttttcttgcctgtctctaaaaatccaggccactgtattccactagcaatcgctattgttattttctgcacctaataattaaatttagttcattaacctggatattctgcagtgtttttttttttttttggtcatcaattttacattcagcagtgcataggaaaaaattgcaaccctgaaaaaccttgtgcaggaccctagatttaatattcttttaaaatttcatttgttccccctgtagagttagaagttgtgcactctgcttttattttatatgcacatttgcgcactctgcttttatcttaataggcacatttagcttaataagtctgaaatgaatcaaggcttgcttttcaaaatagaaataatcaacggctccagctttatttattgaaaagaccatctttccagcattgaaattgcaatgacatttttgccctaagtcatgtgtgagtctctttctggactctccagtctgttttgtttgtctatgcatgtgtcgtgaccacaccatcttaattactatagtgtcacattgagaaagtgaatatcaaatgcaccatgtccagattatatacaaaattagaactctgaccagcctagcagtccaaccacagcctctgcagctactgacgcagaatgatcaggatctggtcaatttctgctagtttccctagtttttgccttttcttccaacatcagatccaaccagggaagatcaaatatgttttgcaagccaaccacctaaagcatgctacttttacttagtctgaccacagttttctcacaccactaacctccagtgttcacacctgaagcctttccttgttttcttttacggtaaagctgcaccattctcctgcctgcatgtaggttctggccacagattggtggctgactcccttcccatagcaagctttgaataaagagttcctgttctcatttgggttaggagtgtctttacttccaccattataagtctcaaaatgtggaacgttaagtcttccaacttctttaataatgtctcggctatgctgggtcctttgaatttctaaaattttagaacaaccttctcaatttccacaaaagtctgcttgtttttttgattgggcttgaattcaatttatacaccagtttgggaacggtagaaatcttagtaatactgagtcttccaatctgtaaaaatggtatatatttccatttatttatgcctttaacaaatttctctcagcgaagttttgtagctttcagtgtagaaattttatacatgttcttgcaaatttatttttaggtattttatgctttttgttgattttatcagtattatttttgttttgttttgttttattttcgttttagtttttgagacagcatctcactctgtcgcccaggctggagtgcagtggtgtgatcgcggctcactgcaacctctgcctcctgggtttaagcaattctcctgcctcagcctcctgagtagctgggattacacgtgcacgccaccacacccagttaatttgtttgtatttttagtaaagacagggtttcaccatgttggccaggctggtctcgaactcccgacctcaggtgatctgcctgcctcagcctaccaaagttctctgattacaggtgtgagtcaccacgcccagcctttgttgctttcataaattgcatttatttttttccttacttttcaaaattaattgattctctaatgatttctcgtgtatgttatgattgtgttggtgtggcggggtggagagagagaaagaacacagtctcatgttctttggaacttgatttgtagaagttctttgaactctgtttaaaatgatttttttggtaaggatttgttcttgcttctaccaggaacctcttggtacttacaaatttggaggcactgtaaagaaattgtaacttagccactctgacggagtagtttctgaccactaactgaccatggtggttgtaattgtttgggaatcttggctttatgcaagaatttcaaactgcacatccatttttcaggccaaaaccttggacttaagtcctcagcacagagacccttaaatgagagacttaatggtagtcaggatttggaagactactttagggcaagaacttgattcttagttaaccatcagatcagatttacttaaaaagtaaaagaatagttacattttacctgttattttagaggttccatcctggaaaaacagttgctgcaacacgaagcttccagactttaaatcatattttcaattagtattccccaaattcacaattaggtaagagagtatcatgcagttactgaattttttccctataatttctactttattctttaacactggtgcataaaatgcaaagaagtagtcgtaccccaaaccaaagaaggatgtttatgaaactgaagaaaaacttactgcctgaatcagctcctctgaagtttacttgaatttgtctactaatgtaggcgacaaaaaaaattctttattcttacctgtgcagttaaagttaagcagaaaagacctcactaaattatttgtgcaaaaagagctatgcatatctcatagattaaaatttatagagccttctgactttaaaatttcattgcaaatacacagagatacacaaaaaagttactcttaatttagtgttttatgaaaattcaacagcatcattctttaaggaaaacaaggatatctttatagcccacagttctctctctgcattccaataatggtgatgattaatccgaagctcagtacattacctcttcaatgagtaatatcagtgttataaatcagattttaatatttttattttccattcactagctcttcaaatatttctgacttacgataagccctttgtctgtatttttcttcaatgtctctattaaatctttgccatgacttatcaacatgaaaattgttggagaagttgattttgggtatgatggcatcattagcaatgtggacatacaaatcttcatgttattctattccttccctcccttcctttctccctccctttctttctccttctcttcctctcttgctccctccctttcttccttccttctttctttctagccttcctttcttgattcaatagaagataagtcccactcactgggtaactctaaatttatagtggttttggtaccctgttaaatagggtgaggctcccatccagccttgtcaagactgctttatttggctttgttccatggtgaaagtctgcatgtaaatcttggttagctacctcaatcttatgtttcttgggctgaaattgctctgggtgttgtatgaatacacaatgggcacaaataaattttttccaatgcacatgccagtgtgacccacagacttcaaggggcatgaacacagagtgtacattctcagcaaatatacacgtggcacatggtagctgctcaaataaatatttgtgcaatggatagatgtgatgtcgaatagccatggatttcaggtcctcacataaataatttttgcctcctaactcgagaaaagagaggacacttctccatggctggtgtgtctttccaatagtgggtgcagtctgtgtagcttctcttgctgttcacttacttcctgacccccatgaggagtggaatgacttacctttgttgtaaggagaaacagggcatgcttcttccctttctactgggagtcagcagctccatagagagcagccattgttctctttcagtattgtgagtctcaagagggcagtcttactagggaagtctgtctcagtcctatgctggctgagactcactggaggggaaggatttcggggtcaggactagattgcctccagacaaaaatgacattcttcaagatctgccatatcaaccatcaaggtgacattttgatgtccataaaccttatgtatttttttcttaattagctcagaactttcatgagccccactggcactcaaacatgacttgatttcatgtattatcttaagcatcctctgctaggtacattcaagcagaacagtggtgtgattttcatccgtaaaacaatatatgtgtacacacacaccacatagttatgtgtttatgtgtgtatgcacataagcaatgggtatttgtgtatttcacctctaattttccaatgcccatattataaagtctagcccacaaaaaaaatgtattgatatggtaccagatataaaactcttatttatgtcttctttacaagagtaagtagttctttgtttcttttttcttcttccaaccaaactataaccttgaggctgctttctttcttttaattttgttacatttattatgcatgaatcacatctttatgattcagtaagccttagagttgagagtaaattatgtaaactttcatgagtgacaaaaatattgtgtatgtcggtcaaaatgtcagttacctaaataaaacatgacactcaaattatgttacatagagggtcgtaggccaatagctcaaaaggaaacataatttatttaatagaattgactgtgattgtgagtaaactttataatctgcagctccatgctatttgggttgaagtatctttctggaaatgtttgaaattaggcaagtgtgggttcaacaataccaaattattgtaattctgggatatttacttcagattaataattctatgattgctgaggttcatagatggtaaatattaaataattttatttttattcttaatatctgagagttagctaaccttcttattaagaattctggaaataatttgcatagaatgtgttacagagcagcaagttaattgctgcttttcttttgaaaatttctcttgtacatatttctcgttatgaatgttcttcaagtttggatttcctttcatagaaacactataagacttcagttacttaaaatgactttgcaaagaaaaagagacagcagaatagcgacccgcttacaatgacagtctccacacctccaatcacatggatgaatattgattcccaaaagtagaattctgtgaaactgctaaccctctgaaacctatactcctgaaaagatgccatgccaacaggaatccagaagacaatggtagctttgcttttattgcgattttatttttaactttagtgtaacaatcaacttcccaaccacaatcctcttaaagtgagataaaattaatttttaatgactaaccacacatctaattgggcggaagtggaacaaaacccagggtcagctcattggctgtgatccagagctccgcttaagacatgcatggtcttagagacccatcatttgccttgagaaaatgaagtggcttaattattttccctaaataaatagtgtctggcatagtgttaggccttttgacttgtctgacaaatattgaatggctctgctcaaggaattacaaataaaaaatgaaaatttacctgtgtctatatattcattctatctatctatcttatctatctatctatctatctatctatctatctatctatctatctgatatggtttggctctgtgtccccacccaaatctcatcttgaattggactcccataattcccacgtgttgtgagagggacctggtgggagataatttgaatcatgggggtggtttctcccatactgttctcatagtagtgaataagtctcacaagatctgatggttgtatcaggggtttctgcttttgcatcttcctcattttctcttgccaccaccatgtaagaagtgccttgcacctcccaccatgattctgaagcctccctagctatgtggaactgtaagtcaattaaacctctttttcttcccagtctcgggtatgtctttatccacaacatgaaaacaggctaatataccatcctatcatctatctatctatctatccatctatctatctatcttatcatctatctatccatctatctattggctatcaatctattgattttatcatctatctgtttatctgtgtatctacctatcatctatttatctgtgtatcttctatcaatctttaataatagaaaatgtcaggctgggcactgtggctcacacccgtaattctagcactttgggaggctgagacgggtggatcacctgaggtcagttcacctgaggctaggcttagccaacacggtgaaaccctgtctctactaaaatacaaaaattagcaaggcatgatggtgggtgcctgtaatcccagctactcagaaggctgagatgggagaatcgcttgaacctgggagatggtggttgcagtgagccaagatagcaccactgcactccagcctgggtggctgagtgagactccatctcataaaataataataataataatagaaaatttcagacacagttgaattttttggtaccttttccccacttatttccatactgtcttctccccgtgaacccccaaaatctggaccataaatttagtattttttatacatattttaaaattgttgctatgtattagctatttagaacctacatgtagacatgttttgcctgatttcaaaactgtaataatgtaaagtatttatgtaaataaatgcaattatattgtgcatatcctcctggtacttgccattctctgttgctttcaatttgttagattttttgtgtgtgtcaatatatctctagttgactcatttgttctactgtacatgtttttattgtgtggctataaaacacatggttttgcttctctgttgatgaaaacttaagttgtttccagttttttgctgttatagaaaatgcctcaaggaacattcctgtacacgtcattttgaacaccaatatgagaacttcttcaacatatataattaggaatgaaattgctggctcagagggcaggtatatttatttagtattgcttaccaatatggggtttgaaacaatttacctgacaatttaaattgaagacttttaaatgtttgctgatctgattgttatgatgtaataacatatcgtacttattttttaattttttttttttttgggaaagacagaaaaacctcgccaggttgcccaggctggtctcgaactcctgacctcaagtgatcctcacacctccacctcccagagctcacttattgtttttatttgcattcctctcgttaccagtgtagtcaaatatcattttatatgcttattggtcatttggattttctgagaatttcctgttcagattatttgaccatttttttctctaacagatttatagaaatttacacacactaacacacacatatatacatatattatgaatataaaatttttcatattatatatatttatatacatatattattgatataaaacatttgtcaattacgtgcacaaaaacccctgataacaatggtggcttgtatttttggtcttgtttttgttgtttgtcaaagtggtggctaaacaatttactgtataacttttaaggctatcaaaatatcagtcatttccgtgtgtgtgtgtgagagagagagagagagagggagagagagagacagggtcttaccctgttggtcaggctggtgtgcagtggcataatcatatggtcatagctcactgcagccttggtatcctgggctcaagcaatttcctgccttatctgcccaagtatctgtgactacaggtgcacactgtaccatgcctggactagattcgtgttctttatgtctagctaagaaaacttttactgttcaaagtcataacattttaatctattttactcaggtacaattaattatatatatcttttcaaaatacccttcctgtaaagtcatctgcttctgaactctaatagttatcaagtcaggtatttaggctgcaagaagtgttatcatagctgaggaatagaaaataaaatgtatataccatgctcaggcttaattgctaataaaaagtaaagataatcaccttaattctaaagtatatttaacaacctgaacaggaacagaggtaaaacaaaatcacctttgttgaactcttgttggtatcagccacgtttcattatgcaaacaattagaactccaaggcaacgactatttgagctaattcccaatacaaacccctcctgtttaagggtttaggacattcataccaagcctagctggacctttcttaaatcattttactcttatttctactaaagttcccatgtgataatacatcttggttcctatgtacataactaaccagctgaggtgggctgagctgtacaaaagcccccataaataaactcaatttcttttaatggctagtctgcaagctgacactttgtttcataaattattctgtatcatcattttgaatcagtttcccagggcttgatcaatgctgggtaaacagataaaaattgtattttgggtcaggttcagactgtattgatctgagagcagaggtgacagtattcatcagtgtaggctctagcctttttgccatcacaataatttggcagaacccgatgcaagtattatgtggttaaaagacactcagttaaccgcccagataattcttataatgccttggaagagacccacataacttgcaacagctaattttgtgtgtcagctgggctgggtcagaggattcccaggtatctggttaaacgtgatttccaggtgtgtctgtgaggctgtttggaatgagattagcatttgaatcggtggatggtacaggcaaagggtttgccctctgcaatgtgggcgagcatcacccaatgtgttgaggctctcaatagaacaaaaggcagaagaaggaggaattcatctttctccttttttcttttgccttaccgcttgagctgagacatctcatattctgctgccttggataggggtttacactatcagctccctagttcttgggctttcagattcagactgagtgatactactggacttattgggtcttcaggttgtagatggcaaatcatgggacttttcagcctccacaatttcatgagccagtttcttataatctctctcttcctatctatctatcatctatctatctatctatctatctatctatctatctatctatctatctatctatgtatctatctccatctctccagttggaaaatcagtctccaattggctctgtttctctgcagaaccctgactaatactttattctacccatgcgatggcttgtagccagtctggaaaatctgaaaaaaaaaaaaaaaaaaaaaaaaaaaaaaaaaacaaataattatagacctacctgatcaatgcatacgcttttgttctctcttagcacagatgcttggtgcattgatcctagccctctgtgtaggttatggcatcctagctagactggcatggacccataagtagttagaggtgaggaaaagctgcaggtaaccagtacagtgtctactacaggttagggctttagttaagtcagggtcccaaaaggtggctcctaaactggggttcttgggatctcagagtggggaagccagcaaaggagtgagaaagctggatagaaaaagggagaaagtcaaatagagtgtgattcctgcaaagtcccagcttcagtctgatctctggggatcactgaggcttatacaatgtcttagaggatttctgtttgttgttgtttgtttgtttgtttgtttgtttgtttgttttgcctggaggtaagggagctgggcattcctatctacccccattcaatcatcgactatgttggctgcagtttggggctttggtgagtgagaggatggagatgcagaatgagaagtgatattaactactggcatttctccatgctccagcaacccaaggacagcaggtcccctgataaaagtgctagaaaaaagcactcagcagcgagacgttgccacacagaataggtaaaagggagctgctgagaatttggtagagcagcaactttggctacagtggtcgctcagtatttgctgagctaaaaccccatttgtctgtagactctgcaatgattaaatccctagcaaattgatgacttaaagaaaaaaaaaagaaaagaaatgcaccagaaatccatcttcatcttgaatgtattccttgcaaaaaaaaatataattgttgatggcttttttcacaaatcatccttgaagaaaattgtctaatcacaaaatagccttttaaaaacagattctgggctgggcacggtggctcacgcctgtaatcccagcactttgggaggctgaggcaggtggatcacctgaggtcaggagttcaagaccagcctgaccaacatggtgaaacccccgtctctactaataatacaaaaattagccaggcgtggtggcgagcgcctgtaatcccagctactcaggaggctgaggctgaggcaggagaatcggttgaaccctaggaggtggaggttgcagtgagctgggatcacgccattgcactccagcctgggctacaagagcgaaactccatctccaaaaagaaaaaaaaaacagattctgtcagccatgtgtggctggtcgaatctggagtttgtaggagagaaattggtttatcagaaaagacagaggggacttaatttgggggaaaattattgaagagatttatgtagtgacagaaatggttataacttggaaagcagccagaaaaagctgaatcatggggattaaagtaggatcgatactccctcaaacgggttgtctgcgaacaaaacaacagtcagtgaagcacgtgacagcatttcaatttgaaaagtattcatcagtgcaatatttttccctgacacaaagttttaataaatgatttttcagtcataaacttggatgtttttttccccttgatgttcttttgtattccttttttttttttttaacggaacaggaactgttttcgcagttagatacaagtgctattctatttccggaactttattactagttcattgcttatcatcatttgccaccataggatagcaagtagccaattacagctcagaaaccaaattctgtccatcgcctgcttttgtaaataaagttttattggaacacaacaatgcccattcatttatgtattgcctatggctgcaatttaattctactttgtgctacaagagcagcgctgagtagttgtgaccaagaccatatgtcccacaaagcctgcagtccttattattggctctttatagaagtttgctgacccctgcattaggatgtggatgaatgccaaaacctacagcacctctttccttcctcatctgctttatagaaaaatcagaggcctctgagcagatccttcaaaatcctgggagaagataagaggtcagaatttatctcaggaaagacaacatatcctattgcctaatgttttcattaaaagtctctgaaatacagaatgaaaaaagattggagaggaaacacaccagctctcatcaatgattcatctctgggaagtaaagtaatagctgtattttttttctttgcacatttatatattttttgcattttaacaataagcatggaagtataccttctataataaaaaatattttttaaaaaaccctacgaacttgtaaaaaatatcagagcattccttctctgtaatcagtaggtggtggggttggatcttggacataaatccatttctaatgagcatcttcagtgccaagaaaattttacttattcctccacgagcatgacaataattttctggaataaatatcaccattcttactttgaaaggctggagtgatttatccagcactgctgtgtttgctagggaaggagaaagagttgggtgcacagccaattttaatgcttgtggtctttgcagcatatcgcatatataaaaattatcaagtattgaatgaattcaaagcattatgaggtgtgtgctaataattaaccaaataatatattccctgcacaataagagcacaacagggtgttactattgggacactgcctattgccagaaaaaatatataatgtatttattgcatgcacacacatatgtgtatatatatatatatacacacatatatataaatatatcccaaataaatatgctaataaataataaatcatggagtaattaaagtaattttagagtgataatctccattacaaatgtacctattaggtatgcattaatattcataagtaaataataagaggttttaaaaatagacatttgattacaggctgtattttcaaaagtacgttaagttaggtcaagtgctggtctcatgtgcttaaaatagggttgaaagagtagttctatgattttattgtgttcaaggctacctttgtgggctgtcttctgataaatggctccatgtatttggacaatgcagctgaccagacttctttttgtaccacaggactttgcagagcctttatcaaattattgttctttgtgaatattcaggagagggtgctaatccacagcttttcctgggatgccatttggcaatgtctgaagacatttttggctgtcattctggaagggggtggtgatattgggatccagtgggtagaggccagggatgctgctgagcatcctgcagtgcacaggacagcctgtcacagcaaggaagggtccaggccaaatatcagtagtggcaaagacaggaatttccttctcccatcttcctggttcttggggctttagtgcacttcacagaatagtggaccttgggtgctactaatgcaccagtgatcctagtgtgccacatgtgctctgggcccctagggtgattcatagcagttagcaggagatgtcagtggggaaccatcaactagaaggagaaatccctgtgtttagcatagatgggcatacctgaagcactgtggtggaagaaatgatttgtgtttgcatttacgtgatatgagcaccttgaatttctagaaaaactagcaaagattgaacaaggcagatggagtgagccaaccagtagaactcggattgctgtggatcttaattggactcccgacaacatgggactgaggaaattcagtttagatcatgattaaataaaacagggacacactgaataaaccggagggaaacaaaacctgaaacagttaaatagcttcagaaaacatccaaatgactaagagggagtaatgacttctctggcatgatatgcccaaataaacaaaataaaacatattcataataataataaatggaattgttagtgcaaagaaaatgcatgcaattcatttttttcatgggcctcatccatcagtttgtctctccctcacttttcctcccgtgtatattgattgagaaggtattgggttctgggtacggtgctcaaacttaggagtacgaaaatgattgaagcacatcccctacgttttggagatcataatgcacaatgaagtatagatgcatgcagtgacaggcaacataattatggccattttgtcaggatggacaacatgctttgatggatcagagatgtggtgatttctaattacactggaggagtgaattatgagctgaattgtgttttatccgacagtggaggttaagagttttctactcaaagagaatggagagagccagtcacagagttataaatgtctgctgcatatttcaactgtcagccagaagtgcaagagcgctggagtggttacacagacataggcagagggggacggcgggtggggctggaaatgcaagtttggttcagttcatcaaagacctccaatgccaggcatctgagggtagatgttcaaggtacgtgagtaacacttatctttcatatcacatttttaattcattctgctcactgtagatctcatacattttctttttttaggtcaggtgaaaaaacacatttctttttcccttacccatttcttctttaccttcctattaaccaagaaatgaatccattcccagctgaaattacaccctacacctccaaacacctaaaatctcatcctctcagcattgtaatttctaatgggggacaaagaagtccttcagaaggatttgaagtgctggtcagcagccaggctcttggatcaagtgttcttcccgctcggaatacaaatccatgtgtcttccaaaggagcccaaagagaaggttcaggatttcatgacccctggcagtcacacagcactgcaatgttcatactgctttggttagttattcatctccacatgtgagcacggtctgcttgtgttttgatcagccccaattcagagatgaagaaacagacaaaagctgaaatgacatctcaaagtcaaacagtcaatcccagcggcaggtaaagagcttagctaggtttctggatttctggcttctgtctggaattcctgccgtgtgttatctcactcgccaaacttacatggcactggcatttgctgattatgggtttcaaactaaatgaaaaaaaaagggggaagtcgtattgaatataaacacaatattttcagaaaatccattacccactatattgcatttataggaaggtgattaaatttccatatccaatatgctaagtgaaaatggggttgaatggtaggtctaaggttagatcactatggatcagagagaaaaataatgagttactgtcacttttttgtgccttcaatgcactagggattctgggaacattgttctggatggattgacagaaaataacccatcctgaaatgggtcctaaaatctgaaaaaggaagcttgtgttcatcaagtgaatcaacttgaatagtttggtgaataacagtagcatcagattgattcagatataatatgacaaccaaagacatttcttagtgtacttatcaatactaccaggttcagggtacatggactctgactgaaatatttcctgagacatctggtacccagtatattggatgttctttcttggaggcaaattctttcattaaaaaaaaagttgatattggggggaaattattttaaaatccttggttgatagctacaaattacacatatttttcccaaaattctatgacatttatagaagtcatatttcacttatttatataaaaattcatgttatttagttaacagaattttgtactctatgttatacactcaatttgaacaatacagtagggcctgtggaaatgggaacttttggccatctctccattcaaacgtagacatttgtgtatcttccttccacatttcttcccctccacctgccctgttttatagctacttcacatgggagagttgctatgctattggttatggttgctgtatttcagagtatgggagtcaacaaggtcttgtttgcttcctctcctcttgtgggaggtacacaggctgaatgttcctatgcaccttggtttggaggaaaggcttggccttcctcaagtcaggaaggacaattaggagatttgctggtctttaattttactgttactgcaaagctgggattgttgttgtactttctggcctgcaaggatatttgaacaaagctaaaatatgtcctagggcatttttaaaggaaatctcatgagcttgtcattttttatccaaagagatccaggtttataatcatttaattactaaatgattggctaaaatggagatccacataaaatgatgtacgcatacttaaaatagtacacttaactatatctatacctatattatatctatctacttatagatagatatagatcaatctctgtctatcctccaccagcgtttttaaaataagatcaagttgtttctttgagtatgtgttcacaaattggagttgttttctgtataagacatatccatgttctttgtgggcagctgagcttaagatgtccctttgagtgaacacacatgagtttggaagtggatctgcctcagtcaagccttcagatgagacctcagccctggtcaacaccaagcttgtagcccagtggcaaaccccaacacaggaactgtatacgtaactcatgcccagattcttgacctataggaaccatgagctaacaaatttgtgttgttttaagccactatgttttgtggtagtttgttatatagtaacaggtaactaatctattatatacaattgacagtattttttttaaagcagaggtagaaattaagacacatataaagaaatctcagtgcaaaatttttctagatttttatgattttcttctcaagcatttatggttatgctgcccccaccaaatttaatagaaatatttagctcacttttacttagttttacaaaaaccaaccactatgttcttttgaaagtagcagctctttttcttgatgccatcaaataagattaggctacattctggcaaatcaaattccataattacaataacaagtgcaagctgtaacacagttttgggatcaaagcaatggatttctggtaggcaaacaactctactcacagaagcagaaagttatagacaaactagagactgccatgtttatactaagacctcaacatgttagtgaattagccaaaacattttacagaagtgatgggctctgttgatgaatctgacaagatgattaattggaggccattttaagaaaatttttactgtgataataaaactaataatttttaacatggcatttctttcttttttatactcctgctgaattagaaatatcggaagagaacagaagatttgagaaatgagacattctcaaccttcagtaatgttcttttaattctaccctgggccattattatttaattcataataagtttgtcataaacatgaattgaaaaatgggagccgcccaatatttctctgtcatcatatatctggttttactcccaaattgtctgataaatgttcccagggagcaagtttcataaatgttaaacaaacacgattttatattgtagggagaaactcatgattctatccatctgttcactgaaagaaaagaaaggacaaatcacttttaaaagaatgtgcaggaaaatgacccaagtttgtaaactctgtattttttatggcatctcatgaatttcagtcttatttttttttaaggaaatagacctaaactcacaaacagtccttacaagagataagaatggtttctctgaagttgttctacttggtcttattactcagatgagatggactatacatccttggagtgagagtcaaaccagccatgggagaaagcaaagaggatgctgatggtggcctctcatcttatcaagctcagagctgccttttaatggatggagaacccaggtgaccaggtgcagataatttcaaagaccaactggaactttgattcacctgagtttctaaggaatgctagatacttcatagatccaaacactgatacctattatcaatgtagaaatcggctgaacactgtccctctaatttggactcttagggcttcatcagaatgttccctggctataagtagcttcctccttgatcctgagtcccaaaatggaactttaaaattaatatcactggaattcttaaagaccctctgctagacatctgttcctggaagctcttttttatcacaacttaggattatatagtatttacctctatcatatataaatacaattgctattgaactttagaagaaacccaacaatttcacaagtataatcctactttatttaaaaaccactgtgagatgagtgataatcctaggcaggcacatatttcatataatttccatttgatatagcaaatatcacatcctgtttatctactctatgccagatgttgagctgcagaatggcatagatgctgttcctcacacccttggagcttacgatgagtaggagggacaatttgacaactgcaaaaagagacatatagcatatataatggatgcccaacctagatttgggagcttaagttccagcgaaggacaattgaagcctgaagagactaaataattgccagaggccagacaattccaataaataacaaacaagatgtaattccacatctttcctcccatatctacataaagaatgcagcttttcaaaaaataggaacgtgttgacaggacacatgaaggtagtgtctgaactttcacagtggacaagtaattgatcagcagcggattaatttgagttccatctctatgtccagtcagcatgctggaattttgaaggcaaagcccccttatccttgaaggttataatctagttcaacatgtggacacttagagaggaacaacagacactggggcctgtcagaggacaagagggagggaggagggagaggatcaggaaaaataactaatgggtactaggcttaatacctgggtgatgaaataatctgtacaagaaacccccataacacaaattcacctatgtaacaaacctgcgcacgtattcttgaacttaaaagttaaatttaaaaaataagtttaaatgtaataataacctagttcaaaaccaaagatattatcaaatggagcaatagaagagggcaatcctgtatgtattgtcacaattctgtgggacagataacacgtggtgaaagtaatttagaaagggcaagagtttaggtctcatttgtcagtttgtgtttttgttgcaattgcttttgaggacttagccataaattctttgccaaggccgatagtaagaaggggaaattgttctatcaaaaagacacaggcactcatattttcattgcagcacttgtcacaatagcaaagacatggaatcaacccaggtacccatcaacagtggatcggataaagaaaatgtggtacatatacaccatggaatactattcagccataaaaaagaatgtgatcatgtcctttacagcaacatggatgcatctggaaaccgttatcccaagtgaactaatagagaaacagaaaaccaaatgccacacattcccacttataagtgggagctaaacattgggtacacatggtcataaaaatgggaacaatattcctttgggtatatacccaataatgggattgctggaacagaaaagtaaatagcacatgttctcacttataagtggaagctaaatgatgacaacacatgggcacatagaggggaacaacacacactggagcccatcagagggtggaaggtgggagaagggagaggatcagaaaaaataactaatgggtactaggcttaatacctgggtgatgaataatctttacaacaaatccccatgacccaagtttacctatgtaacaaacatgcacatgtgcccctgaacaaagtttaaaaatatgggaaaatagactctagggaatataaggggaggaggaaaagggaggtgtaagggtcaaaaacatctttctattgggtaccatgcttaccacctgggggatgcaattcatttatatattccaaacctcagcaccatgcagtatacccgcattataaaactgcacataaacccctgattctaaaataaatgaaaaaaaaaaaagaatgggtgagagaccctggctctcagggaagtatgaccccgcaaaggccacatcctcatcacatcccatacacaatgcagcattcactcttccccacatgcatactgcccttttctggctttagagttctgcgggtttctgtattcttttttccagaatattctgtctcagaagattcttctttatttagcaaaagcccactttaaatgccacctcctccatgaaacttcaggcctaaatattttctctgttcatgacaagtcacctgctacatcacacctttatgcaatcatttgtaaaatgctaacaataatgctactccattcatgggaggctgtagagatttagtgagagaatcaatataaaattcctagcacaagatgtggctcataggtagggctaaccagagtgaaccttcattacagttaatgccagtattactgttgatgacaatccgcagtcctcactttgcacactatcatgacaattaaaactcacacatgttggaatcatgttttcaccttgcaccgttctgtggtcacagattttcagggagagaacacggttctgatgggcatgaggtttagcatcaggagggcatgtcaagagaaggctgtgtgtaataggaataggaatagtaggagtaactgaagggttttgcactaatgaggaactcgagttagaccctgacagtttacattcttgtctttcagagaaggacaaataaaagaagtctctggcatattgtttaaactctataatagcagcaaaaatgcctcagctgggattacttggatggaaacatgcagagttgatcttggttggtgtgagaggaccttgcactcaatgcaggtcttcgtgaattgtgatcatcaacagatacatgggccactgctgacagcactgtctccatgttaaaacacctgacgttggtaggatatgtcaggggtattgttagggtcatcgacaccatcctgggttttttggctatgtccttgtggctcactgcatccacttttatgttttctgggttatttatgtcaaatctttggattatacctcagttattttagggaaaaaatgtgcatcctggcacaaaaaatgtaatgtgattattgccatgattataggctgctctaataaatatgaaacaacagttttatatggaagacaacatttgtgcaatctctggaggacattgattcaaactcacaggggccttcccttcttcattacaataaaaattgctttatttttaaaaattatataaataaatgtaggtttactgtgaaatactccgaacaacacagaagtaaagcagacataaaattgtatgtacaaattccgttcccagagagagtcaccgtaaatatactggtgaacgtgttacttagctttctacacatgtgcacatatatttgtacagaaagatacatcggttatttttatgctctctcaaatttgcttccccctcccaagaatacatcaaggacagttttgctcagttttgctgtctgcctatctgtctctctactatctatctatgtgtccgtctatctatctatcgtctatcatctatctacctatcttatctttccatccaacatctatctaatatctatctatctacctatctaatctagtctctatctcatctatctattcatctgtctgttaccatctgcgtctctattatgtatctatctacctgtttatctatcatctagctcatctgtctctattatcattttaagtaactcgctatgtttcattgtactataatttgttaaatcaacgctattgatgaacatttaaagtgtttttaaacttttcactctttcatacaaaaatgtgatgagtgtatttgtacatccgttttatatttgtcagacttttttcctgggataaatttctaaagtgaggtttctgagtagaaagaagtgcatatgcaattaagatttttgaagcctacttccaactgtccgtgcaactattgacactgtatattgatattaggcattatcaacttttttcatcattgtcaatcttagttatcaaaacagtgactttttttaatccagatgaatgaggaaactctaaaattcaattgtttttcctcaattgtgataaaagatgttccttttttgccatagaggatactttttctatttcttttccctagttttctaataattcctggtgggcttgttgtagtttgtctttattatactgagacaaagtttgattctgccttccctggtatctgttcagacctcctctgtgtacttatttattggttggggatattgtcatggtctcttccacagaatagggaatcagagccgggtgggctgctacgagctgttgaaaaggagttggggctgggtgcagtggctcacacttgtagtcccagcactttgggaggccgaggcaggcgggtcacatgaggtcaggagttcaagaccagcttggccaacatggtgaaaccccgtctctactaataatacgaaaattagccaggtgtggtagagggtgcctgtaatctcagctacacaggaggctgagacaggagaatcgcttgaacccgggaggcagaggttgcagtgagccgagatcgcaccactgcattccagcctgggtgacggagcgagactctgtcttaaaaaaaaaaaaaaaaaggagttggagggcagaaagaggtgcacgaagcagcctggtttctcctctttgccaaactcccatcattagaacaactggaaagaaaaagacaagacaataagtgtctttagggtgtgtaaactgtcattcttaaaaattccggattatgtgttcataatccccactctgtagaatggttgcaggcatctaaggctaaaccttgagttaggtgggctttctttgtgtaaatgtcagtgcagtctgctttgctggttggtcccttttatcacacccatggtgattttgagatcctttacacatgtgtatctcatccatacattgctggcttagcaccttccattgagttgttctggaccatgcttcactgtctccttctgtatcccattctcacatcatctctctgttgccacctacaactgggtgataaacccatgattgatggcagataacccaggagtattttgttttccaaagaaataatttaaatgaaacactggctattttcttgtaagtagtaagtgatagctctacttaaacagaattaaaagatagaccacacacacacacacacacacacacagtgggagggtcaactcttaataggtgtagagaaaggaaagatatgagtcaagacatctgagttcttgtgccttctatgacaattggacctttggaaaagccacttgatttttctgtgtttcaattttccaatgtataaaatgggctcagctttgatctgcttcatataccaggttgattttttgtttgattttatttcaaaagggcattcttaactaaggaataatacaaaatttaagaaccatagaactatttttatttctagggttacttccagctctgagtctaggaatctgacccaaatttttaatacaactcaaaagtagaagcctttctgttttaactctctattgagctttttattattatgaagaagatatataaattagaacaatataagcctgtataatttttacaacaaaagaccattttatctattttaattagtaatttttatcaagaatatctatgagaaaataataaaggtacctaagccattctttgaaaatgactaaatgattagtaagaaagaagaaactaagacactataaagcacaacaaaattaacagatgcttaaaatttagaatatatgttttaaaaagtgttctcactagagtaagaagtggcgttttccctggaacttttgtaaaatttgatttatatggtgcagtcaaagtgtatttaaataatgctatcttttttttttccacctagcattagtgagtttgatgagaagactgagtctgagtggcaggtcaggaactgccatcacatgggggtttgttgggaaccgttcattcatccataaagcaggataatctttgagggatgctaacaatggagacaaggtttccatgcaggtgggcttcatcccaggtgaaaagaagctcataacattcattgcagcctgaaaaggaatagcaattgtatcacggcggggtgtgtctttggatgtgggtgtgaatggagtcagagtttttttacaggtcagactctaggggcttagaagaaggacttggagattctgatgtcttctggggccagaaagagaaacgtgaaagggtggaataggtggagtgggcacctgggtgagatggggcaggtgtgcactgtctaaagagatcacctactcagcttcagtccacggctgctcagtagaaatgctggtcatgtgtcactaggccatctgctttccaagagaatgtgcccaccctctgtcgtgatcttgatgtcatgacccctcacttgtgctgagtacaattatctaagaccattgccttctttccattatttattttattttacggttttccaaatcacagaccagcatcgagctaccccaaaaggatatgaaattatatgagtgtctctatccagggtgccctctgtcttgatttaaccaaagaaattccagaaaccgtgtacccgaaaggaaaggaaccaagggttcagaaagtatgcctggcaagtattggtggctttttgttttgatttgtttctgaagaaatgaatgttatcttatcaaatgcacaacagaaaatctcttaaacaagctgaactaaccaaataagaggaatttattacaaggatactgtagcattcttcaaactcaggggaagatgtgtaactcagcctcttgagaactgaaacaagatgctgcaaatatattagaaaacaggcattagctctctccctctgcccatatggcactgtagggaataaatgtacttcaatgaaaaactatgctatattagcctgctctcacgctgctatgaagaaacacctgagactgggtaatttataaagaaaagaggtttaattgactcacagttccccatggctggggaggcctcaggaaacttacaatcatggcagaaggagaagcaaacacgtccttcttcacatggtgacagaagagagaagtgctgagcaaaaggggaaaagccccttgtaaaaccatcagaactcgtgagaactcactgtcatgagaacagcatggaggtaaccgcccccatgattcaattacctcccactgggtccctcccatgacacgtggggattttgggagttacaattcaagatgaggtttgggtggggacacagccaaaccgtatcacatgcgttggctcttacacacttttccaggcagtacaactctatccctgttcattgactttgagctattttgtaactctttgtaaattggaggtaactgatacgcaaactctgtcttgtatgatagagtttcaactgattctcaaaaatgtctacagttttgccttcttttgcaattcaactgatttgctgtatatgaatttgtgcattttcccccttgaaccagttatattatctgtccggttgtctcatttgattaatgagtaaaataaaatcatttacatgtgttcattttttttacctgtatggaagtcatgcttttatctttttttctgaaaagcatctcttcctatcttgcttttactaattctgaatgcacaaagatacatggctcccatgctgactttgcaagatcttgcttcaaaggaacagtgcttctaaatctcaattctaatttcctcctagagaaaaaatatgtttttaagtgtccagctggcatgattctacgtttgctacaattgagcgtgaccagagggtgatgcctgcactacctactatcatgtttgataacagcccagaatgttgggatgtggagggagaagttctcaggagtgtgtatgttgtatttgtgtgtgtgtgtgtgtgtgcatgagcttttagtgattgggtgctctgagtggttgttctgcacagtagatagtcaagaacaagttgattgccacaaatgtcagggctgtagaaacagaattgggatatctatggggccaaagaggacctcaaacaggaacaaacagcacacatccttcacctcacaaaacttcattaaattatgtctactatgtaaacccgttgctagaggttcttgtgtatatgaagggaacacagaagagacacatgactcacagttattcaaattagtggccaggtgtggtggctcaggcctgtaatcccagcactttgggaggccgaggcaagaggatcacttgaggctaagagtttgagaccatcctgggaaacacagcaagaacttgtttctgtgaattttttttaataaaatcacccagttgtggtggctctgtctgtagccctagctactttggaggctgaggtgggaggattgcttgagcccagaagtttgaggctgcagtgagctatgattgcaccactgtactccagcctgggtgacagagtgatacactgtctcttaaaaaaaaaaaaaaaaaaaaaaaaagttagtgtgtgataagtcctataaatataaagaattccaggtttatgggagtttgaaataaaggtctatgggagtttggaagaggagaatatgacttcctctttgagggaattaaatttgtctttatagtataaatggcatgcagtgaagaccatcaataagagaccgggttggaacatgggtgacaaggttgtggtggtggggatagtagggtttagaagggtttcacatgttctatatgcagggacagcccaagccaaagttcagaatattcagaagcaaagaattatttggtggaagcagggaggtgtgaatggtttgagcacgttgacacattggtcaggctgggtgaagagatattcatgtttggggatgaggaccaatttacatactctaatacaaagcatgattcttccgagggctcacagccagcattgggagtggattttctgaacccccttaatgaaggatgcaaacatcagaattcaagtcaagttaattttatcaaataaaaacatgtttattctaaggacaaaggggcatcctgtggcagcaaagggaagttggacctcctaaaagacaaaaatcagaaagtttctggaaggtctgatttacatcattaatgtaggtgagacactatatagccacgggccaataaaggcaagataaggcttgatttacaaaaagccaagaatctttgaatttatgacatcatagtttatctcaaggaagctttaaacctgtgaatctgatatctaaaatagtataaagcagattgaggtgaattttaggagaaacatttttggaacttctcacagctccagaactgcattctttgaacttaaaggagttcttttgcttagagtttggtatgataaaaaatattttccatttctactagctgtttttatccttttggcattacaaaacaatttattttttatttattcttttacagttgctgaaatttagacagccgagtgagagatttctctctaacctaggagacaatttgatggttgtgttcatatagaagcatcttaactgaattctgaatcctgagggcatggaagattgaaaagtgccctggcagaagaaaatctagcaaaatttctattattcattggaaaagcagggaacaacaaatggaattcatgggtagatgcagcaccattgctaaactttcacaggataagccagcagaggtagacaatggattggaatttaaatcaacctctttagtccacagccacatggtgtgggtataaatgatgaatacaatggccaaggagaaagaatgggaaagacaagagtcatagctaggaagcattggttggagagtttaaagaaaaacttcgacagagtcactttctaactttataatgtttttatttcaagtggatatctttggttgtgaaacatatgtagtccccgaaactctatgcatcagaagaaataagtacagaaactgcaagagtttttgaatattgagaaaccataattcaaatattttgatttcacaaaatcaataatgtattctctcattttatttccttttatggaggcacatgtcctcttcaaatacacacacacacacacacacacacacacacacacacacacacatatatatatatataaagtcaagagacaatcttttataggtaaagttaatctaacagaagaaaacaatgaagtaaatcaggaaagaaaattagtgttcccttcttttcttttggaaggtagagcaatcaaaaagatggtcagggtttgaaacaatttgaaaacatactagaagtgaatcttctatgttgaattaattgaaaatatattggggactgaatctcataaaactggcaagtagagatgaaaatacatgcaatggagataattcatgtttattgcactcttgtgaccttataattattggttttctagtctatttaatattgatgtattcatcatgtgatttatagctaatattctccttctaagatggcaactcaatcttgatatattcagtgtattcgctcatcaccagattttgtatcctatcattcagaagccacattttccatgctcataaatgcttgtatgtggcaacatttgacatttgggaaaattgttattttaacattattttaaacatacagaagagttgcaaaaatgtaacacagaactcttgtaaacattttacatagattgacaaattgtttgcattttgccccatttactcactctcttttcttattctttctctctgtctctttctctctcctctcccttgaccatttgagagtaaattacatataatgatctttcattgttaaacatttcaatgtttaacattgaatgttctttagaaagaacaaagacattcccctgcataactacagtataatgatcaacatcaaaaaatttgatgttagaaaccctagccagagcaatcagggaagagaaagaagtaaaaggcacccaaaaaggaaaagaagaagtcaaattatctctcttcactgatgactctctaactagaaaaccctaaagactccaacgaaaggctcctggaaatgataaataactttagcaaagtttcaggatacaaaagcaacgtacaaaacttagtggcatttctctacaccaataatgttcatgttgagagcaaaatcaagtatggaatcccatgtacaatagccacgaagatgacaataatagacactgcagattactagagggtgggggataagcgttgaaaaactgttgggtactatgtaaaacaaagtctgcacatgtacccactgaataaaataaaagttgaaattatctttttaaatattgaccttgatacattcctattatctaatccatattctgtatttaaattttgtcaatttcctcaatattttgtatataaaatatacatacattccaatcataggtctaatctaagatcacacattgcttttagcttttctttaatatgaaacagttcctcagccaattatttcgtagactagtaccaaaaggtatatggtgaccaatatttacttttgatattccgttgattcctcactgagctggtggagcacagatattgtagaacatacagttataggatcaacctgaaaatgacaacaaaaagtcagtggtctgggtcctcagagaaatacttgagattggtaatatgttgatttagttttgctcttccactagggtctttggccaggaggtctgaaatttaattagattcaggtcaactctaaggttcctaggttctatgataaatatagccagaatagtaaatgttatgaaaaggaacataattgggcagtggaaacaattatgatttaggtttccatagatgcaaagctatgtaatgtcacacacttggattcttactctttgagagtaatttgtatcatcattcaggtactgtttcaccttagtccaagacagaaaattcaggtgactaaggtttcttgaccaagagcacagcagagactctggtccagggacaccagcctgaaaaccaaaccctggttagaaaggattgatagtgtccttgcattatgtttgctattacatttccactgttaaacaattgtacacattgatatggtttggatttgtgtccctgcctgtattagtctgttctcatgctgctaataaagacatacccaagactgggtaatttataaaggagagaggcttaattcactcacagttctgcatggctggggaggcctcacaatcatggcagaaggtgaaagaggagcaaagtcatgtcttacatggcagtaggcaagagagtgtgtgcaggggaaaccctctttataaaaccatcagatctcatgagacttattcactatcacgaaaactgcacaggaaagacctgacaccatgattcaacaccatgatttaattatctcccactgggtccctttcatgacacacggaaattatgagaacaataattcaagatgggatttgggtagggacacagccaaaccatatcactgcccagatctcaccagatatcatgtcaaattgtaatccctagtgttgaaggtgggccctgatgggaggtgattggattatgggggtggagtgttcatgaatggtttagcaccaactccttttggaactgtgtagtgaatgagctctcctgagatctggttgtttagaagtgtgtggcacctccctccttcctcctgctttagccgtgtgaagtgctggctcctcctttaccttctgccataattgtaagttcctgaggcctcccagaggcagaagccaccatgcttcctgtacagcctgcagaatcatgagccagttaaacctcttgtctttataaattacccagtattgggtatttctttatagcagtgtgagaacagactaatgcaacagtctatttcaaggattgagtttttccttagtgtatcagtccattttcacactgctataaagatattaccccaagactgggtaatttataaagaaaagagttttaattgactcacagttccacgtggctgggaaagcctcagaaaacttacaatcattggagaagatgaaggagaagcaggcacctctttacaaggcaacaggagagagaagcaagtgcaggagaaactgccacttataaaccatcagatcttgtgagaactccctcaatgtcacgagaacagtgtgagagaaaccacccccatgatccaatcacctcccaccatgtctctccctgacacatgaggattacaattcgggacgagatttgggtagggacaaagagctgaaccatatcacctaggtatcattttgttttcctcaaagactcctatggtatacaggattatgttaagattctgtaaatgaacccggagaatccagtaggcctcactgaaactctcctggtgcacaaatatgagatgacatgttacggtagctcatagaattggtagcccaaagagtggctatttcctctttgattgactcatgaaaatgaaaggacttcctcagacccaaagaatcccttggaggggtgaggaattcccaaggaagcccttcctcggtaagcacatcaatatcacaaacatttattggatgctgctgtagttgtttgattaatagaaaggccagtcccgcctagaattgggtgggtaaatgctagaatgacaggaataagacaggaaaagttatcaggggtcagtttatagagggttctgggggttgtagaagtagcttgaattttattataaattgaataagaatccattatagaaatataacacacatagtcttaatccatatctccactgaatattacctaaaatatttaccttaaaaaatagtgtccaagaaacagaggactaagtgaagagagagatgctgaaatgaggaaattgctaggttatgtgtgattcaattggaagatcaacataaaaattcatagcagaatatatcaattttggtagtatcagggacaaggtggctaaggagacaagatgattaaggatgaggtttcaatcttaaccttgatgaagggaagtgagatagcaactgtagttagacattcttgtctttctgtttcgctctgcaaatatttaacaaaaggaggtggcctctggaaagtgagaataatagagaagggaagtgcttggggaaatgatgaggggaatacatgggaatctgacactttcttcagtgatgattaggcaacaggagctgggtgccaagatgctggggagttgaatgtatgtccaaatatcaaggtggcagtgctggaagcatcagtgtcaaatgcaaccattctgctacggatttgcttagattttgtgttaggtttctattgcttccagaacctaacaaatcaccaccaaccaagcagctgaaaacaacactatttttttatctcacagttcttcaggtcagaagtccagatggacttggctgtgctccttgtgtagagtcttataaatctgaagtcaaggtgtcgtctgggctgggtcagagggggaggatctgcttctcttctcattcagaactaaaatccctgtttcttcagtggcttcagcctgggattattctcagcttcaagaggtgacctacactccttagctcataccccctttccatcttcaaagccagcaaggaaactgaatttctttgacttcctctccgcctttgtttttatattttatttatttactaagagatggagtcttgctatgttgcccaggctcgtctcaaattcctgggtttaagcaaccccaatgtgctgggattacaggtgtgaagcactgtgcttgccctgccttgacttttaagggcacctgtgattactttgaaactacctggaccatgcaggataatttccctatcttaaagtcaaatgattagtaatgttaattacatctgcaaattccctttttccacataaggtaatatgttcacagtcccagggattaaggaatggaaacttctcaggggtcacaattgtgcggactccagatttcaatcctagtgttgcccttccctagatgcattgttttaggcaagtttctgcaatcctccttctcagtgtccttgaatgggagatgaagaaaatgatggtaactacctcaaggggtgtttgaagagctaagcaacttcatacttgtccagcaaatagaatgatgtttggcaagtggttagagttctgtaactgtcagctattattttaaagggaaaacataaacggagccacgatcaaaagttagagatgactcactaatcagggaagaacagggattcaaggtcacagccagtagttagactgagtctaagtgggtaagaaaacagcaacaaattcctcctgcaggggagttgagtttagttgataagcaaggaagcaaatattatttcagacaaaggctactcttctgcgttcctccaaggaaaaagcaaaaccaggtctgatgaaggaggtgatggaaattcagcaactcctggctgcgggactgcacttagtatgcatactctagctagagtgaattgtcagtgtgagaaaaccaccagatggccacattctggaggactttccacggaagtagaatgcccagttatttctcagtttacaaggggcatccatagatcccactgatggaggttttctgagatctgctaaagagatcttagaaatgtgtttaatgttgtgcaccaaaccaggccattaaatcaccctgcctgaattttaactgagatttacctacatttcataattttgtctgcttgaattttcttctcttccccttttcaaaatatctgcttcattttgtcatggaagatctgcttcaaggatcttttaaaacttgtctagattcattgactgcccttaggacaaagagagtgaacaaattacctttattttcctttgatgtagtgtatcaaccatgcttgtttaaaaccaaaaaggaagagactgtggaaaaatgaggtcagcaaaggccacagagaagcatttcttaagtttcagagaggatttaaagttttctacactatgaaactattaaaaataaaataagacatttttatagatttttttctttatttctgtgactcccattagctgagaaaaagatattggttctgtgtacagagaataatgggagattaaacctcttcttgattcagctgcatgcaaagattgttgaattttagactgagaactttttgaaaaaggtaattgggaaaagttgagctttaaattgaaattttctttctatctatctatctatctatctatctatctatctatctatctatccatctacacacaatgtataatgtctctttttctctatatgtagagatacatataatgttaaaaattatgctatatatgttatacattgtaaaattgttatataacaatgcatatatataacataatacttttcactgtactataattcataagttatatatgtaatgtgcttaatatatataacatatacatgtatacagtgttttctatataatgtgtatgtatacaatactatatataatctacatttgttataacatatatacatttatagttatactcacacacagacacacacaaacacacacatatcacttggatatacttagtattatgaaaaggaataccttttccaacttttcactattagcccaaggtctaaatagataatctttaaaaccatttatataccatttatataaatgtgtaaactgtccaagaaatggactattaaataaatgaatttttctccatgtcacagtgacattctgagtcaccagcaaggagaagtactggaatcttccctgaagataaactaaatattcaaccttgttggtccacatgcagtatctttttacattttccacacacaatgctttacgtacatagaaaagtgttgacttcattctccctccaaatggcatcctatcattcactctctgatcatttcctctgtggagtgaaaggcctctgcaaacagccccgtgtcacccagggcaagctggggctaccaggcagggggacaggcaggtcacatgtcctatgcacagtccctcttttggggagaagaggagggggcactggtaccaggtacattattgtccagaaaagagacagctgctctgtgttatcctgtggacaacccggttgtctctctattgtaacttttataagtaaaaagaaattaagtgaatgtctgtaagtagtttctttaaaattatttctcatcggtaacagtaactatctccccatttacctgcaagagagctgatgtgtagccttgctatccaatgcaggcaaacattgtaattcatggtataatgcactaacctaaaagagttctattcattcatgttaaaattcaatatatagtgatcctaaagagatgagtgtaatctcaatccaagaagtataaaccttcatgcatccggctataaatattaaaatcaccttataatggagacatttaatgtgggccagcgggggagagaattaaagtgagaggaaaagatgaacagtgatactctctttcatataattattttcctcttcagacttaatttgatattatgcgctgttttcccataatgtgcaatagtattatttttccttttttatatcgttctgagctgatgtgaaaactctatcatctcttatgtccttttttgagccaaggaagtcaaaacattctacccctgaagtgtggtttcctcctcctccttctcctaattattttcctcctaggatttacttttcagtcttttgttccccagtctaaatccattctctctggaaacacatgtgaagtatgatctttttagtacagtgactatatcctcacccgctttgtgtttctagcctcactggactttatcaaggtaacctcatgcattcataaccacctgctgtcgtatgtgtaccctttaacctccagctgtaagataaacttaagtcccataattcctgtcacagaacactcaaaccatagggaacttatgaattacttgatgggaaatgtgggatgattcattcattcaacatgtatttattgaatgcctactatgtgacaacatctttctacgtgcaaggtattatacagcaacgtataaagaaacaaaaactcctgtcctcccagagctaatactgatgcgtttgaatctgaggatgactttactcacagagttatagataatgtagatcttaattacaaactactatttttttgttgaatactcgaatttttgctgtgacgtgaggtttgtaagcattcttcttttttttttttttttttttttttttttttgagacagagtcttgctctgtcgcccaggctggagtgcagtggcgcaatcttgactcactgcaagctccacctcccgggttcacgccattctcctgcctcagcctcccaagtagctgggattacaggcgccagccaccacgcccagctaatattttgtatttttagtagagacagggtttcactgtattagctagggtggtctcgatctcctgacctcgtgatccgcctgcctcgacctcccaaagtgtgtaagcattattctaccacacttggctttcatgttttacttctgcccttgggaatttgcttgtgattcagaacctgtgacttcttccgctttctttttcatctgccgttttcttagcctcacatttccatatctcctaggattagtaattatcttaaaataaattttgtgtaaaaaagaagcacggtttcattgtttcaaaatgggaattgtcagctccagaaatacctcaaatgtccatcaaggtctatcacattatgatttattagtcaggctggggacgggggtatgcaaggcacagataccttcacgggccagcttaatcaataaaaaacatgtgtcatcttatacatacatgtgcctgatggctccaccagagccatgtagattagagggaaggccttttcttagtgggaagaggatggggacctaaacaccacatggccctccttttcctctcatcccaagttagtgcataggcagagttcatagcagtaagctctggagtcagaatgccaacatcacatacctgttccaagtataataactccaccttcataagctactttttgtccacgtgtaagatctacacccaatagactctatggcattctgataccatgaggattaaaagcgacaatagctgttgatcaaatgatacaaaatgtcaattagacaggaggaatattaaggaacatggtaactactgttagtaatgatattgtatacttgaaaattgctaagagagtagattttaaatgttcttacctgcaaaaaataagtatgtgaagtaatgcatatgtcaattaggttaatctagcctttccacaatgtgtagctgtttcaaaacatgttgtacatcataaatgcatacaatttttatttgtcaatttaaaaaataattttttttagagaaagacacaatagatagaaactgagtagcacaggctctaaaatggagtgcctgttcagttaatgttaactcttattaatcaatgcatcattgatgatatgacatccttgagacatagactagctattaggatcactcttatgaggtatacattctttcagatactcactccaagttctgaattgtttataattactcatgagaaaatggagccagaggttacttgtcctggcaaagatgaagacagaggaagaatgtgggctttctgcttcccatggcacgaccctacttactagcccccaaatccgcctctcatgttatgtgtgatcttggttaaatgtctcctcccatgctggtcagtggactttttctctaaaaaaaaaaaacattatttagtaccttcaatcacaaaagctcatttctttgtttgtctgaaatatgcttactttagatttcaaggtaattttctatggccctcacagaccaaatcggtgtccacaacacttagcatcttattctgttttgcaaactgacagatgtatgtcaccagtaacaagataaaaaagggagtggaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggtgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaagggagtggaacatgactcttctggaagacccattcttgcccactccgaaccactacagatcccaaaatggtaacattcttctgatatctgtcatgatgggtgagttctggttgtttcaaatgtcctgggagaccggtggactctttttttctttttcaccctactgcagaattgataattatttttataacttccaggagggaaggaggtaaatgtggctgcaactgactcagttgacactcttatcacttaaaaatttccttacaaatgattattaactagatgatcagagcctattttatatcatggatttatggagattttgagatttctgcatcttctctttaaacaaaaatatgtgtatgtactgatcccaaaacacatttgaccccacgggataatgacctgttttctcaaggctgattagatctttggatgtttgatcttcctatttcattttgactcatattttacaattaattctttgacctactgaccttgggattggacttccaatttttttttcatcattctctcacttgttccttttctctctttctctacctcattttttcttggattttctattttaccagaccaactgtgcacaaaatatgagtaattattatttagctgcagaagattgaccgtgtctttatcaggaagccagagtgttatgtttaggcagattctgtttccactaatggggatacagtaaacatcacttcatttgcaagttcataccgtccttcacacgtaaggaataacatgatttgtcatattgagctttttctcacagttagagttcttagttttgtcaggaaactttgaaatagataaaaaggcacaaatttacaatataaggggaatttcctgttacatttaagaggaactataatgactgaaggaaattaatctttataaaggtgctttaaaactacatctaattttacataatatggctacttagtaagaacacctcaccaaaaaatagcaaaatacaggataaactgaaattatagtagtttcttagaagtgggactatttcaataagagaaacactctgttaactgttccttcacaggtaaagattctaaagtaatttcacctaggctatcaacacttgaaaatttactcaccagtgatttttcaacagtcaaaattggcttttctcaatttatagtgttagcagaaaaggcaataaacctcatctagcaaagaatagaactaatctactttgaaccaaaattagagcattatttgcatcaacaagtaacggttcaggagcttgcctgattctaaattcagctctgagcaacagctaagttggtgctcaaagcccactgaacagtaataacatgttgtatgctataaaatgttttacgctaaggtacacaccaaagctcatggtggaagaagattccaaccctattatcatgtctagtgatattaattactgtgcctctcataccttctaattgctcactaaaagacatacaagtcatcatagaattgcaaatgtgtacaacctgaattcttccattcttcattagaacctcgggcaccaagctttcttttgtttaatttttaactttcattttaagcccaggagtacataggaaggtttgttatacgtgaactcaagtcatgggggtttgctgtacagattatttcatcactcaggtattaagcccagtacccaatggttattttttctgctcctttccctcctcccaccctccaacctccagtagaccccagtgtactgtttccttttgagttcatgagttctcatcatttagctcccacttataagtgaaacatgtggtatttggttttcagttcctgtgttagtttgctaaggataatagcctccagctccatccatgtgcccgcaaaaaggcaagatctcgttcttttttcaaggctacatggtgtatatgtaccacattttctttatccagtctatcactgatgggcatttaggttgattccgtgtctttgctattgtgaatagtgctgcaatgaatgcacatatatatgtatttttatggtagaatgagttacattactctgggtatatacccagtaatgggattgctggttccatgtgatttcctgaacctatttcctcatctgtatacttagggtatagaattagagacatggttagcatagtggtggaaggtacaggaggaggtgaggctttagacctagacctttgttgatgtaaaaggacctgtgtggcctggatctgtgatgcccccccaccttaggctgagaaccctgtagtggatatctcaaatattgtcatcatcccgatgacaggcatgaagagcagatgcagaaagtcatagcaaaggccacctccatagaaagcaaagcagaacaaaacacaagcaaaagggttaagcacggtggcacacaactgtaatcccagcactttgggaggccgaggagggcagatcacttggagtcaggaattcaagtccagcctgaccaacatggtgaaaccacatctatactaaaaatacagaaggtcgctgggcacggtggcgcgtgcctgtaatctcagcttctcggaaggcagaggcaggaaaattgcttgaacctgggaggcagagattgcagtaagccaagatcacaccactgcactccagcctgggtgacaaagtgagaccctgtctcaaaaacaaacaaacaaaaaaccacacacacacaagcaaaaggagacacaggtatacctgcacaccctatggatttaaaactccatgtcaaactccaagtgtttatttccaccttcaactctgaattgaggaaaaaataacaaaataaacacttttctatagttaggtgctagcaccaatagactcatttgttacattttaggacctttttgagagtgaatctgatggtaggtggatggaattgatttaaatgttttaaggggtcccatgtatattcaaaaatctagttttataatttttgaaatctataatttcatgctgtgccaatagacagatcacttcttaatcagtgatattatttaacctttgatatttcacatccaacaatctttttaagccttaatgtttaaaggaggttttggaaaatatactgttacaaataaagttggttggtaacctggaatatttcactcagtgttcaaatgacattttgtgtcttaataaatccttctatggaaacaaatataagaatacaaaagagcattaaacctttcagaaactgttgcatggaaaaaataaaacacagcccccatatttttctgttaataaatacgtgacattaatatagtaatataacaaatagaatatattaaatgaggaaaatatatatttcacaaggtggttcacatgcattctcaagaaaaattcaaaacatttaagctttttacttaaaggaaaaaagaaaaacagagacttcaaagaaaagtgtaccctaaatcaaccatttacttattcaggtagagaagataatcacatattcttagactctatgtcaaaattcttaaagtcacttgtctcaataaaaataaattttattcaggtaggttcaatggaagtagctatttttgttgacaacctggtgtgtttgaggaatgttgcctaaactgttgctaagccttaccgccaccctgcaaagtgaattgtgcagcgcacatgatacagatgagaaaatggaagctcataggcaaaaggcatttgcaggaggtccagaaagcagctacctccccctcaggaccctgaccacatcacgagtgggtgtcacctgtggccacattaaccaatgccccatagcgggagaatatgatgttgggacgggaggttgtgaatatgcaccacaaagatccttgaaaggctatgtaaggactttcaaattttgataaactttgccaatcaatgtaaccaatgcacgaatataattaatatcccttcattatcacccccaaaggattctggaaacatagtaattcaactggcatttattcatccctttttctgttctctttgtggctattcatttgttcttcatctgatcaacacacacatatatattaaatactcagcaggagctaagtcttatctttcctctttcttcattgagctaaaacaaggatgagctttcaaaaagggagatttttctttaaaggctaacaacccattcccagctactgtggtggtttctcaccaactttagttaatactagtgcctgggttcttaaaacacacaaggcttggttcaggctattaggtcaattggctcctcttgagtgtgaaatataacttttggtcatttctatatggaacgaaataacgtgctgatttcatgtgccccgacacttccatctcatcttgtagttattttgaaattgttttcttggaacattgttttgagagttttgaggattctgagttcagtcagcaaaggtgaactttgaaagtcaaagcatgctacagcaaaccgaaaagggtggatttggtgagcggttggaatcacgtaagcacaaaggttttcctggccacattacagaccctatttgtcagttttacacaccttctttacctgtagcggtggagagatcctggcttgcaaaatcataaaggaatttatggactttatggagatttatttaaaaatgaggtggggtcgctgctaattcagaatgtatgaagagtgaacttgggtaaaaggcagtgcagttgctgggctggaagccagaactcagaatcattgtaattgtagatgaaacaataattatttgtgattgcttgctaatcagcgaaaccaaggaagagactgctgacaagtgctagctaggtaattaaggtgaagcactgtatttgcatacatttacactttgatcattgtttgcaagattctctctccaaaaatagtcttggcttctttgaagatacaggctaaatcaaagtagagggtaggagtaactgctgtacatcaataatgcttaaatttcccccaaccccatagacaattatctaaagactctcttaattttaagatcaggctcatcttctgtttttataatattatttaatataactaattaataattgttttttggcatcttcaatccatattgaagtttggaactttgcaaacacattcaatgtgcctgtcaagatgtgttgttattgttgatacaaaaagtcttgtattccctgtccacttgctgaatggcctgttctaacatttatgcagaatctggcattaccactttaaactaggagtcaaatagtttacattaagtgaacgcaataccaagtaaatgttttatgcacgattgagactctagttttactaaacttgacatgtggatttcaaatttagagtaaagcataatcgaataggaaccttgcacaggataccccatgtgaaaatatttgaatatgtggttcagactttctttttctagttgtatgatcttgcacaagatcatacatttgtctattccttagtttccttatttagaaaattaaagagttggcccccaaatatcccagtaccattgagatctcttccaatgcctatagccagcaataatcatggtaattgtatatattttgtattgtttatatgtgtattatatatattttgtattatatatgtgcatattatattttgtattttctatatgtccatatgtatacatgtatatatgtgtgtgtgtgtgtgtgtgtatgtataaaatcattctaaaattccattggtttggttaacaaattattggcagtttgtaatttcttaagaatctattttgttcttgtaaacaaatatttcattactaatcctaacaggtaatcatttttcaatagtggagctttgcaaatggactttagaggccaagtacaccaacagacaatggtaagaccatatatgacaacagaactctgtcctaccacccattcagcacccagttctgggatccaaactacaatctctgcaacagtcatccccagcaatcaagacttcatccatttctgccagctttcctatatttttcccctcttccaactcagaaccaaccagggaaagtgaaatatgctccccaaaccaatgacgtgagatgccccactttcggacagctcacctgaggttcccccatgccagcaaactccaaatgcggcacatccacagccttctccttttgttagcggtggaagagatccaagttaccttgagttgccagcggcgaatccgtgtgtgtctgcagcaacttcagcccttgcctcctcagaagaaagagtttgactgaggagcataaagcagaaaaagagaccaagccaagttctagagcaggagtggaagtttattaaaaaggctttagaacaggcaagaaaggaaagaacccttggaagagacccaagtggccgcctgtaggtcaaagagaaaagaggagaaactttagtcttgtacctggactttatagggtactctctttcccatgattctccccttagggtgggccttccacctgcagtgtcctccttacccttgggagatgagcatgcgcagtgtgtttagggaattgtatgcatgcccatctgaggatttcttccttcttccagtggagtatacctggaaggtcatacgtcaccatttttgtctcttaatgcgcatgcccaggaagttgcttcatcctggggcctgcctttagttaacactttaatgttaagaggtgtggaccagcagcaactagcctcttcctagtgctggcaatttatcccttttagagaggcaatgccataattgctgaaccatcacctgatatttccagtgggggtggcggggagagtcagctcatgcctgactacctgtaacactttaaagtattctcactccccactggcctttgagtctctgccaaatgcaagcgatagtgccggactcccttgctagagcaagctctgactaaaaagtctctgctctcattttggaaagaagggggaagtctttatttagttccacaaacttaagatggtttttgatacagatggatagagtaggtacaggctgaacgcctcactataattattattgacacgggctaattttcatattgcactatagctttttctatttggggggaatagggaataatcatggttaacttctcaaagaataaaagagtaatgtttgctgtttgtttttttaattaaaaattcagcaccactttcccagaaaaccctgtcttgtcccttgttgttgttgtttttctgtggtatacctcaagagttgtagcagaaactgtagtcagcaaggcaaacagtgagcacgggtgtagaactcagggagttgaggaagaagtaggaagtgaatagtcagtcattttaacaaccattcaggaagtgaacagtcagccattgtaagagttgattttgtatagaaacaaactctgagtatgtatctaatacctccccagaggaaattttagcaattggaaggcaatttatcagatggttttggggaaagatgagattcagggaaagtatatacagctgaataggagcttttctttgtgcaatttgctacatctcagtgctgcccacagatgatgaaggtgtttagcttcaggagttctttgtgtggggttattttgtctgggttttttacgctgttgcatcatgagatcccaggcatccacctctgaaggacttctcccttataatgtgctgtcttacctgtgggcatttgtaagaaaacgaatacaagatgaagcactctagttagacatgtgtgatgtctctcaccatccaggtttctgtgagaaactaatgaaggccctttggtgctgtctgttctaagagacaacccttggtctctccaggaatttcactgaaacaggacgtgggtgctttgaagaagccaggaattgtacagtttaatgctaaggcaatttaagcaaaagagactcaagaacaagttgtgaatttgatcccttggaaaggaaaagacagacaatgtttctgaaaatataagcttttgaacataaaatagagaaattgcacgaaagcaatcttctatgtttgatggtaatttccatttctgtttcaaccgctccttcagataaaattacagtggagcttgcctttctatttaaccagtctctggatacaaagtcacctgaaatcttcaggtattgacagcctttgaaatatcgcttacagaaaaggcacctctaaaacatgtatcttgtgtttctttgtaaaaagaaatgccagtaggccattaggtcagtatctacctggctagccatcctaccatttgacattaaggttgatcagaaagaaagggcattgctcaaccgctcttacaaaagtccattgagatatttttagtaaacaaaaatttggtaaacaaggataggaagttaggatatttacccactgattcccatctcctgttggtttgaaggtggttctcagggttttaacttcctaacatgaaagtcttttttttttttttttttaaagattcagggggtacgtttggaggtttgttacatgggtatattgcctaatgctggcttctattgaacccatcatccaaatagtgatcatactacccaatatgtagtttctttttacctcctttcctctctcactctctctttataaaagtcttcagtatctattgtttccatcatttatgtccatgagtacccttcgtttagctcatgcttgtaagtgagaacatgtggtatttgactttctgtttctgcattaattcacttaggacaatagcctccagcactatgcatgttgctgcaaagggcatgatctcattcttttttatggctgtgtagtattccatggtgtatatgtaccatattttctttattcaatccaccattgatgggtgcctaggttgattctacgactttgctattgtagataatgtaaagcaatgaaacctatggcatattggcattcttggcctgcacttctatgagctgaattggaatgaagccatggaacaggacagagattgtcaaaggcggggcagaggtagtgttcctggagctgttcacttcaacagtgctgaaatcagaggcaaacagagggtgccaggagggtccctgtgtgagacaggtctcatgctcttctatgagataaacatattatggcttggagaaacatagacgaaagagtaataaggtaaaatatattcatagagaagttagttagctgtttttttcccacaattagaatgaatgaaaggaaaaatcaaaatctaagtttagaatagtgatctggaatgagcctgggtttcaaagtcataaagatcagactttgtagtcaaaggaagcttaaaataaagaacaagcatcatactcatcatcaaaatgagaattagctctgtcaatgacactcttgtgctctgtgaaatttgacattcaaagcaggagaatgaaaggaaatgatggcaaagatggaacaaggctgtggcatttgtcagagggagaaagaacctggtttggtggaagttcggtggaatcagattataaagagtatgaagagttaaaaaagaggcctaaatgagaaacttgaaatcaataagttttaaagctcaaatgtgaagtgaatttattttgactgggttagattagtttataagtgactttgaaaaaaagtgctggattttagttattcactaataaaaaatgcatgaaccctgccgacttccttgatgaaaggcattttctactaagtcagccctttggtcattcgcagaataacaatatatagacgcactagccagtatatttgtctagtatacttgctgtacagtgaacatcttgatattctattgagtgaccatcctattaaaattgccattaacaagtgtatggcacgagagagaaacacaagcagctttacaccagagttacaaaatcatttgttattgtctatctagtggaattatatactgaccactgtatataattctgaagcatttccaccaaagtactaaatgcatttccaccaaaaagatagaaatagatgcaatacaatgaaacccacatcagtggaacagacctgaagaaaaaccagctgttgaggtagtggtcattgctatggaataaaatgccttttattccatattagtgttttacatgttagtgtagtgggttaaaaatatttgtttggggagtcaggaggaaaaagtgggaagggggtgagggataaaagactgtaaatcggattcagtgtatattgctcaggtgatgggtgaaccaaaatctcacaaatcaacaccaaagaacttattcgtgtaaccaactactatctgttccccaaaaacctatggaaatatatataatatatatgtttatatataatatatatatataagagctgtaatctgagagccacaaaaatagaatgtaacatatttatgacatagtaacagtaattccatgtaaaaggcagattaagattaattaagattaatgtatatatttgtgtacatatttatatacacatatacatataaatatatatatatttgtttgtcagtttactcaaccatagcttaatctgccttttacatggaattactgtgttactatgtcataaatttgctacattctatttttgtggctctcagattacagctctgcgcgttttatacttgttttcttagcaaatacaatacttagcttattttgttgttagtatttattgacatatcctatccccaagtaacacacagcattaaatacgaaagtgtacctttctgtttctcgggaacatgccacacattaattagcagctggacttgtctgagggtcacttaagtgtcacatcaccaccaactgtcaatactgtcttctgtattgatttccactggatggcatattttctgcagtgcagggatcttggcttttaatttgcactccttttttcattcagttcccaatttacagagtgtcaataaggtgttagcaacttcaacatagcttgtcagggctctttcagcattttaggcgtatctccattgtagcatgacactattttatgattattcatctctgcagctgtctgtctgttagcctgtgaactcttatggtatttattcttgtatctttgtcttcccatctaacttccccaaaatctgcatatacagatccatacatcatactgactgtatttctggactagtagaagaccctacttgtcaaatgactcaaataatggcaccccatcatttctcaagctgtttgtgatctgatataacagaagtaggcaatcatgtgtctgattaggtatgtaaatatgacttacctcttgcttagtctggagaggctatggaaaagaggtcaggaaaaaagagccatctgtaagaggattccttagctggaagatgaatgcattgccattgtgtttataggatgtatctttttgtatctttcatctcaaatatcctgtcactcccatgggaatacttcttgtttttaagaaaaaaattccaaacatctttgattcatcaagctaataccctgtggacctcagatagtgtatccttatagacttcatggaatggcacacaccttcccctgaaagtcagagctaaaaattagccagtatctgcactttgccccaagccattaagcctacacccaatttctgcaagggaggatggagccttacttggacatgccatttcctgatctctgtagcacctcttattgatatttcatactcaacccttgattccatctagccttttttctttccactggttcctgctaatgcaagccttgacttttcattcctattatgcattcttcaatagtgggctgtgtcatggattgagagcgcctggcggagccctggatacatggcagtttttcaataagcagttgtcggcgggcagccctgagagtgtgaattatgagtactagcaaaaggcaaggttcatttgcataattataagctgaagaacggcagaggaaatgaggtactgaactgctttggaattgttctggctgctccagtatagttcacattaacaaattttattgttaaaatttaaatattccaaaatgtaaatattccaagtggaaatttctggaagagaagtgatatgtgttgttgtggaaggggttacaataacatcccaacacaccccagccagtctgcaacatcccagcaaatgcaattaaagagtgctaggaaaacgttctaggtacatccagctttggattaaacatgtctgataccattatactgaggttcttaacttagataaaaaagctccttgtggataaactttttagcgggtatgtgaaactcaaggcttcacatacatacatacataaaattatgtatgtgcatctgtgtatttaaaggagttacacacgttatcaaattcttgaagggaggtgtttcgagacaatacagaggaaaggatgcactgtttttccagagacctgtttattctctgggctgattccagaagtaaaaataaaacccaaaaacaaaaaacgctacacagtttgatcagaacactaagattctcacccaagcagctttgatgtccaaagtgtgtttagaatccagcttatcgattcaatagttctagtaagtttaatatacatagcaacactcaagactggaaaggttccttggggtctttacataggctgtctacccagtcttgcttccatgagaaagtagcaaacggtcttttcagcattctttgtcactagcaaaaatccctggattatccaagttgtcaactggctgtgctgacctgtcagttcacaaaagggtgattataggaggtattagtcaaagctttgctttttctcttttctgaacttcttctccctgggctatacccttttcctttcgaattcctcttcagaactccattctacagagaagctgctcttggaactgtgaggctccctgaagacatccagtgatggattggcaagaacacggaaccctgcctgactttattctgctctttcctgtgcctaatttaattcaatttcactgggcaagcagttttttactccctaacaccttttatatatcaatcattctgttacaaatcatgaccatataattcataagagcttagcattgttcattttggagactggaaggcgattatgcattgcaattatcatagtgcattttgcaaatacaggtgcttcatgcattgcaggataccaggcataaaacaagatcaatttccaaacatcagacaaggacctttaaaactttgtcaaatgcaagagcaattatgtggtaataacaggaaaaacaaaacaaaaacaaaaacacaccttatatagtccaaagtcttcaagggaaacaaacacttctgacactaaattgggggttttatagtgtggttcacagaccccggggagtctctgaacactttcaggggttaagccaaaactattttgataataatgctgagataatatttttctttttcctactgggtttcttttgtactgacagtgccaaacagtgcagagttaagctgccggtaccttagcacaaatcaattcagggatactaaactgtgctagttgtcacagtatggttccctgctatgcactagtagtttataaaaagccagtatcactgaagaatgtccctgatgaagcacaaaataatcttaactgtcttcaaccttaatcctagggtaaacatagattcaatatttggtatgacaagataaaaactgtgagttctccagataccaaagtgtcatttcgtgtatgtgtgaaggaaagcacttgtgcagatgtgggaagtgtgtgctaaatttgccactttttagaggatgcacaattttcatttgaaataatgacttccagataaactattgtcctttggacttgaggatttggttgatattttcttgaaagtgaccaaagtgaggtcactttggtctctttcagtatattccaagtatgtattccaacgataaattcctgacagtaattgtcaatgataatgttcaacagctttccaatacttaaagacttttctgagaagatgaatggtgatattgaccagcaagatatttttaatactacataataaaatgtgtgagtatttggaagatctaaataaacttactgaaacaatattttttaaatgaagaatgcattgtgatacaaaatgatgcatggctaaaagacccattttaaaatatgtatttttttttaggctggtcaagtgaagccaagagacccatttgaagtactcatttaaatccatatatccatggattttaatacaacagtgtgattatgaacactgaagacagattccaaatttcaactaatctttaaaaatcttctctttctagattttgggtatagagtcaaagaatgtccacaatcatctgaaaggttgtttaaagcctcttctcttttccaaatacatatctgcacaagactggattttgttcatagactccaaccaaaacaacatatgacaaaagattgcttgcaggagcaggtattagaatcccaccatttctattaagagatttgcaagagtgtaaaccaatagcacccttctcactttttcactttgctttgcaaactacaaatgtgttatttacgttatgacatagcattactcagtccatattacagaaatgtctcagtttcaatttccaaggtggtaaataacaataaatatatgctctgggtatccttcaaagctccttggggtccttgacaatctttagggatataaaggcgttctgagactaaaactttcaagctttaaaataataatcctgaaacagagtccatcattaaaatcaatggagcagttttctaggtgtgtaatctttggctccagcttttgaaaattctaattctggggtgtgattcaagccaagtgtcactaaccttgccagggtgaatgtactcactgtggtatttagaggcatgattcgtgggataagctttgaaaataaaatagaaatttcatactgtaccatgctttttgaaaatcttaaagaatatgctaatttatgctttctacgctactggtttttagatttcctaatataagtggacatggctattgttcgggaaactataaatgatcttttgttgctgttctttcatgggacttcgttgctactttatgtttttaacaggcgggtggatcagtctcttgtataatggcacatgtgggcttagagtcattttacttatatccaatgcttagaatatgaaatgcttttttttttctttttgtccgtacttggtttattcggtcaggcataaaacacaaatgttgtttaccaaactagttataactaaacaagaacagcttgttaagtgctgtctatccaattaaagaaaacagagtacattttaaaatacataatttctttataattcttatgttattcatcttcttgtgtgaaactaaataaactgaggaatgaagatgaacattttgtttcataatctagaaaaatgacttaaagaataattaatagtggtaaggagaggaggtaaaatgattgggttgaattcacaaaagaaaggatttatcataaatgccttggagaaacagaaatgaattctggaaaagaattcaccaagattcaatttgattgaaaaaacctttgcacacctgcagtgtattctaccacaagactatgactgagagatgcatagaatatagttggggtttttttcaagaatttcaaatctagaacaaggattagaaagttggaaaccattgcacataatttgaaatattctagaagtgtttccaaaacatgactagggaagcattgcactatggaaatcatgagaaagggtgttagacaagattaagcagcagcaaaaaatgaaaaaagaggtaggatttagggtaataaatgccatagggtaaacttgatacgaatggaaatgtatgagagaaggagttacatcatcttagcagtgattgcgggggaccacgaggtttgtaaggaagagggaaagtgcgtaaaattattctacgattttcaggagagacaacaactggccatctttgagatgactctgtaggggtggaaacagaagcagagatacttgagtcttagagtagattttgagggtatcccacattgcaagctttgatatcaggattcacagaggctcctgaatctacttttagatttcatgcaatttagaccaatctccaattaccagcctgcagagcactttatgtcagcctgcttttccttaacaggaaatgcaattcctgtggcatgttcttggcctgacagttattggtgggtgtgaaagacccctgaaatcttcctaaagaagatgggtcacctttcctgggaagccatttccatggtcacttgtggcattttattgtggaagagtatttctttcaacacccacagagtgtggaatgttgacaagacttacgaaaacaatttgcatccagttttgacctggaggaacttcatggaatatggttagttatgatgaggttgcctaccaagtccagaaaaaccatctacccttgccagatgaactggtcaacttcagattcagagccagggtttctattggtgctgtcattctagaaggttattatagctaaacttgcttcacgttttggtgggtaggctctgccagtgaagaagactcaaaggtgatttttatggctcacaatctcaaggattttataggatcctgccattttatttagatgcgggattccagaccaggctctgcagcaaagacacatgggattctttttgtttatggtgtgctggattttattgggttggtgcaaaagtaattgcagttttggccattaaaagcaatggtcattaaaagcaattacatttgcaccaacctatactcatcgatttatatttatgttgtcattcttggaacagaaaacatactttatgaaaataatggatggcctttctctaattgattgtaagaaatatctccttgactcttgggtttggtatacattcttctataataacaaatggtataattgtttggaaaataaaaactttatcattgaaaaagcagaacaatacaaaataaaacacacacacacacacacacacacacacacacacactccaaactgaagtatcatatacttcacaaaatgtttacaaagtcatgctaatgcagatactcctttaattcaaggttcttttaaaaacttaagacaaggattataaaataatgttaagtgcccagggtggcaacatatttgattatccaggggaaatgaatgatttcctaggaacatgtaaacttccaaaattaatctacacaatatagaaaatcttagtaagtttaaaaaatctgtcgttaaaaatggcagttgatgggtttatggatgggtttatgtctgatttacatgtatccctttgattaataattcagtgcagtgtgtagcagtatttctttttttttttaattatactttaagttttagggtacatgtgcacaatgtacaggttagttacatatgtatacatgtgccatgctggtgtgctgcacccattaactcgtcatttagcattaggtatatctcctaatgctatccctcccccacttcccccaccccacaacagtccccagagtgcgatgttccccttcctgtgtccatgtgttgtcattgttcaattcccatctatgagtgagaacatgcggtgtttggttttttgtccttgcgatagtttactgagaatgatgatttccaatttcatccatatccctacaaaggacatgaactcatcattttttatggctgcatagtattccatggtgtatatgtgccacattttcttaatccagtctatcactgttggacatttgggttggttccaagtctttgctattgtgaatagtgccacaataaacatacttgtgcatgtgtctttatagcagcatgatttataatcctttgggtatatacccagtaatgggatggctgggtcaaatagtatttctagttctagatccctgaggaatcgccacaccgacttccacaatggttgaactagtttacagtcccaccaacagtgtaaaagtgttcctatttctccacatcctctccagcacctgttgtttcctgactttttaatgattgccattctaactgatgtgagatggtatctcattgtggttttgatttgcatttctctgatggccattgatgatgagcatttttttcacgtgtcttttggctgcataaatgtcttcttttgagaagtgtctgttcatatccttcacccactttttgatggggttgtttgtttttttcttgtaaatttgtttgagttcattatagattctggatattagccctttgtcagatgagtaggttgcgaaaattttctcccattttgtggagaactacaaaccactactcaatgaaataaaagaggatacaaacaaatggaagaacattccatgctcatgggtaggaagaatcaatatcatgaaaatggccatactgcccaaggtaattgatagattcaatgccatccccatcaagctaccaatgactttcttcacagaattggaaaaatctactttaaagttcatatggaaccaaaaaagagcccacatcgccaagtcaatcctaagccaaaagaacaaagctggaggcatcacgctacctgacttcaaactatactacaaggctacagtaaccaaaacagcatggtactggtaccaaaacagagatatagatcaatggaacagaacagagccctcagaaataacgctgtatatctacaactatctgatctttgacaaacctgagaataacaagcaatggggaaaggattccctatttagtaaatggtgctgggaaagctggctagccatatgtagaaagctgaaactggatcctttccttacaccttatacaaaaattaattcaagatggattaaagacttaaatgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagcgaacaggcaacctacaaaatgggtgtaccagtatttctaaatgtgctacagagtgctggtcaaccaaaagtatcagcctcaactgggagctagttagaaatcatagcctcaggacccgcatggagataactgagttgaaacacagcactggggatgggagcagaaatctgtaatttaaaaagctttctaggtgccttgtgcatgcttaagtttgagaagcactggtttaaaatattctagacaatagaaaatacgtaaactatccaaattcattttatacatgagtataacattgatgaaaaatcagatggtaagattaaaagaaaataaataaattattttttattatgaacacaaatgaaaaattctgaataaaatgttggcagacattacgcaagtctagctccaaagaataatatattataatcaagtaaaatttattccataaatgataaagggctcaacatcagcaattacatcagcataattgataacaaaaattgaaagagaaaaaacacataactaccaatgggtgccagaaaggtgtttggtagataaaacagcccttacaaataaaaaatctaagtgaaatagatatagaaagaagctgcttaaatatgataaatattatttaccgataataatcatcagtctaacggcaacattctggaaaatttgttttacagttaagtacagaaatgagatattagttgtcatcactattatcaattttttggtttactttagatgataaaacacaaaagaaggagataaaatttatggcaagattagaatgtgaggcaaaattatttatatttgcagagtatttttggaaactgataaaaactaactagaattaagtaaaccttgtcaggttgaattagaaacatcaacacaagttaaacacacaagtcaatagtttttaccccatggtgataatcatctctttaaggaattaaaaaaaaactcataataatgttgaaaataattaattcatggagagtattctaataaaaaagatttagaatttatatgcagaaatctggacaatcttattaagtacaaaatacaaaacctgaacatatgtagagatagttcattgtcctggatctgaatatttaattttataaatacataaatatgtaaactagatgcattccaataaaaatcccagtgagtgaggagaaggagaggaaattgattacatattcttaacgttccaataagaatcttagttagcttaccttaagagcgaaaggtcttgtgaaaaataatggtgtttgtaccatgatgtctacgagtgtgtgcctctgtgcatgtgtgcatgtgcataattcagcagaaatgaacacttaccatgaagtccctgctatttaaagcagataatattggtgaagaaatggataaatatattaattaacctgaagagattactgatatatgtatgtgcttatacatacatatatatacttattaaataaataacatatatattaaatacatatgtaatcaaggtaacagtataattcagtggaaacaaactgatatgattgatttcattgataagtagctctatcacggaaaaaattctttatacctgcattgttacaggcaataacatttacaagcaaattacacatgggtttgatgattaatgaaaatatatatactattagaagaaaattgaacacatgaaattgttgatcctggagtcacctttttatcttcccttttgttgtgtaaactaattttcagtcatttttcttatatttctagtcattttatttcgggccttttgttgttagtggaaggcatttttattgttacattggacaagaaaagatgtctactaagcctccaacaccacagaatttcaaggcctcaattttgtagtcaagaagctgtaaattatattttgagaagttataaatgcaagttattcacatgtaattacttacatatacatttaaggataaaaaggagagacaacactttaatgtcagttgatgcacaaaaaacacagtataaagaatatttaatttttcttactctctgaaaaggtctaggccatgtgatttgtgcctgtcgcacgaaatagtacaaaatgtaaaagtcatgggggatagatgctaataaaaggatttatagtcagtgcaaagaaaaaaaaagcagcaggaaacacaatttgcaactttacataatgaagaaaagtgtttgaatacctacataaaatgcagagataatagatttgctggcaggagaagggaacatgagtaaaagaaaaagaaattaaaaggaaaaataaaactggattgctgacaggtaaattgatggccttaagttaacggctctcagtagttcagcaatattcactgagtatccacaaagggttgggccatgacttgagctctgtgttgagatggaagaaaattgaagcgtcaccagttatatagatgtatatattgagtaaaggagaagagtagaagtttaagatgaagaattcaattctagaagaatattataattgtagaattgatttatacatagtaaattttagcacttttgatccacatttgcaacagaaagagaaacataatgaaggaattaggaacactctacttctcctcaagaaagattaacagctaagggaattgctataacactgtaaacaattagctggaaatatatgaaactatggttttcagactatggacaagaggaaacatgacggtgatctttgagatgaagaacaccaaaggtcagcactcacatggccccggcttattgcctagggtactttctacgcttcaacgcaaggaggagaaagctaaatagctggtgattttgctgaactgatgacacagagacccaagttaaaactgttaggaggctgaggttgctgagatttgcaaggcacagtggtggaggggaaggataactacaaagaaatagcccctgggatctacagagcagtctctagccaccctctctgttcagatctctacaatattgtagagaaccaacagaagtaagtccactgaatgagtccctgaattcccaccggaatgaaaacagtttttgttcacaccagccagagtgcagagatctcataatacacaggagtcatcaacagcttcaagacaaagacagagaaaatactcaccaaataaattgtggataaaagactgagaactatgatctatgagcaagttttacagctcagtaatgaaaagacaaattattgcattaaaaaggcaaaaaaattaaacaactctcataaaaacataaataaatggccaatatgcacatggaaaataactcagcttccttggtcatcaggtatatgcaccaagattccactagacacccaacatcccaacattaaaattgaaaagactgacaatgtcaatgttcacgatgacatgaagcaaaaggagttttttttggtacttttctttagcagagttgggggtttcaccatgttggccaggctagtctcaaactcctgacctcaggtgatctgcctgcctcagcctcccaaagtcctgggattacaggagtgagccaccgtgcccacatgcaaaaggaacttttatatacatttagtgagtgtagaatggtacaatgacttgggaaaactgctggaaattacacaaacttctagatatgacccaagacctagccattccactcctatttacccaagataaatgaaatcttatgtccaaaaagactagtacaagaaaattaaaagtagctttatttataataggtttaaaaatggaactggcccaggtatctatgaacaggagaaagggaaaacaaactttgctattttaatacacttggcaatgaagggacacaaactgttgatacataggatatggattattttattaaaaatatgctgaatgaataaaggcttgaccaatgaccatccactataggattccatctttatgagtgtctagaacaggcaaaacaatacctgttggaaaaatatcaggtcagcatagtgcttgctggggcagttgtggatgttactgaaaactgacacaggaaactctctggtgaagcctgtgctctctactttggtaggagtttggtttacatggtgtgcttttgtctctttattaaatgcatgcttaatatttatgtatctctatcagaaactgtgtcccctggagtgagaccatcactgtctgccatcatgtagctgtttcctttggagccactcagtcattgactgctttccctggaatgaggggaatacccagtcattggtcatcaattgtttctgctggaccaactctgtcctgggctctgttccctccactgactcagtgattgactgttatccttggagtgactcaagtgtcggctgtcttcccaggtctgaggcaatcacttcctgtcatcctcttaacaactgttttccttagagtgacacagtcattcactgtttctcctggatatctccctgtcatttcatcatcaattttttctctagattgactcagttcaccatcaactgtgtcccctggagtgacttggtggtcaattattttccctgaattgatttggtcatcgattcttttgcctggactgactctgtcatcgactgttgtccctggaatgatttggtactcaactgctttccctggactgattggtcatcaactcttttccccggatttactcggtcattgactgtgttccctggactgacttggtactcaactgatttcccctggattaattcagtcattaactctttttcctagtttgactgggtactcaactcatttccctggaatgatttggtacccaactcatttccctgattcgactcggtactcaactggtttccctggaatgacttggtactcagctggtttccctggattgacaccatattcaacttgtttccctggattaacttggtattcaactcatttccctggactgactctaccctgaaatgatttgtgccctggactgtctggtattcaactcttttccctggattgactcagtcatttgccctcatttcctgttttacttggaacaactcagtcattcactattttccacactgagggcatctccatgacttcctatcatcaatgctttccctggactaagtcagtcatagactctaatctctggaatgactcatgatcactattttccaatctctggaatgacttatgatcactattttttctggtgtggcttggtaactgtcttttttaaatgaactgaagagatcatgccctgccacctcatcaactatttatttcccttgttgtgactttgtcagaggctgtgttccctgggctgaggtcatctcctcttctttttgtcatcagtattttccctggagtgactcggtcatctcttcttttccctgaactgttgtgtaatcacgtcttttccctggaatccctagatcatcaactattttccctggacagactcggttattgattatgttccctggagtgactcagtcattgattgcttttcctggactgatctcttcatcacctcagtcgtcttagaagggagattgctggtaataaaagtatatttttattttcataaatatgtacacaaatacatgaacatatctttatacacatgtgtatccaagcctccttcaggaagtttcagcccatctgagaatgcataacaatgccttccaaagttcatgtgtggcaaaacttttaatttttccccccagtatgataggggaggaatggtgtctgtgtttcctgttgtgctcattttacaatcagtttacttggacttcttcttcatgaatgtttttaatgttttttccttccattttcaattttttaaaaaaatgtgttaacgttagcccctttatgaggcaacttatacaattctgtgctgggaacacttcctgagaaatgcatccttggctgatttggcccttgtacaatcatcctagagtgcatgtacccaaacccggatggcacaggtaactgcatacctgggctgtatagtgtagcctgctacactcctgtgcaacctgcgactgcactgaatactctaggcaactgtaacacatgttacatgtgatatttgtgcacctaaacgtatccaaacctaggtaaggtaggctacatatacggtattataatctcatgggaccactgtcaaatatgtggtctgtcattgactgaaatattcttatatggtacatctctatatttctcatgactttttaattgcactgtttgcccagcaaattttttaaaaaattatatattcaaattttgtatatttgattgcatttggattttgagtggtacttagaaacctttctccacactgagattatagaagaattaattcacttttcttctagtacttacatggctgtatgtatgttattgtgcatacccctaagcatgtgtatgtgcatgtatgtttagatacatgattcatgtggagtttattcctgtgtataaataaactgtggatctaaatatatcattttccaggtggtcccaccaacatttacttaaaaatccattatttcagacactggggtgcgcacctgtagtcccagctacttaggaggctgaggcagcggaatggcttgagctcaggagttcaagacccatctaagaaacatattgagaccctgtctctaaattaaaaataaacatgataaagtagccaggcgtggtagtgcatgcctatagtcccagatactctggaggctgagtcaggaggattgcttgagcctggagaccaaggctgcagtgagccatgatcgagccactgcactccagcctgggcaacagagtgagacccttctttaaaaaatccattattgcccagtggtttgagatgggcaataatggattgaaataataataattgagataccaccttaattgtatactaaacttccttctgtacctctacctgtttctagatgttctcttatattcctctagtctttttgtcttctcatgcacctgtaacatattattttcattatagatgcttaataatgtgtttaaaatctgaaagggcttgaccctactaagggtttttctggctattcttgcctgctggttattccacatgaacttccatgtcaactactgcataagacaatttgtaattttcaaaaattttgataacattacttttataaattcacccacttagaatttacctctttacatttttgagccatcctattcaaagatgattttccttttgttcctactacttttatttctttcaggagattttaaaggtttttaaaaattatatagagtttgcacagttcttactatgtttattcttaagtagtatgtcatcttctttggtgtaattgtacatggacttcatgctaaataactctataattttttattttagggttatattaaggacttacatatgctacttttattgctaattttactgaattatattattttgtgaattaatttgaacattaattctttaaagctttccagatatcatctgaaaaataataggaattaatttgtttctagtccctatgcctctaattggtttattttatttccttgtttagaaaacaccttcagcataatgttgaatagcagtggagatattttacattctggcttgcatttctagcatgaatcccacttggtcatggcattttttgcaaagtgatattggattctgtttgacaatattttatttagtacttaagcatcagtattcataactaatattggtctggaatattctctcattattcacctgcatacatattaagttagcatttaaatttttatattatgaatttaaatgtctgaaaacaacataattttcagttgtgtataactttgacatattaaaataaaattcttacattgttcttacaaatgtatccaactgtattttcatatcatagtgactagaattttaacctcaatgtaatagattttttgaaaacatattgattataataatgtcctttcctatattcacataagtatagaaattgaaaatttaccttttttgattcctaaaatagtagtgactcatatgttaacattttattctgagctttcattgtatttttattaattatgatttatcaaaacaaaaatatgtgtcacatctctataagtaataaatatgtcttgaaacataatattttatgggggataattaagagcaaaaaatagcaagaaactgtatataaatctttaaacatccaattgagcaccaattatttggatgactacaggactcagtggtactctcctagccagccacagacccagagcttccaccattgttatttaatctggagtaaaccgctacccactgatggcaaatcaccatcaggagtgggaaggttatagaacctttttctaaaacatgtctcattaggaactcacacttacctgggacattatttaaactctgaagaacatgcttatcccacagacattccgttcatatgagatttttagaacacagttgcattatagaggggttttattgactcaggaataattatacatataattattatataaataaagtacactttacaaatacaaaggtgtagcttactagaatggaatgtaaataatggacaaatatatactagatgattattaaagtaaatatatctactgcaaatgtattactatcagagaaaagagccttcaaggcaaatctcactaatagggacagagaagggcactacataccacattcaaaaaagacattttattcatcaggaaaatataaaaatattattatcttgtatgtaaataaaaatgttgcaaaaacaagtaaatcagaagaacaagaaggtattttaaaaattcacattaccttttttttttttttttttttgagatggagtctcgctctgtcaccaggctggagtgcagtggtgtgatcttgactcactgcaacttctgcctcccaggttcaagcgattctcctgcctcagcctcccaagcagctgggactacaggcacgcaccaccacccccagctaatttttgtatttttagtagagacggggatttcatcatgttggccaggatggtctcaatctcttgacctcatggtcctcccgcctcagcctcccaaagtgctgggattacaggcatgagctaccacgcccagccaacattaccttttttaataactcctaggacatggagtaaaaagtaaaattatacaatacaagagggaacgaggcaatataaacaaagttttgttatactcttgaaaataaaaaggttctcctttaaaaacattgtatcctggtaggatgcactgaagacacaacatcacatgcataacttcaaactaattatgagaaatcttaagacaaacccaaactgagagacagtctacaaaatacctgaccaatactcaccaaaagtattaagggcataaaagacaaggaaataaattagagtagaataaggacacacaaattgcaggagaataaacatatacaaaaacaaaatgcagtgtgagattctggattggatcctagaaattaaaaagatattaggggaacactggtgtaatgttaaggtctgtggtttaattaatagttagtgttcattgtcaaaataggacaccattgttagtgtcctgattttgacaatgatactatagttatatgttgtaaatattagggaaaattgaatgaagattatatatgaactttctgtaagttcgaactttttcaaaataaaatatttaaaagagatattgatgattttaacacaaaatgaacatatttgctatggtaaatctcaacacattgaaacaacaaaaatcaagcagataacattctctgaacacaataaaataaaatttgaactcaagtgacaatataattaaattatcttatttttcacaattaaaatataatgatacatattcatgggtaaaaagggaaatagtaatgagaatgagaaaataattaggactaaataaatgtattacatatgaaaatcagtaaatttcactaaaacaaaattagagggaaatttatagaccaaaatggttatgttagaaaaagagaagaaaataaatcaaaactcaataaataatcatccaacttaagagtatagaaaatgaacagtaaaattatgaaggtaaaagtagaaactaagggaatgtaaaaacaaacaaaacaaagccaaataaagaaacagacaacctgtcttagtctgttttgtgttgctataacagaataccacagactgggtaatttataaacaatagaagctaatgtggctcgtggttctggagactggggacttcaagagcaaggcaccagcatctggcaaggaccttcattctgtgtcatcccatggtggaaggcagaagggcaagacggaggaagactgagagaggaagacaaggcagagctcacttttattaaaaatcatgtctatgataaggagcccacttctccagtaatgacattggtccttgcatgaaggtggagctcttatgatctaatcaccattcaaaggtctgagctctaagtaccatcacaatgacaattaaatttcaacacaagttttgaagggaatgttaaaatcatagcaaaaccctaaggaacctgcatagccaaactctagagaacattatttgcattgtagtgtatttatacaatactccaccctacactgtttatttcaaatttgaacaaccttacactgcagcctagacaaacttatagcaagaattcacaaagtcaagggttgagaagagaaacacttaacaattgttgctgtagcaattcactatatgtggaaaaaaataaaaatcattttctcacaccatacattaaaatgactcccatagggatcaatgtaaaagacaaaactgcaaaatatttagaagtcaacagataggaatatttttatgacttccaagtaagaaaggcttgcttacataaaacacaaaaaacttaactgcaaaagaaaaacattcaatacagtcaattagttaaaatataaacttgtatttctacaaataagtaaataagtaaaacctcctaagaaaaattaaaagagaaacacaattaagtagtcatgaagcctgtttgcaaatattctaaatctcttttggaagcacctggtgtttcatgtccactggaagtgaaatgtaaccatgttgcttgttttggacaatgacatttgaatctttcctgtatattccatacaaatatgttttctgttgtttgtcattgtaggaacatatggggacagaggatggtggccctagaacctaaggcaaagtttgtcttccaatttaggtccatgcaggtgcctttaatattcacactgtggctcacccatccattattccacaacatattagaaaacagaaacaggaggagatttcattttttttcaattttaggaatccttccaattctccttatttcccagctctgctttaggttcctaaattcttagtcaagacagagaggctcttgacaggtgggattgaatttagcttgtaaataactgaggacacccagatgagccggcctagaaacagacgttcggccaagctaggagaacaaagaagttgtgcagctgtatgtaccatattggcttgggcgtgtatcaaaagcatgatttactgtgcatgcgcacacagaacatgaatatagagttggtaactagactgcaccttaatgtgtgtcagagtagactcattctcaacagccaatggcttgagcataccaaggggctattcccaatgactcttgagcctatgtgcagattttcattggggatatgctgttgcctgcagcaccattcaaaatacagccagctgatcagtgagctgttagcaatttaccatcaacgatcaatttggaaagccatatagcaagatggaaagaaactggctatcaccaacaatcatactcctagcccacaagaactttcaaatgggtgcaaaagaggagatgctcatggccattggatctgtgtagttatcatggttatgtagatagatacttaatacatgtatgcagaatagataataaagatcttaaataatatatcataaataaatcttaaataaatcttgaataaacagatcacaaagatcagaatagatcataaagttacacatgtgacaatgtgtgcaagagagtggaacaagagtgagagaattatgcactacaataaaacaaaagaggatctttgtacagagaaagaatggccaacagcccagtggagaaataattcaaataaataccctggaactgagagcaatgcatattgctgacatatgcatatctatcattgtaaggaattataggatgcgtcaaaagaagattctatgcccccagacataaattaggagccagtgacaccagtctagtgttgggcttaccttccagatcagctcagaatatctatcctaggttctgctttcacacatttaaccaaaaataaaacgtggtagaagtagattattaaaacagataaaaggcatggaatattccacataagatgtttagtaaagctagatgagaaaaagaaattgatgaaaatcaaatgtacaacttttgcttactattttccagtgatgaagtctcaatagtttagcacttgaacattacacatgattcatgagaatttgggatttttttttcttctcgtccacaatatgtaactcttatttttatcatgctgaggttcatgcccagaaagtcaatctgttgttttatattcctttcatttgccaaaaaaagagattctctttcacttacattaaaaatctgcaaaattctcacacagtagatttttaaaaatctcttcaatgcaatttctaagtgaatgttttgtatgttaactagaatgaggaacaaagcagaaatattataattcatgattattaattttgcattctgggtttttcaatttaaaaataaatggaaacatttagagatcatttagtattagtattagtacactaatactaaacgtttagtattagtgtactaatagtgtactacaaacactttgttaacactttgttttaataccagtgtaagttggctataaaagaacttaaaccttttaatccacaaaatgcttgcaaactaattggagaggcaaggcccacacatatgaaaataagtggtaattatgtctgtaagacaagaaacatgccaaggtttagagaaggaggagttgacacaagctgtccgtatgataatatgaataagaggaggcagcttttaataaaacaaataatagttggggagatccacttatacataaacataaaaacaaagaaaacatgaaatcatagacacttttgaaggtaactgggaatgtaaatcttgatcaacctttgggtggacaatttggaaaatttcaacttccacaacaatgacaaaaaacagtgcaacctgaaagttctcttaaacttcagattgccctagtttcaattcttaaacattaagatagattatgagaagactataaattctgctgctaaaactattattctcaaatgagaatttctgtcatctgggtgtgtaaaataattcctcagcatgttcgaacccatcgcaaggaagctaaaaaccttgaacaaagattagaagaatggctaactagaataaacagtgtagagaagatttaaatgacctggtggagctgaaaaccatggcacaagaacttcgtgacgcatgcacaagcttcaatagccaattccatccagtggaagaaagagtatcagtgattgaagatcaaattaatgaaataaaatgagaagacaaggttagagaaaaaagagtgaaaagaaacgaacaaagcctccaagaaatatgggactatgtgaaaagaccaaatctatgtttgattggtgtacctgacagtgatggggagaatggaaccaagttggaaaatactcttcatgatattatccaggagaacttacccaacatagcaagacaggccaacattcaaattcaagaaatacagagaacaccacaaagatactcttcaagaagagcaactccaagaaacataattgtcagattcaccgaggttgaaatgaaggaaaaagtgttaagggcagccagagagaaaggtcaagttacccataaagggaagcccatcagactaacagcagatctctcagtagaaacccttacaagccagaagagagtgggggccaatattcaacattcttaaaaaaaagaattttcaacccaggatttcaaatccagccaaactaagcttaataagtgaaggagaaataaaatactttacagacaagcaaatgctgagagattttgtcaccaccaagtctgccttacaagagctcctgaaggaagcactaaacatggaaagaaacaactggtaccagccactgaaaaaacaggccaaattgtaaagaccatcgatgctatgaagaaactgcatcaattaatgggcaaaataactagcgaacatcataatgacaggatcaaattcacacataacaatattagtctcaaatgtaaatgggctaaatgccccagttaaaagacacaaactggcaaattggataaagagccaagacccatcagtgtgctgtattcaggagacccatctcatgggcaaagatgcacataggctcaaaataaagggatggaggaagatctaccaagcaaatggaaaacaaaaaaagtcaggggttgcaatcctagtctctgatagaacagactttaaaccaacaaagatcaaaagagacaaaaaaggctattacataatcataaatggatcaattcaacaagaagagctaactatcctaaatatatatgcgcccaatacaggagcacccagattcataaagcaagtccttagagacctacaaagagacttagactcccacacaataataatgggagaccttaacaccccactgtcaatattagacagatcaatgagacagaaagttaacaaggatatccaggaattgaactcagctctgcaccaagcagacctaatagacatctacagaactctccaccccaaatcaacagaatatatattattctcagcaccacattgcacttattctaaaattgaccacatagttggaagtaaagctctcctcagcaaatgtaaaagaacagaaatcacaacaaactgtctctcagaccacagtgcaatcaaattagaattcaggattaagaaactcactcaaaactgcacaactacatggaaactgaacaacttgctcctgagtgactactgggtaaataacgaaatgaaggcagaaatatagatgttctttcaaaccaatgagaacaaagacacaatgtaccagaatctctgggacacatttgaagcagtgtgtagagggaaatttatagcactaaatgcccacaagagaaagcaggaaagatctaaaatctacaccctaacatcacaattaaaagaactagagaagccagagcaagcaaattcaaaagctagcagaaggcaagaaataactaaaatcagagcagaactgaaagagatagagacacaaaaaaacccttcaaaaaattaatgaatctaggagctggttttttgaaaaggtcaacaaaaatgatagacttctagccagactaataaagaagaaaagagagaagaatcgaatagatgcaataaaaatgataaagagaatatcaccacttttcccacagaaatacaaactaccatcagagaatactataaacacctctacgcaaataaactagaaaatctagaagaaatggacaaattcctcgacacatacaacctcccaagactaaactgagaagaagttgaatctctgaatagaccaataacaggctctgaaattgaggcaataattaatagcttaccaaccaaaaaaagcccaggaccagagagattcgcagctgaattctaccagaggtacagagaggagctggtaccatttcttctgaaactattccaatcaatagaaaaagagggaatcctccctaactcattttatgaggccaacatcatcctgataccaaagcctggcagagacacaacaaaaaaagagaattttaaaccaatatccctgatgaacatcaatgcaaaattcctcaataaaatactggcagactgaatccagcagcatatcaaaaagcttatccaccacgatcaagtcggcttcatccctggaatgcaaggctggttcaccatgagcaaatcaataaacgtaatccatcacataaacataaccaatgacaaaaaccccctgattatctcaataaatgcagaaaacgcctttgacaaaattcaacagcccttcatgctaaaaactctcaataaactaggtattgatggaatatatctcaaaataataagagctattcatgacaaacccacagccaataccataccaaatgggcaacaactggaagcattccctttgaaaacctgcacaggacggagatgccctctctcaccactcctactcaacatagtgttggaagttctggccagggcaatcaggcaagagaaagaaataaagggtattcaattaggaaatgaggaagtcaaattgtccctgtttgcagatgacatgattgtatatttagaaaagtccatcatctccaccccaaatctccttaagatgataagcaacttcagcaaagactcaggatacaaaatcaatgtgcaacaatcacaagcattcctatacaccattaacagacaaacagagagccaaatcatgagtgaattcccattcacaattgctacaaagacaataaaacacctaagaatccaacttacaagggatgtgatggacctcttcaaggagaactacaaaccactgctcaagaaaataagaggacacaaacaaatggaagaatattccatgctcatgcataggaagaatcaatatcttgaaaatggccatactgcccaaagtaatttatagattcaatgccatccctatcaagcttccaattactttcttcacagaattggaaaaaaactattttaaagttcatatggaaccaaaaaagagcccacattgccaagacaatcctaagcaaaaagaacaaagctggaggcatcacactacctgacttcaaactatactacaaggctacagtaaccaaaacagcatggtactggtaccaaaacagagatatagatcaatggaacagaacagagccctcagaaataacactacatatctacaaccatctgatctttgaaaaacctgacaaaaacaagaaatggggaaaggattccctatttaataaatgatgctgggaaagctggctagccatatgtagaaagctgaaactggatcccttccttacaccttatacaaaaatcaattcaagatggattaaagatttaaatgttagacctaaaaccataaaaacactagaagaaagcctaggcaataccattcaggacatagggatgggcaaggacatcatgactaaaacaccaaaagcaatggcaacaaaagccaaaatagacaaatgggatctaattaaactaaagagcttctgcacagcaaaagaaactaccatcagagtgaacaggcaacctacacagtgggagaaaatttttgcaatctacccatctgacaaaggactaatatccagaatctacaaagaacttaaacaaatttacaagaaaaaaacaaacaaccccatcaaaaagtgggcagagggtatgaacagacacttctcaaaagaagacatctatgcagccaacagacacatgaaaaaaatgctcatcatcactggttatcagagaaatgcaaatcaaaaccacaatgagatactatctcatgctagttagaatggcaatcattaaaaagtcaggaaacaacagatgctggagaggatgtggagaaataggagcgcttttacgctgttggtgggagtgtaaattagttcaaccattgtggaagacagtgtggcgattcctcaaggacctagaattagaattaccatttgacccaccaatcccattactgggtatatacccaaaggattataaatcatgctactataaagatacatgcacatgtatgtttattgtggcagtattcacaatagcaaagatttggaaccaatccaaatgtccatcaatgatagactggattaagataatgtggcacaggccgggcgcggtggctcacgcctgtaatcccagcactttgggaggccgagacgggcggatcacgaggtcaggagatcgagaccatcttggctaacacggtgaaaccccgtttctactaaaaatacaaaaaattagccgggcgtgttggcgggcgcctgtagtcccagctactcgggaggctgaggcaggagaatggtgtgaacccgggaggcggagcttgcagtgagccgagattgtgccaccgcactccaacctgggagacacagcgagactccgtctcaaaaaaaaaaaaaaaaaaaaaaagataatgtggcacacatacaccatggaatactatgcagccataaaaaatgatgagttcatgtcctttgcggggacatggatgaagctggaaaccatcattctcagcaaactatcacaaggacagaaaaccaaacacctcatgttctcactcataggtgggaactgaacaatgagatcacttggacacagggcggggaacatcacacactggggcccgttgggggatgggggactgggggagggatagcattaggagaaatacctaatgtaaatgatgagttgatgggtgcagcaagccaacatggcacatgtatacctatgtaacaaacctgcaggttgtgcacatgtaccctagaacttaaagtataataataataataaaaatacttcctcagcaaaccttacagcataaaatatactttcatgagttgttctttaattagctactcaaggaagatccttgtaaaaataattattcggattttaatgtagatagttttgatttaaactccaagatttttttgggggatgggtaatatacatcattgaggtacactatcaacatatacttcacatttactattctttcttctttttttttttttaaaaaaaaggtctgtttttcttggagtgtttaatttcttttcgaatgctggaaaaatttggaggacttgctaaggtttttaacaggatattttttgtgatagttggcaactgggccaggattagggtatggtaaatgaggtgtgttattatttgttgaccatttacctgtagtgcaaaattcaactctgtaatagagataaatagtattttaatgcaatatttaaaaaaattaatgtaagacatccatgaacaacaaaatatcagacttaaatactgagaatcagtagcccttttgtgatgagccaaattggagcttaaggcaaaaaaaatcaatattgatgttcctttcattccaaattttggtattttgttattcatgggtgttttgtattaattctgatttttaagaaataattgcgttaaagatatggaatcaacctaaatactcaatgatagactggataaagaaaatgtggcacatatacaccatggaatactatgcagatataataagtaatgagatcatgtcctctgcaggaacatggatggagcaggaggccattatccttagcaagctaatgcaggagcagtaaaccaaatactgcatgttctcatttgtaagtgggagctaaatggtgagaacacatggacacatagagaggaacaacacacactggcacttattggaggatggagggtgggaggagggagagaatcagggaaaaataactaatgggtactaggcttagaacttaagtaactaaataattggcacaacaaacccccatgacacacacttacccatataataaacttgcacatgtacccctggacctaaaattaaagttaaattaaaaaaatgcattacactattataatctctgtgactgagggtttttttgtgtgtgccctcttaaattttacatccaaaccaagtgcctcgtttgctaatcttcttcccagcctcggttcaggaagggctggaatttcctcatcctctccttcaggatgtcagttctgcactgaatgtgacaaactactgagtgtcatttgtgtgccacactcaggtgactcattctggtgaggaactatttgtcattgtctgcaagttcataagcagatttggaatttctcttccgtgcccttcaatttgcccttgtacaatttgttatgattaatgggaccaaagaaggcaaaaagataacggtaccctcttggctgtggaatgaaagatgacagagaccactcagggtcttagagaacacccaatcaaactcattcaataattattcaccgagtgtttatctgataagaaaaatagttagttgccgctaatatttattcattccacatgaatatattgaacactcttatgtgccaggcattgttctcagtgataaatataccaggaaaaataattatgcccttagctgtgtacagtatgtatgtgtgcatgtacacacttgtatatacacctgtacacacacctgtgcacttaccttgtgcgtaagtgcacaggtatacccatgtctcatggatataatggcaaagattacaaaggtaagaaaaaatagaccttctccctgccctctggaagcttatagactaattgggagagaatgattgggcagttctttcaggctgaggaaactggagagagggagctgtctgtgcaaaggccctggggtaacaaactgcaggcttgagatgcagcagccctgtgggcttctctctttatcctgggagaaatgagaaggtattggaggatcttaaatgggagagggacaggatcatattagaatctctaagtgaggacaagacaaggatggattcagggagatgggtcagagaccagaggacttggtgattgatgtagggccataaagctgggggatatagggcaccatgaactcaggtgccctaagatgacagatggtgtcctttagtgcagtggccccaaccttttaagcaccagggactggtttcatggaagacaatttttctgcaggccagcaggtggaggagatgcttttgggatgattcaagctcattacattcactgtgcactttttttctgttattattacattgtaatatgtaatgaaataattctacaactcatcataattcagaatcagtgagagacttcagcttgttttcctgcaactagacactctcatctgggggtgatgggagacagtgacagatcatcaggcattagattctcataaggagcatgcaatctagatccctcacatgtgcagttcacagtagttcacgctcctatgagaatctaatgcctgatgatctgacaggagggggagctcaggccataacgtgagtgacagggagcagctgtaaatatagatgcacctttctctcttgcctgccactcacctcctgctgtgtggcctggttcctaacaggccacgagccggtacgatttcatggcctggggcttggggacccctgctttaatgcacctagcaaaatcttctgctcaaagaaacttggtttgtgttgagctatggaaggcagtggtgacattagcaactactgtgaactgaactgggctctttctttttagcttcccctcccagctttatttaggtatagttgacaaatataatgtttgtatttaaggtgtgcaatatgatgatttactatacgtatatattatggaatgattaccaccaccaagttgagctggggttcttaaaagtattatttctagaccatgcttcaagtctgttgctaccttcttgtgctccttttgggaaataatttgctctttttgtaccagcccacatgctcacccactcacattcatagagtacctgaaactagctctgtactggtgagatacaaaataaatgaggtatagactatgagtgccagcaacttaatctctctggagccagaacacatatccaccccacccattaaatgtgagtaaccaggacgggagatgttgcatgttactggcaatgacagaactgacgtacataaataaaacctatagtgtacagattcaccgctctgaaatctacatgtttacacacaaagaatagctgtctaaaagcatgggcccttttttctttaagaattgcaattaataggccgggcacggtggctcacgcctgtaatcccagcattttgggaggccaaggtgggtgcctgtaatcccagcactttgggaggccgaggttgggagtttgagaccagcctgaccaacatggagaaaccccatctctgctaaaaatacaaaattagccaggcgtggtggtgcatgggtgtaatcccaactactcgggaggctgaggcaggagaatcgcttgaacctgggaggtggaggttgcagtgagccgagatcgtgccattgcactccagcctaggcaacaagaacaaaactctgtctcaaaataaataaacaaataaaaataaataaaaaagaattgcaattaacaggaaaaagattataaaagattatattctgtctctcaaaggtcttttctttgccattacagggtggagggatgttgcagatgatagtaatagtgactctgatgttcaagtggaatttgattcatttcagaagtatctatagaatttgtttaaaggttctagtgctttgatccaggtttctgcttattcaagaacttaaagaaaagatttttgcaacatcgattttttgaaaattcttcaactctgttggctgccaatgcaaccacagatataaataatgtgggggtttgggttgatttgctgcattttcatcattgctgctagcttgtgacagatgcctgaacagcaggctagagcttagctggctgaaccacatattgatgtaggtgttttgctttaataattcatagagcaagtgaatgcaggtggacagctctgtctcaggtcctacttggcctctcacacatgtagaaagttctttaatgtctctataagttcagtttcttcgtctgtaaaattgataaaaatagtaacacctacactagggaattgttctaggaattaaatcattgacaaatgtaaaatgcctagtgcatcaaaaatgtatcctaaatgatagaagttgttgttgatctctatgcaaaactagaaatgacaagagtaagcaaaccattatcttataatataaacatagtcttctaacataatgcctaaaaagaagcattcctgtgtttacctaaagttacaacttcaaattgactggatatgatagtttgagtgtttcatccttgaggtatttttttgccaatttttaaataatagacaaataaataccctggagtctctattttggtagtcaactgaatgtactgtttgcaagagaattgatcttggactctttaaaaggcaattctcatctcggacatggtacattcagtttgggatagcagactgtctgattgtctatcccagagtttgggataccatactcgtctaattatggtggtatcccaaacacatagaacagcacctggctgatagaggacatcaataaatgctacttcatttcttccctttttgagaatgatgtaagtaaacggaaataaaatctgtgctttttatctaggataacatatgttttactgcaggtcattattacgtcacccccagaatccctggtaaatatcagtgacttagtcagtataggtaatcaataaaagtgaatgaatgattcacattgcagaagaatgatctggtaagagtgtctaggatgaaaatcaatgcaggaaaggactcattaatctagaatacctttgttctcttgtctactagggaagcatatatttatcttttattgtccaaatatttttcagatattctttggcaaccatttctgtagccacctcctcatgatatagcagcagacccaagcccccccacagctggaagaacacatgctgggccatgactatctctgataaacatggaagagtgttttgggaaagaaaagtgagagcttagaaacaatggcttcagataggttcaagagaataatctagcaaagggaagaacttggagaactttgccaacaattcatagtcagaagttaagaatgctaatctgtgaacctttagaggaaaaacagaattaaaaaataaaatggacacccagcccatgttgtgtctacccaaaagatgagaacaagacctctgtatttcaccttctattcccccttcttcagaagtgccaactgtatgcaactacgtggctgcgaattttttttttttttttttttagagatggagtctcactctgtcgcccaggctggagtgcagtggtgcgatctcagctcactgcaaccttcgcctcccgggttcaagagattctcctgcctcagccacccaactagctgggattacgagcgcaccacgctcggctaatttttgtatttttagtagagatggggtttcaccatgttggtcaggctggtctcaaactcctgacctcttgatccgcccgccttggactcccaaagggctaggattacatgggtgagccaccgtgcccagccatggccccagatttttggtggcaccacatgctgactttaatgtgcctattttttacctagagtttccctaactctgtaaccacatcaattgacacttggcccttttacctggccaaaccaaccctatagacccatactctatccacgttccagatgcactgatatttttctccagttgtttaattataccttgttatttaattataccttgttttttgttttgtttttaatttagtcattttatttttaattgtacataattgtacatacttatggcatacaatgtgatgttttgatagatgtatacattgtataatgattaaatcaaggtacctagcaaattcatcacctcaaatatttatcatttctttgtggtgagaacactcaaaatcctctcttctagctattttgaaatatacactatattgttgttaaccatcgtcaccccactatgcaatagaaaagcagaatttactcctgtatttaacagtaactttgtacccattgaccaacttcttcccacctctcctcccctctactctctccatcctctggtaactaccattctactctctacttctatgaggtaaactttttaagattatacatatgagtgagatcatgcagtattcctctttctgtgtctgatttatttcacttaaacttgatgccctccaggttgatccatgttgctgcaaatgacagaatctcattcctaactagtatttccttgtgtatatgtatacacattttctttatctattcatccattgatgaacacttaggctgattccatagcttggctattgtgaatagtgctgcaataaacatgggagtgcagatatcatttttcctgcattgactcttaacttaaactctcttgcaaaattattcttttgcaatgtgaatcatttattttctctgggtttgaatatatgcagtagttggattgctgattcatatggtagttctatttttaatttttgagaaatgtcttagtgtttcccataatggctatattaatttacagtcccatccacaacatgtaaaggtttccctttttcccacatcctcgccagcatttgttatcttttgtcttgtcgataatagccattctaactggagtgaggtgatgtgtcattgcagttttaatttgcatttccttgatgattaacaatggtgagcattttttcatacacctattggccacttgtatgtcttcttttgcccatttaaaaaattggactatttgttgggtttttttttctatagagttgtttgagttccttatatattctgaatattcacaacttgtcagatgtatagttttcaaatgttttctcccattctgtgggttgtctttttactctgttgattatgtcctttgctgaatagaagctttttagtttgatgtaatcatatttgtttatttttgcttttgttgtctgtgctttttgagatcttaaccaaaaatccttccccaatagtttcttctaggtttcatggtttcaggtcttaaatttaagtttttaatccactttgggatgatatttatatatggtgaaacatgggggtctagtttcatttttctgcatatggagatccaattttcccagaaccatctattgaagagacttgtcctttctccaatgtatattcttgcacctttgtaaaaaattggttgcctgtagatgtgtggttttatgtctgggttctctattctgttccattaagtgtccgtttttatgccagaaccatgctgctttggttactgtagctttgtggtttattttgaaatcaaagaatgtgatgcctccagctttgttcttttcactcaagattgctttggttgttcaaagtcttttgtggttccatacaaattttgggattagtttttccatttctgtgaagaatgtcattgatattttaataggcattgcattgaaaccatagactgctttgggtagtatggacgtttttacaatattaattcttccattccatgaacacaagatatctttccatttatttatgttctcttccatttttttcatcaatgttttatagttttcagtgttgagatccttcacctcactgtttaaatttattcttaggtatcctagttacttatttttgtagttattataaatgggaatttttatatttatttttcagatagtttattattagcatatagaaatgctgttgcttttttatgttgattttatatcctgtgactttactgaatttgtttattaattcaaagagttttggggtggagtctttagtgatttctgaatataaaatcatgtcatctgtaaacagagataatttaatttcttcctttccaatttggatgccttttaaaattttctattgcctaacagctctggctagaatttccagtactgtgttgaatagaaatggtgaaaatgggcatccttgtcttgttccagattcagagaagaagatttttatttttttcccattcagtatgatgttagctgtggatttgtcatatatttattttattatgttgaggtgtgttccttctgtgtgtaatttgttgagaatttttattatgaatagatgttgattttttcaaatgctttttctgaatctattggaatgatcatatgttttttgtcctccattttgttaatgtgatgtatcacgtttactgatttgcatatgttgaatcattcttgaatccatgggatgaaccccacttgattatggtgaatgatctttataatatgctgtttaattcagtttgctggtattttgttgaggctttttgcacctatcttcattggagatatttacctgtagttttctttgtctgtatgtgtccttgtctaattttggtatctgggtaatgctggcctcatagaatgagtgtggaagaattccctcctcttcagttttttggaagagtttgagaagaattcatattaatttttctctaaatgtttggtagaattcagcagtgaagacgtcaggttctgggctctttttttgatggagactttttattactaattcaatcttgttatttgttatggtctgttcagattttctacttcttcatgattcaatcctggcaggttatatgggatcagggatttatccatgtcttctgtgttttccaatttgttggcatacacttgttgacagatgactcttataattctttgtatctctgtagtgtccattataatgtctattttcatctctgattttatttatttaaatattctctctcttttcttagtctcacaaaaattttgtcacttgtttatcttttcaaaaaacaaactatattgtttatcttttttatctctgttttctttatactgctctgatctttattagttctttctttctactagttgtgggtttaatttgttcttgtttttctagttctttgaagtacaacattaagttgtttatgggagatctttcttcttttttaatgtaggcattttaatatagtttattgctataacttccaaatactgctttttttggtaacctatatgttttgggatgttgtatttccattttcatttgactctagaaattttataatttctcttttaatttcttcgttgacctgttggttgttctggagcatgttgtttaatttccatgtatatgcacagtttccaaagggagcaaaaaagaaacaaatgatctacaaagcaaccagaaaacaattaataaagaggcagtagtaggtccttgcccatcaataattagtttgatgtaaatggattaaattctccaatcaaaatacataaagtgactgaatggacaaaaaaatccaagatccaagaatatgttgcctaaaagagacccactttagccttaaagatacacataaactgaaagtaaagggatagaagaagatattccatgcaaatggagaaagaaaaagaaaataggattggctatgcttatataaatatgattaaagacaaaaactgtcacaggagacaaagaagatcattatttaatgagaaagggctcaattcatcacgaagacaaaacaattggaaatatataggcacctcacattagagtacctaaatatataaagcaaatattaatggacataaagggagaaatgggtagcaatacaataatagtaaaggacattaataccccattttcaacaatagacagatcaatcagacagaaaattaataatgaagtattggaattaaactgcactttagccaaaacagaccaaaaatatacatacagaacttaatatccaatggtagcagcatttttctctagtgcacatgtaatgtccttcaaggtagcttatgtggtaggccacaaaacaagacttaaccaacttttaaaaattaaaatcatcttaagtatcatttctgaccataatggtatgaataaataacagtagaaactttttttttttcctgaactgggggctttcaaaaatcatgccttccttttggaacacacttgatcccggtcataaccctttcactttaattctaactttaggtctcagcaaaaatgtaatttctgcatggaagcagcctctgatcccccaagctgaattacgtgttcctgcaacgtgttgactataattttgctctagcagaatgtatcagtattgactatagtagtttgttagttttctactaaagtagcactttagctctctgaggccaggactgactgtatctgtttaaatcaccctgaattataccctcatccttccatcaatctctactcagtaaatacttctgaatcaacaaataaatctagccatggagagcaagttgagtgaacaatgaatggggagtggaggggacctggtggagatatccacagggtacaaattaagtgtatgatccttagacataaaaatgtctgttcctgatgccggtgccaccacttaacaacattattatttgcagcaaatgttttcacttctctgtgcctcagtttcttactctctttgtttggaataatttgaagtccttccccatagacatgctaaaagcattgcctgaggtacatgtgtaaagtgcccagaatggtgcctgatacaccattagcactcttgagtgttagatattacaagggttgcactgtctctggggtgaagtactgttgctggtggccatttccacgtgcacatctgaatagaaagtcatgatggtgaagcatgatggaactggcagctctgatgtagaagaaaaatctgctagacatggaagactgagtaaggagttccacatatcagccattatcccatatctgtaactctgggaagacagtttatgcaactgatatcctccaaaagatagatccaaggaaaacacactctttctttctcagaaaacgctagatgtgtatgtttttttaaaattttagttccagaatgaataaatataaggaaaaaataaacaaatataccacgagtcctattaaaataatttggaacaggatgaagggatgatggaattttggaaacaatagtttttcaatattctgttgaagtcttaggtttgcatgtgaatagcaactttcccatgtgatagggaaaaaagtatttctttttttttcccataagttattggggtccaggtggtatttggttacattagtaagttcttcagtggtaatttcggagattttggtgcacccatcacccgagcagtatacactgcaccatatttgcagtcttttatcccttgcccccctcctactctttcccccaagtccccaaagtccattgtatcattcttatgcctatgcgttctcatagcttagatcccacatatgagtgagaacatctgatgtttggttttccattcctgagttacttcacttagaataatagtctccaatctcatccaggtcactgccaatgctgttaattcattcctttttatagctgcatagtattccattgtgtgtgtgtgtgagatacatatatgtatctcacagtttatcctctcattgattgatgggcatttgggttgtgtgtgcaagtatctttttcgtataatgacttcttttctttgggtagatacccaggagtgggattgctggatcaaatgatagttctacttttagttctttaaggactctccacactgttttccatactagctgtactagtttgcattcctaccagcagtgtagaagtgttccctgttcaccgcatctatgccaacatctactgttttttgatttctttgattatggccattcttgcgggagtaaggtggtattgcattgtggttttgatttgcatttccatgatcattggtgatgttgagcattttttcgtatgtttgttggccacttgtatatcttcttttggaattatctattcatgtccttagcccactttttgatgggattgtttgttttgttcttactgatttgtttgagtttgttgtagattctggatattagtcctttgtcagatgtatagattgtgaagattttctcccactccgtgggttgtctgtttactctgctgactgttccttttgccgtgcaaaagctctttagtttaattaggtcccagctatttatctttgtttttattgcatttgcttttgggttcttggtcatgaaattcttgcctaagccaatgtctcgaagggtttttccaatgttatcttctataatttttatagcttcaggtcttaggtttaagcccttaatccatcttgagttgagttttgtataaggtgagagatgaggatccagtttcattctcctacatgtggctagccaattatctgagtaccatttgttgaaaaggatgtctttcccccactttatgtttttgtttgctttgtcaaagatcagttgactgtaagtatttgggtttatttctgggttctttattctgttccattgatctatgtgtctatttttataccagtaccacgccattttggtgactatgaccttatagtatagtttgaaatcggatagtgcactgcctccagatttgttctttttgtttagtcttgctttggctagactatttcaagtgtggatgagaaaaatctgcaaggacttccagtccaaacctaagaaactgtaggttgacacatgtcatatttgatttagtatgcaatccataaatccctaccataaaaaaccataaatagcttataatcaagagatcttcttatctttccccatcacatttattatcttggtagctggtaaactatttaaagaagaaaaacagaaggaaatccttcaaagtatgaaacctctggaactgcacaagaattctgaaactggggctgcagctggctctactcatcacatccttctctactggcatcatggcacattccttaggaaaagacaaactggtggataaggcaaaactacactgagctgttctcagtaggaatgagcacactgtccatgtgttcatgtcatggctaagccagacacattatgaagctcagagtcaacaatcgccaggggccctgggagtgctggctcaacataccgaagcatgacagaaagaatcaagaaaagcattgcttccttgcaaatatggcttgtttgtttcttattagcaatgcatgatattgatcctgcctgcagcgcattgccaatacttcagataaaatcggtatctcagcatggtgagggacaactggaagctggtctttaaaaagtgatttcaaaagacagacacttggcttctaaacagcttgcaaatggtctcataatacaggcaagaaaattaattacatgccaatggactccccagggtgtcatatattgtgtggaataattcttctcgcacagctgtgagtgaaaccttcaaaaaggaacaaaagctttgctggtcaattctgctcaggcccttttgccctccacatgccacacaaacacaaaacaatgtgttcttttccacagttgttgtgcttatgcccaactggatgcgtttccttcataagagctttgtttctagccaggacctaggaggaaaacttacccatagaagatcaaaggcatctagtgttggcacgaatttttatttaaaatttaaatgtattagtgatttatgtgtcataatgaataatacagcatgatgttctcacaaacggctgtatgagcattaaagatgtatgtaatttgattctctaatgagaaatctggcactgtcatgggaaaaaaatattatctagtcttctaccgtgaatgtgtcttttgactttttagtgggtccaatctttctgaaaaaaaaaaaactatcataaaaatgaaattagacatttgttgaatgtgagaaaaaaatttcacagaaggaaattgtgtgaattagatgcaaacagatggtaagattatgtggctgcctgcctgcctgctctgtcaatgggaaaggagtcgtggcaaggttaagagggcagcgaaaatatgaatgtcctcaccgtccttctaccagggcttgagaagccaacggattaatccgactctgtcttcatcagtttaaaggaaagggccagaggaataaatatgatttttttgtaatgattttgaaacaagaaagtaaaaaaaaaaaatctattcttctctattttcagatgtagtcaattgatactaaaagaaaatcatttccctttgactttatatctagaaaacaaattcttaaatgaaggaggacaattttatcccccaggggacatttggttatgcttgaagacacttttggttgtcacaacttggggaggaatgtgaggttactagcatttggtggggagaggccagggatgcttctcaataccctataacgcacaggacattccctcccttcctgactacagtgagtaattatccagcccaaagatagtctcatctgaacaagaaagaagtgtagcattcctattcctattgccttaaatcaagtgctttgaggattcatttccatcaccttgctcaatgctgtaggcacttgagtttgggacccttagatattctggtgcaagactttttttgttcatttgctttttcagatgaggaacagaagcccagagagggcacgcatgttgcttaagttctcagtatgctggtaacacagactaatacactttccattccttctgtctccacactatctgtttctttgttatctacatgcagaatgcatagtgtgaacataggtttgtgtgtgcatgtgtgtgtgtgtgtgtgtgtgtgtgtgtgtgtgtgtgatttttctttagcccagaggtattcataatgaacagctcactatagcagataggtgttttattttttaagcattgaccaattaatatccagatttctaagaagatattttctaaaacctgcacatttgaaggaaaatttatctttgattgtctgcgtgttatttcctacttccatgatttctctctgtcaccaacaaaataagaatttatataatacatcctttactggtctacatcccacttgtcagtcgatcttttatggaatcactgagctcctcacctctgctttcctaagatgcacagtggaatattttctttgttttgaagcaaaagaaatgggagttgcacaaaataaaagccaagaggccagtaatgaataagcttccaaggatgtacaaggcagatttgcatcaggaacatgtggacctatctggttttgtgctgcttcccacaaactctcaatttggaaagatttttcaaaattgttttttgttattaactagaatgtgaatagggctttgataagcagtgttcctactagataaaatccttagagctttttaattctgtgcttgaggacaagcccagatgttctcttcatgaccttccatgaggtttctttttgctagcaggtattgcaatgtagtttactacaagctctagtggagcaaacctccaaagtaaagcacttttattgccaatatttctgcaaatgcagatgctagcctatttttggaaacattaaacatttcagaataattaattgaggaagagattcacaattcacaaggaatctccatcaagattagttgaggctggcatagtactttgaacagtaaagtctctttttagatatacgccatgatataatttttaaaatgtgatttgtattcaactctttacttctaccaaccttttctgaatagggcatctactcattttaagggctggaccacatacagcagaagccaagatgagttgagtgccttttatgcataaaaataactctctaaagtaggagtaaaaggaagtaaaagaggtttgtaatactgcctggtcacaggcgcaaatcaaagtgtgcacccagtgcagaggggagggtgattttaacaaggacaccaattgaaaggtcagcaagtgactcagaggctgacaacaatgccaggtcttaaagactgaggagggatctccattgaacaaagaaggagaaagacattccagaaacaggggatgcctaggcacaggctcagaggcagaagcaaatgctctttttagatagataacagctagaagagagtggctgctgaattattagacaaaggagatgagaactgaagagcaggagagtagagagactagggaaaggatgagaggaacttgtgtgccatgttaaggagcttgacttttattaggtaaaaaaatatagggtccttgaagggttttaagcagagcaatacatgatgatgatagctacaggaggcagagaaattttagtagacaggggtgggtccctggcaaaacctcaccattgagccagaaagcctgaaacctgaggcccaaagggagaacttccatccctgtgtgccttctgtctcccagttggttgtttctgaataatgtctttttaccaattgaatgttgacttttccaaaactacctatggcccgccctgcccccatcctgtgcctataaagagcacagactcagtcagcaaaggagagaagcagctggacgtcggggagaggagacttaacttcagagatggcggctggttgaggcaacttgactttggaagagaaagactgaaaggtggcttgactttaagggagagcaaactacccttcttgtcccctttccagcttccctctctgctgagagctgctttcattactcaataaaattctccacattcatcatccttcaatttgtctgcatgacctcattcttctagggaaccagacaagaatttgggatgcaccaagtggggtaccccaaaaggcagtcacactggccctttgccctcgctgccagagggcagccgtcccatgtgatgaggcaaagggcccactgagctgataacacaccctaacctggatgctgccacaaggcctgcacagagtttgctcctgccggcgctgaagtggccgaccagttcctgcattcgttcactcacacgctccctcccacaagggttggagcccgggggaccctagtgaatggaatttgctcctgccaggcttccggcaggttcctgcactcgcttgatctggttcctgcacttgttcgcttgcacgctccccgccgcacggcaggggcacccctgtcaagagtcccgccaaggggtcaagaaaatatcctgcatcgatgatgtttgtgttttaaaaacataacaaggtcacagaagaacttatacctgatagattggagactacatgaatctgaaacctactcagtagttgcacagagttttttgataaacataaaaatgggcccttctggtattaaagcttgaaacttacatttgttttatctgagttccatcctcaggaaaggaccccccaagcctctcaaaaagcatcaaagggcgctgggcacggtggctcatgcctgtaatcctagcactttgggaggccgaggcgggtggatcacgaggtcaagagatcaagaccatcctggccaacatggtgaaaccccgtctctattaaaaatacaaaaattagctgggcgtcatagtgtgtgcctgtagtcccagctacttgggaggctgaggcaggagaatcgcttgaacctgggaggcggaagttgcagtgagccgagatcgcaccactgcactccagcctggcaacaaaaaagggagactccatctcaaaaaaaaaaaaaaaaagtatcgaagggctgaaactcaccagatcactgcatgtagacaatgagggtccaggcccttcattcctcatgattgctttcttacccctcccaagttcctgttttctcaggcatagttaacctttcttccctgctatataaacttctgattctagttggtcagggagatagattcaagactgatatcccatctccttggctacagcacctgattaaagccttcttctttggcaatacttgtctcagtgattggctttccatgtggtaagaagcaggacctagaccaaacccctgctgtcttggtaacaaatcatcaccataaggaaaggcacatatgagagtggatgtttccagcaagtgtggatggtgccattgttgagtgggaaaagagatctaataactgggtctggactgggggaaagaagaaaattagttttgtgttggacaaagtgaactttagattcctatgggtatagtgaagaagatgctaggaattagaaggaagatttagatgttataggatgatcatggtcattctaaccctgaaaggtgaagatgtgattggaagataattgtatatcctaatatatatatatatatatatatatatatatatatatatatatatatacacactacatatgccatctgaagatagcagtgtctccagtatagtaggaggaaaggattgataacagaaagcatactttttatagatggtagtctatatgacaatgccaccagtaacagttagtttctgtcttttaatataaatttcttctggtagagtaatgtgacattacccacaagctgacatcagcatgcaggtggagttttttggctcctttggaggctgttacatttctaactcattggttattgccattcatgtagtaaatatttaaacatacttattgaataaatgaatgaacacaagattatttcccccatcatcactgaagagggagggcactcattaaaagtgaattttctagatattgcatattgattttttaaagtacactattccaggaagctccttcaaaaattacagtatatatatatacatgtatatatatacacactactatatatataactatatacagtatatatagagagaaagagagatctataaagcttttgactactcaactagatgtcttcaaagggccattaggattccagggtgctctcagtttattatttgttagtttatcagttttaaatttaaatgattttgttttctgtcttccttgacactcagcctaacacatatagcctagaaaagcactgcagtagaaatgacatcattgacatcattaaaatagtgattatataccttgtccatttggtaggttgtggttgggccagcatcatgcctccctttgcagcaaagttcgccaacactgatgtttcctccccccttttttttcttgcaattgtttcacagtctgaagctactgtatgtctgactgaggttatcagtacatctgaccgctggaaatgtgaaagcattactggagaaagaaaaactagtaactggaaaattctttcccatccagatttgcacagatcttctttctaggaaaatgtagaatttcttaggaaaaatctagattttattacgaaaaccttaggggttcacctttaacgtggaatcggagtctatggaaatgcagtctaaggcaagaggttgcagtttcaaagcaccaccaatgtcaacttcacagaaatacacacaaggcccttttaagaattttgccaactcatgttattagtgattctgagaaaattactgtactccaacactgaatatatcaaataaatattcttatgccttatacaaaaatcagaaaatatagaagatatcagagacacaatatccttaccttccggagagaagaatcatttaccacctactctttgggattttatgtaaatataccatcctttgcacaacactttatagttcataaggcattcttaaaattagtgtttcatttggactttagtaccttttgtaaaggaaattgggggtggatattgcaatccctgtattagaagtaagcaaacagacacttgaaaatgagctcttcttttcttaatccagcaactccacattgctacacacataagattttcctgtgttattgagtgaaaacgtgagaggaaagtaaaagtagaaagcaaattcaatttccttgtctattttagaatcccataatgctcaggggatgattacgaagacaaactgttcttctaaaccttcttccaatatttagtctgtactgaaatctctttagaatatggctaatatgttaaaaaaaaattaaaccacccttctctggaagttgaggagatgggggactctaagcccacccactcatctccccctttcccttattcattcttccatattctctgtcttctgcccatccttgaagcatagtttgaaaatcattctcttgaaagatagattcaatatgttcttggtaatatctaaattaaggctgctttgtagtaagtcacatcctgtttgtggaattcaaagagaacatgaattcaagtcagttacaacaaagtcatttgcccaggaatccactgtgaatgataccattaaaattaaaaaatgatttgcaagttagaaattaactcttcggctaaaatagaatatctgtttaagttattatagattggtgctgattttgtcagtgcgattcactttttttcccctaggatctttttatacttctacatggacgttttagtagtacggtattcaatagtacttaagctaattaacaatataatagtgggaaagaggctatcaaacttaagtagctgattactgagtgattactattgacagtagctcttatttcttctctgttagctttcctcattaacacttttgtaatagacaattgggttgggtttttggaatctaatgtcagatttcatatatctttcactaaggtttccctatccccagtggagaaaaaaatggaatggcccatgcaaaagaatgcattaacatttttttttttttggagacagagtattgctgtgttgcccaggctggagtaaagtggcacaatcatagcttagtacagcctcgaactcctgggctcaggtaatcctcctgccttagcctccccagtaactagctgggagtacaggtgagtgccaccatgcccagctaattttacttttttatttttgtggagatagggcctcactattttgcccaggctagtttctagctcctggcttaacatcccacctcagcctctgctttataaaatattaaaacttcttgttgaatacagaggtggaagctgatatcattctgacgtattggattcatgaatgacaaagaggaatcatttatttcagacttttttttttattatactttaagttctagggtacatgtgcacaacgtgcaagtttgttacatatgtatacatgtaccatgttggtgtgctgcacccattaactcgtcatttacattaggtatattgcagacattttaaagccagcaaaatgttacagaagtatacagatgagagtgaatttactagttgtgttttaggttgaatgggatgctaggtcggatccaatgtatttttatttgtttgttttttgtttgtttttgtttttgtttttgtttttttgagacggagtctcgctctgtcacccaggctggagtgcagtggcacaatcttggctcactgcaagctctgcctcccgggttcaagccattctcctgcctcagcctcccgagtagctgggattacaggcacacaccaccacacccggctaatttttgtatttttagtagagatggggtttcaccatgttggccaggctggtctcaaactcctgacctcaagtgatccacccaccttggcctcccaaagttctgggattacaggtgtgagctaccacgcccggcccagtgtgtttttaaatagctttgctccatgaacgtgggccttcatattgcttttttctctcccttcagatacattcatgataaaacctctgcccaaaaatcttacacagacataattcaggttgtaaaagtgttttcttagatttcctaattaacagctgggatataaatataaatactgaaaattagtatggtagagaaagaaaaggaataatttcttaaagtttttcacttacaagattttttttcttctacatgtttcctctaatccagtaagtggaacaatcactttttgtttggagtctgtatgttaccatgttttcaatttggttacatgagactgactgactgcttttctggaaacttacaaaggccttttttcccccgtcatctgtcctaatttcaaataagcagttagcagccaaaatgactttctaaaagtcatctatttgacctctgattatcactcctctgtttaagaaccctcagtattttccattttctagaggataacgctcaaatttcccatggtgtgtacaagagccttcactattagcctggaaatcctcaccaattaaaagccctgtccccagtggtctgcacctaccccttcaaaagacccttttaagcctgccattttccttctacctagattagctttttccttctagttcacctggggaaatcctattttataatccaggtcaaatatcacacttgctgatctattttccttctaactttagcagagttatcttctattctcctcagacactttgcaatatcctccctacagcacctaacacattacattgacatgtcttatgtagcacggtaattctgaactgaaaataagtgtgttctccaggaaacatttggccatatctggagacattcttggttgtcactattaggaagagctggtgtctagtgtgtataagccaagaatgctcctaaacatcctacaatgcccaggacagcccccatgacaaagacccaccacgcaaaaaatgtcaataataactgggattgaggaatcctgccttagaacatgagccatatcttattcattcttggagtcttccttctcccctcccctcctcccatcaaagagcctgacaccaacagatccttaagacatgtagaatgaaattaacattatgtggttatttcctaaatttcttttcttgcttaaaccacgttatccacaaaaaaattcactccctgtcacttctttcctgctaccaggtttacccttatgtagcatggcattctacatggatgatggggtcgtaaccagtattattgccatttcttgcagatcacaccatttacaaaaacaatgtctctgtgtgttctgccatttccctgtgaaatctgttctccctcattttcaagaatcagattcaactttgctccagtaaatcccagaacccactctttttctgcaacttcagatatgccctagggtccaccatggtaggccaggaaagaatgaacctcctgctctctgctgtgtgactgtggcattacatgccttgtatattttgttttgttatttcctttgccagtgttcaaattcagtttcagtctttcattcctttccaaataccccttggtttccttggaatcgtattgagcccttactcatccattaataatttaaaaattaacctaattctgtttacattagggaatagtcggtttaataatatgtttcttattttttaaaaaataagagaggctctttattcgtgtggaataggctttggttttttttatgagaaaaatctccttcccagtccaacttctcaaataattttaaaaactcccagatggttaaatgggttttaaaaatggaaactccatttaaaagatgtattggtatatataagagcaaaaaggaaggggaaagggcttctttattttcttcagctacttcttcaaaataacttttctctttactataaaataaaatatgattttcttttcaacattcaaatacaaaatactgatgcccaacattaaacttacggtcccttaattctgtagggacatcagaagattaattaagggcggcaatttcaaaggactaatttagaaaaaaaaatattttaactatacaacaaaatagcagcatactgaacacataacgtgctgcaagtatgcttcttagagtattatttttaatggttgaaaacagaagattacttaagggtcctactatagagagcactccacacaatggaatattatcatctttaaaaggtataattaggaagaatactaagggggccgggtgtggtagctcacgcctataatcccagcactttgggagacagaggcaggtggatcatttgaggtcaggagttcgagaccagcctggccatcatggtgaaaagctgtctctattaaaaatacaaaaattagttggggtgtggtggcaggtgcctgtattcccagctatttcagaggctgaggcaggagaatcgcttgaacctggggtgcagaggtttcagtgagcctagattgcaccaccgcactccagcctgggtgacagaaggagaccccatctcgaggaagaagaagaagaaggaggaggaggagaagaacaagaagaagaagaggaagaagaagaggaagaggaagaagaagaggaagaggaagaagaagaggaagaggaggaggaggaagaggaggaggaaggagggatgtgactaaatgttctcatttattaaggggaggaaaaaggggttgaaaaccttatgtgcatgcaattccacacatacatacatgtgcacacacacaaatggactcacgcactcatgcaacacatggtcagaaacagctacacatcagtttcctcttggtggtaagagtaaggcatttatatgaatatatacacatattattttctgagacaggggcttgctcttgctctgttgcccaggctagagtgacttgatcgtggctcactgcaaccttgaactcctgggcacaagtgatcctcccacctccgcttcccaagtagttgggactacaggtgcacaccaccgcacctggctaatgttttcaattttttattttttgtagatacaggatttctcactatgttgcctgggctagtctcaaactcctggcctcaagcaatgctcccaactcagcctcccaaagtgtagagattacaggcatgagccaccacgcctggtctatatttttatttttaaaatttctgtccctatttgaggtatcaaatgcctaaaagtgcaaacagttttgttgatcagttggatgagtttttacctatgagaatcctgtgtaacattcacccaaatgtagacatgggcgatttctgacaccctgggaagcttgttcatgttcttttctacccagatccccaggttgcagcctctattctaactcctctcataatagtttcagtttgtgggtaggtttttttgatgttgttgtcataaatatattttcatagattttgtaatgcatattacgttttagaaatcctgtaagtgaaatgattttagaatgagaagagaaagagaggttggaaggagggatgatggaaagaagaaaggaaggaaagaaggaggaaatgaagagaggatggaggaagtgaggaaaggaaggaaaagaaaggggaaagaaaggaaaaaggaaagggagagggaagggagggaatggaaggagggaagaaagaagggagaaagggagaaaggatgggaggaaggaagggaaggaggaagcgagggaggaagggaaggaaaaaggaaaacaggagggagagaagaagggagggagagagggaggaagtaagggagaagagaggaaagaaagaaggaagggaggaaggaggaggaagggaaagagtaagggagacaggagagaggaagtaagggaggaagggagaagagaggagggaaggaaggaaaggaaggagggaggaaggaagagaggaagaagggagggaaaaagggagggaggaagagaaggaggaagggaggaagaagagaaagaaggggatgagagggaggaagaaaataagggaaggagggaaggagggaggatggcgggagaatgagcttgccagggtagccctgcagtctccattgtctgtgagagcctccatgcttgggcaccacacaaccccaagtcctgaactttacccttcataactgtgacgttcccaaatcaagcactcctttaaatcgatgccttggccatctcctcttgagggatccttgagaggataaaatacaattcttccttttattttttatttttatttttatttttattatactttaagttttagggtacatgtgcacaacgtgcaggtttgttacatatgtatacatgtgccatgttggtgtgctgcacccattaactcgtcatttagcattaggtatatttcctaatgctatccctcccccctccccccaccccacaacagtccctgatgtgtgatgctccccttcctgtgtccatgtgttctcattgttcaattcccacctatgagtgagaacatgcggtgtttggttttttgtccttgcgatagtttgctgagaatgatagtttacagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttataatcctttgggtatatacccagtaatgggatggctgggtcaaatagtatttctagttctacatccctgaggaatcgccacaccgacttccacaatggttgaactagtttacattcccaccaacagtggaaaagtgttcctatttctccacatcctctccagcacctgttgtttcctgactttttaatgatcgccattctaactggtgtgagatggtatcttattgttgttttgatttgcatttctctaatgatcagtgatgctgagctttttttcatgtttgttgaccacataaatgtcttcttttgagaagtgtcttttcatatcctttgcccgctttttgatggggttgtttgtttttttcttgtagatttgtttaagttcattgtagattctggatattagacctttgtcagatgagtagattgtaaaaaatttctcccattctgtaggttgcctgttcactctgatgctagtttcttttgctgtgcagaagctctttagtttaattagatcccattttggcttctgttgcaattgctttttgcatttttgtcatgaagtctttgcccatgcctatgtcctgattggtattgcctaggttatctactagggtttttatggttttcggttttacatttaagtctttaatccatcttgagttaatttttgtataaggtgtaaggaggaggtccagtttcagttttctgcatatggctagccagtagaaagtcttaaaaataaatcttggctcttcaccctgcgttattttcccctgtaatgtttatgaccttctaatatagtcatataatctactcatttgttgaatgaatgaatgaatgaatgaatgaaaagaaccccgctgaattttccttgtcactattttgacttacccattctgatgggcttggcagctattccctaagcgtcatcactctgtttatctcatttttgagagtggagctcattatccaccttcccatctttgccaacaactaggggctgggcacagtcactcatacctgtaatcccaaccaaaatcttgcctgggagaaattcggggaagatgcagcacgtttcctcaagggtctatgggtgtcacattcttgatttatatcccacctaagatctgtctatcaggatgaaagggacatgaaaaaagaacattcggacaccctgacatgggtcctgttttcagctgacagagagactgaaattcataacgttctttgtagggcatggtgggatgttgatattttaattccatgaaattattgaagagaaattctataataaaatatgaccatgttctatgtgcagtcccaaagctcagccacagctgtgcttctctataacaggccagttctgaatttttcctcaggctatttatttgcttctttgagagtggtttgtcttttacaagtagacaggcagtagcaaattcctgtgacttgagaaaagcttttggaaaaacttagaactgacaagttttaaccattgacttatgcttccatcctcctgcgaaccagggcaggctgctgtgattccattgcaactgcacattatttaactctagtttacagagctaggttctgtgagagcaagtctcagcaccatggagatgcaattagaacaaaatactcactgttaaacagtgtctgcccttgtgtctaattgtctcacatggatatttctgaatttatgccagatgacttagtagctattttttgaacacccgtgatgtgcagtcactgtcctaataagtgctggggatatatgaaagaaaatgaacatcttgcttcgagtctaatatggaagaaaaataacaagtgagccaataggtcaaactcttcttagtggaatctctgcttctcaagatttggtctccttagggacatctcagttaaaattgctgatggatcttcatggtgtgtagtaggaaaaatgaagtcttggcaatctccctcgatgcctgaatattttcctggacattctccacctcgtatctcttctgaacccttctccagcctgctctcagctgacctacagtggacatcattaacaggtccctttgccctttgctttctgtcagctgaactctccgggtgagctagtaatgtatccaaaggtgagctgggagtgaagccatggtctgcatcctctgtgctctctgcctaggagaccacaccccgctgctggctgcattcctgagctgaaggaggctgtttctaattctggtacctgctctctcctcctgatccttcagactcaggataagaatggctccctagtccctaaactcagggtgctccatattccccatgtattttcttaccctcacaagccaacttcctgcacatctgtaagtagttcttcactaaatctcaattacttattccatcttagtatgccgccttttactcctcaaataccctgcacaaaatagaaaatcctaacaagacatcaactgctgactctgtgatctgctcccctccctgctcttccttgaaagaaatcccaaactagcccagagcaaaggaatttggtgtgtttttttttgaaatataagttttctagaaagaatcaagaaaaaaattatccatgcatagttttaaaaatgagatgtaactgttgtaactctttagtacttgttccatgtatcattctaccttggattcttgatggctttaaacagccagccagatacgggatgcccaataaatgttcatagagtaaatccgtgcatactgttagggcatttgacatgacagcttaaataaggaactgattgtcttagtgttgatctatatctcagataaataaataaaataacagtggttcagaaacagcaaacaacgcccagccactcaaccaccatattatatttgataagggtagattaaatagtagataaattaatttttattctccctccctctctcctttcctcccttccttccttcttctcttccttccatccttttttccttccttccatcattctttcctccttctctctttctatctctttctttctttacttctttcctaccttctttctttttttccctctgcgtttttagaataaagtagctaaaagaagacaatagagaatgtgcagtaattccatcaatatacaaatggcacatccacaagttaaggctttatgagtgacaaagccttaactttgaaggctttttaagtgctctcttagtaaacacttttgatttcaacctctccaaatatgtgttaatcaaattgttccagtcatttgcgcatttggagaaaaacaggatgtgggtttaatccatctagactgaaaaatgattttctttgtttcaacttaaaaacttagtgggggataagaaagtctacactccaatgattaaataaatggaaaaacagtaggaatgcaacttctcccctgactactccacaaaacagtgtattttaagtcttatttcccaccaacttgtgaatagtatattattcccatgcttacactcatgacatcaaacttaaattaaaaatagttccaatcctccagctcttgatggaatttgaagttaaaatttggcttatgcttacttttactaacaaatacttttgtgctgctgacatgatttttttggtaccattgttagtccagaaaatgccatctgtaacatcttagaatcacgtgaacgctggcttctgtgctaggcaggttcagctagtctaccccacgcatgggaaccatgcgaccaaaccagggctggtagctgattatttttatctctggagaacaaaggaggaggaggctctctcttttatttaatggtgtgtgttaagtgaagccctctaaatacccctccctgatttcatttctctcctttttcaccatggatatgagcactatcctgaatgggtgtttagcactcttatacatgtctttatacttttataacataggtgtgcattcttaaattacataattttacatatttaagaggtttataaatatagagttatagcatacacccttctgcaatgacgactgtgttttatcctttcatcaatgggggaatcactatagaaatttatgctgttgagttcaaaattaatcaccaaaggactctagaacagatgtgttacagtatgatttgtgagctcttcaaaaaggaaaagtggctcacaagaacttcatgatataaaggcgagaccatagagaacaagtgaggttaaggaattgcctccaagtcatgctgcatgaggacaggaaatgaattgagctccaaagctcttgctaaagcttggcgtaggtcctgttggagaaggaaagaagatgacaagaactgcctgacacaccgtatgccggacatcttcaagggtgctatgggattggattctggactagagcctgtgaaccccattcctctgcatgtgtcttagctactttgtgagatctgcctagggtaagtgggaggtgacaaagagaggaccttctccattttacaggccaggtagatcagtaaacagttcctggaggtagaaggttctgtcctcttatgtctagaaccttccaatatttgagtcagtgtgtattaatacgcccaccagatgggctggggtcttcatgaggcattctgcttcctgtagcagtcagcaggtccaccctcccattgtccctggagtccttgttctctggagttcagcagctcgctgtgaatgagctgaggtttttgccatgaggggccctgtttcagagtttgtgacaaccaaaccttaacgaggttaaccccatgtacttcacaccagaacttatgtggttagggtcctctgactagaaactataataataataatatttttcagatagggtcttactctgttgcctacattggagtgcaatggcataatcatggctcactgcagcctcctgggctccatgaatcctcctgcctcagcctcccaaatagctgagactacaggcatgcaaccacaccaggctaattttctttccttttttttttttttttttttttgacggagtctctctctgtctcccaggctggagtgcagtggcacgatctcagctcactgcaagctccgcctcccgggttcacgccattctcctgcctcagcctcccgagtagctgggactacaggtgctcaccaccacgcccagctaatttttttgtattttttagtagagacggggtttcacaatgttagccaggatggtctcgatctcctgacctcatgatccacccgccttggccttctttttttattttattattattatttttttggtagaaaccaggattcactatgctgttcaggctgctctgcaactcctgggctcaagtgatttttctgcctcagcctcccaaagtgcttggattacaatctgattggaaattcttaaacgagatgcaattctgacaccaccatcataaaagatcactctaataaatgggaaggtgaggaacctttaaaaatacatttggttacataaactagagcacatcccaacaatgaaataatgtgcagttgtgaacaggatgagaaagtgctttatgtgctgatatgtaaaatctccagaaagcttttacatagaaaaagttaggaacagaaacagagtatatacagtatgccagtttttgcttaggaaaaggggagtaataatatatattcatatttgaataaacgtttgaagcatatagaatggggaggccagaaatggagaggagggattaacaggtaggagattactcaatatatgccttttcataccatgattttggaaccacataaatttttgtctaagatacattgaatcaagtaagatctagtttaacattctaccgatgttaatttcctatggttgataattacattatggttatgtaagatgttcacattggggtatgaggtaaggacaatattatttttacaactttggggtaagtctaacattagttcaaaacaattgttttaaataaaaggtgatgcacaaatagctgataaacacatgaaaatgtcttccaacgtcattagtcatcaggggaaagcaaattagaaacaagacaaaatgccatttgtatagcaactagaatggctaaaatttttttttaagttgagaacaaaatatttgtgaagctctcctgcattggtggtggaagtataaaatggtccaataatattgttggcaaattcttatggaattaaatatgcacctaccttttgaccccaaaatttcatgcctaggggttaatctatgaaaaacaactgtacaggaatcatcataacttctgtatttacagttgccaaaagctgcaagcaaccgaaatgtgcaaaaggagaatgggtaaaggagctgtttttttttaatgttcctacagtgcagtgccactcagtaatcataagggacaaaggactgacacatcaacaatgcttatgaagctcacatacacggtgatgagtaaaaagaaacttgatagcagagagcttgcactgtatggctccatttacacaaaatgctagagcaggtaaagctaacaaaaggaaaactgtatcagaactgtggttgcctcttgttggatgattaactgggaagaggtaaaagggatgaaaatgatctatatggtagcaaggttgtggattatggaagtgtatctgtttgtcaaaattgtgcagttattttttgtgtgttttagcactacatactttatcgttaaaaaaagcactgtgaaaataataattacctagggtttgggaatgggtagaggtattgatcatagagaatggcagaatatggatagcactgaggtgtggtggtggatttgggggagagtcaataaaccagtctgtttactttttctgtatttgatatttttcacagtaaaaagtttaaaatattctaaaaagaaaaaatacaaattttgctataaagggaagcaatagaagtaacagggatttttttattattaagaagatgaaagcaattataccatgttttaagctaacaggagtagtagagttctcagggctgggagagtgtgtggcaactcaagatgttccctgactgacactgacaatcgaaatgacattttaaaatatgcagtgatcagatcacagtaaatgaatgtcaagaacattgaatcgcaggcttatgaaaaatgctaaggaaagctaagaagtattttggtggtagcttttgggtaagaagaccaagaaaacccacgcctatttctgagagcaggtggtatgttagcagctgtaaagagagttcagagctttttcaaatactgactttcttcttctatttctacaccaaagaaaatggcctttaaattttaaaggtgaaagcaaatagaggtgacaaggatttaagcgtttgataggtgaagaaacaatgagaggacaaagcttcttaaaataaattccaactcagaagaattctatctccagaatggagaatatttgctagtagttgttgattaatgatgcttgacaagagaactactgaaatataagagatgggtaaatataaccccatttcccctttcttttcttttcttaaaagaggatagcattctggaaattacagactattaaatttgacaataatcctctgtgttctagaatagattacctaacaaatgtcttataagcccatagcaaatgaaatagcaatttccagaggctcaatgggtttgcccaaagtatgtccctaccaagccagttttattaaaagccctggatataacttgtctagatgctaacatgttatttggcaatttccctcttgccattctggaggacaagacagacgtataaatgagtgagcctgaaatcagaggattatgcaagtgttcatttacaggcattttgtagtaattttcaccacccactgaaaggctgcatgtctaatgtcacatgtggagacagaacctgtgtttagtgatggaaatgacctatttccatctgcatctatgcctatatttacatatacatgcatatctataacgatcttgtttacctatctcggcataaaattagctcacttttgtcctcacttatatattaaaattagtatgatttaaaatttaaaaatagtgtacattctctatatttgagaatagatggcctgattatttgaatgttccatttcatgtaaggacattgagacatctttctactcttgtgattgcaaaaaattccagattgtaccagcacgttttgctgccatattaaatagagcacatggaatcaaagttagcatttttttggcgattcatcatcttgtgaggcagacagggctggagatggggtggaattagtattggcttctggtagttgttattagaattcaattttaaatagtgccttgtactttccattctcttctgtacaaaaagtgaaaacctgaagtcattagtggacgcttctagctatttatctttgagagccacctgtctttttttcaaaactgtttgtgatggctttaaaaaaatcacagttacttaaaatactagtctaaggaactaccttcctatatggagaaaaaagacataatgaaacagtctctttttgatatttccattcacagactgtcatacttccaatatgtattattgtctgcaagtagctccttagctaataatcaccagtgaattagaaaatcaggaaattcactgtggcatatccaactcccagcactgttaatgagcgttgcggatgattctgcacagataagttcaaagcaaatcactgagaaaatactgacatacttgtagccttttcatttgggggagggtaacacagctccaaaattttaagaaccacctctctttaggcattaacaattcagtgaggaaaatcaattctggttttaagacatcttcccacttaccacttagttaccttctggctcacactgattattttagggtgtgtgattccaaagtaacaatcgttggcagtcttatcacgtagtacatcttagcatgtaattatatgaggttttgagtggttctctaaagttttccttggttgtgcaaattgtgatctcttggtaaaaaggaatggcatttgaactgctttaatatcctcggtctgaaattttattaacattgcaattactctaatagatagattacaataattatttctatacttgctgtggtcgagagaagatgagagtggaaataggaagagttgggtattttacctctttggacttgggcaaagattccttctttcagcttcagttgttcttttgttttgttttgttttcatctacaacagtggaaagaatggtcatcccttagcaggatggtacaaaagttacccaagataattcccaaggtaagtcactgtcttccacaaaatgaggctaatggcattatccccccggaatagtccttacttttagtagcagctcaactaattctagttttcttcttattctgtttttcttttaagaataaacttaagattttgggatagttttataattacaggaaaattacaatgagtagtagtacagagagttcccatataccccagaccctccttcccttattgtaaacatctgctaaatttatcaaaattttagtaaaccaaggttgacatgttagtgttaactaaagtccacttcttattcggatttcccttacatttttatttaatgtctcttttctgttccaggatctcatccggggtaacatatcgcactatttgtcatgttttcttgagctctctttggttttgacaatttttcaaacgctttattggtgatcttgacaattatggggacagttagagaatcagatattttgtaaaatgcccctcagttgatatgaatgagatgtttttctcccaggattagactgggtttataggtttttgaggggaaatcacaaaaatacttttgcttttccttcccttcattttccatccatttcttttttcctttgctcatattttctttttttttttcctttcctttattttctaaataggcttctcttcctcattgccctgggaaaaaatttattcacttatttatttatttatttatttatttatttatttatttatttattgaaataggatcttgctctattgcccaggctggaatgcagtgccgcagtcatggttcactgcagcctgaaactgctgtgctcaggtgatcctcccacctcagcctcctgagtgagtgtttaggctccttttaacccagtaagtgtaattggatgttcagacacatcaaaaaaaggaagttaaatgtacatactctaaaaaacataagagttttattttgatgtgctgaatcaggtccaggtggaacgtttcaggaagcagaaataattaggagggttaggattgtaaacataaataaataataataaacaatccatactgaaacccttgaaaagggtgttaacgaaaagcatttatgagaacggacaagtgagaaaaataatattggaagcatccttaaggtctcgatattttgcatagctttcttatagaatttaagtttcacacctttattagcagatttattgcctaaataaaatgtaaattaatttttttaaacctgggcagaagatgaaacacactcagaaagcgggataggtttatttgtttcatggggttgagtaataacaaagataatgatttctgggccttggtgttgatttccgacacagtctggcaggtttggcagtgtgagggacttcatgtgtattaagctctgaaactgctaaggcctcccttcaagcctattctattttcccatcaggattgttgcatttctaagcttagagattatctattgcatatctgtagtgtccttggactctgaaagtatcagtcattggttactcaagtctcttgggctggttaattgcatctgtcatcttgactgggccacagggtgcccagatacgtggtcaaacttattgagtctgtctgggaaggtgttttagatgttttatttttaattcttgtgggtacatagtaggcacatataactatggggcacgtgagatactttggtacagtcatgcagtacataataatcacatcatggaaaattaggtattcattccttccagcatttaacctctggtgggagggggttttaggatgagattaacatttacatcgatgactgaatgaagcagattgtccttgccaatgtggctggaccttgtccaatcagtcaaatgcctgaaaagtacaaagactgaccttccccgagcgacagagaattctcctgcctgtcagctttcaaactggggcatagactcttcctggttctgcagctgcctgccagccttaggacttgtattgggagatcatttggagtttctacaggttttcgacttttcagcttctacaattgcatgaactaatttcttatcataagtctctttctgtctctctctgtgtgtatgtgtgtgtgcacagattatatatatcatgtatatctttactggagctgtctatcctgtatctctctatgtagggagagacttgttttaaagaattggcttatgcagttatagaggctgactacacacatgcacacacacagacacatcttaatatgtatatctttattggagacatacagatctcatatcaattctatttatctggagatccctgactaatatagctatcttctctacttatgcacacattgtgtaaatggattaaagtcttttccaaatactcccatgtcataggtcaggactataccatttgattagcataaattatgcttccacaactcgtttggaaaggaatggcagaattcaggctttctgcttatctaatcaaatgggagtgatttcgctgattatcttcattttgtgctcatttacttcaatttaaatcaaccatcattaagctcctacccaacattcgtgggacaggttattatcagacaaggttcttgtgcaattgcattgagctgtgcaaagaaaaacaactcttttgagggcttgggaaaagggtctgaactacacaagagagatatacagggacacaaggtcagaagcacgtggccttttgagaagctgctgagaactgaagttatatttttataacaagaacaaagcaagcctctgttttaacttttccttatgcattcagaactttgaaaggcgagacttgtcaggcaccaggagagacacaagtgcttctagatcaggggtcagcaaactttttttctgcaaaaagctctattatcagattttaggcttttcaggccagtctttgccactaatactcagctgcaccattttaacacaaaagtcacagtgggcaatccacacatgatacacaatgcacatggctgcatgttagtaaaactgtatgtatggacactaaaatttaaatttcttatacacttcacatgtcatgaaatattcttcttttggtttttcttttggaacactatttacaaatgtaagcatcatttgtagctcgtaggctgcataaaatcaggcagcaagcagatctggtccttgggatgtagttcgccaaccactgttctgtggtatcagtttcatacatacttcttatgtggtaatgtgcaccgagaaaaggaaagacaccatttccccctcagtcgcaatactatagaaagtgcttgattaaattgacataagtactaacatcttatccacattgatgtttagctaatttattttgtataacaataatacaaagagttctttttacctgttacactaaaaaaagtatattaatatttcattttacccctctttgaaaggcaccaatgaaaaccaattattttatataacattgcagttctatccaaatatcaagttcaaaaggtggccttggaatttattgttttttgttttttgtttttttttgagccagggtctgactctgttgtccaggctggagtgcagtagtgtgatcatggctcactgcagcctcaacctcctgggctcaggtgatcctcccacctcagtctcctaagtagctggtactacaggcgggtgctaccatgcctattttttattttttgtattttttgtagagacggggtttcccaggctggtcttgaactcctgggctcaagcaatccaccctcctcagcctcccaaagtgctgggattaccggcgtgggccaccatgtccagcctggattttttttgaatgaggtttttgcttggttctagggtggctgtctgaatatatgtgaacctcagcctcctcatcactaaatgaggggattgggccagttcaggtatgaagaaactttttcttaaaaggccagccagtaaatatttgggaagccatactatctctagtgcagctattcaactctgttggtgtggcactcaaaagacactgtaaacagaatataaatcaatgggtgtggctgtgttccaataaaactttatgtacaaaaacaagcggagcccaggtttgaaatatagatttctggcccctgatcttgttggtcttaaaatacctttgcagatggagaaatcagatgaatgttgcttcgtaaaaatggaccaccagaggaaacttgggaatgattatttttaactttctaagaagtagattttatctacattttataaataaaatattggtgcataagaagtgctagtttcatgcaattacatcagtggagtcacctatatgaatgatgcattccttatctcaattcttccataagtagaatcacacactccaaggaatttatatgtttcataaagatcagtcaataaccgggaggtaacttatggagatgaattgcatttagttatttcatctcttatttgacatatagattttaagcctgttaaatgttgtcagttaaatgttgtcagtgatgacaaaattgaagcattttctctccttcaatcaacatggtgagctaagtgttaaatggcaattaaaattataacaaaatataatattactgatgtggaaccttcatttcttatttcattatttctcacatttactattctagggagaatagctcagagatatagtaaattcaggctacattaagcaaaatgtctactcatgggaatctcagaaaatgtatttgaagcctccctagaagagtcttgagtcccttggcagtgctaacttgcacaattcctgacccagttcaccttcagttagggatttaaagttactcttcttctgaacaatggcaatttcaataggagggctttttcgctctgtgcacacgtgtggttttcttgtaaatggtttgctgcatgaaaggcaatctggattactttcgttagtcttgtattccaaggaaatcctccgcagggatttccgctgttgtaaggaaaatgcacacactgcaaatttcttccaggaagttgctgaattaacaaaaattaaatcaactaggaagaaaaccttttgcacaagtgagccccggtggcagatgacagtcatctatcagcttggtgcactggtgcttgcagaacattccaggaacgtgcctcagctcactgtctttttcatcctacattttccttatgaaatagctcagcatgaatgtcatcaggtgcttcaggcagatggtgttggaaaatcatttctcaaattgcctcctcgagaaagtggcacttgtaagaattgcattgccgagaaccaatcagcaacctgtgatgtttaagctgcctgctagagtccatttttcatccaaaatgtgactcatattggttggtaggagacaaaacaaacaaacaaaacaaaaaaatgcacatcatgccaaatgttgaagtttgaaatccctgacttggaataaacttttccaaagatcaaattccatgtttagtttaaaatcagtgagtgtattagtctgttctcatgctgctgataaagacatacccaagactgggtaatttatgaagaaaaagaagtttaatggactcacagttccacatggctggggaggcctcacaatcctggtggaagatgaaaggcacgtctcacatggcagcagacaagagagaatgaaagccaggtgaaaggggaaaccccttataaaaccatcagatttcgtgagacttattcactaccacaagaacagtatggggaaaccgcccccatgattcaattatctcctaccagatttcttccacaacatgtgggaattatgggagctgtaattcaaaatgagatttgagtagggacacagccaaaccatatcagtgagtgacttgggttaaaatttagcgatcatatcaccaaatgacctgaaggaataattacctgaaactgttaaatatgtatttggttactttaatttctgtctccttaactaggtaaacatgaaataaagtctcacactttaatcctggcatagactagtaggtgttcaataaatgtcagttgaatgaatttaaaagtgaatacgtattgcattcgaatattgaattgttttctcttattttttataaaatactcagtaaatatacattttaaggatttcagtagaaactctttgagttgatattcttttatttttaaaatgctactcatctggatctgaaaaaggctatagtcattttagatatactaacatttagatctatgagtcaaatttataccagctcattgttttcttgttttattcagggtctgtagccatgctaaaggcacataaaagtttagggttttgttttgcactaatttgtgagacccaaggtttgttttgtgcataaaataccatgtgagtatgcaacacagatatcacattttcaccaggctaaactagcaatcattgttatcaaatgaagcacacttatgccaagacctcaaaagggacatttaggaaccttaaatcactagttattcataaattgtacataatttatttaaaaatgtttcacatagtctttctaaaatgttaagtgtagcatctgcttattatagaaaaatcagaagatcaatagaaagaagagaaaatggccaggtgcagtggaataaaatgagataaaaatgagaagggcttagaaatactaatctctggaatggtctgagacattagaaagaaaatgtaaccaggtcttagtcatactaagtccaatgaaagcaatgtaaatcttgcaaactctattttttgtaattaaataaatgttggttaatatgagataacatctttaatatcaagcacaaagtaatacatatcttaatacatattttacaagatatcttaaattttaaaaatatgaaaataactcgatattgtaacatacataagcaagccaaatatgcatcaaaagtatggcattttaacctaacaaaatggctaaagttaaaaagaaagaaaatgtcaaaagttagtcacaatggaagcaattttcatgcacagctggtaggaatataaattgctacaaaaattgttgggcagtattaatttgaactgaaaacacacctactatataatacagaaattctattcctaggtcacaagaaataagtgtttattctctccaaaagacgtgaacaagaatgtgtataggaactttgttcatcatagccccaaactgaaaagaagccaaatgtccattattaaaataaaggcgttgttctgtattcttaaaatggaatattatataataacaaaaaaatgaatgattccatgcaagaatatggatggatggcacagatataatattaagtaaaagaggctagacacaaaagagtacgtgttgtatgatttcattggtgtaaatttcaagagcatacactaggggtcaaaacagtgcttaacttcagagaatgttgactggaaagaaaaataagggggcttttgggtagtgaaaaagttttatgttttattcttgtatttggttacagaggtatatatgtacagaaaaaaaaatatcaaggctgggtatggtggcttatgcctgtagtcccagcactatgggaggctgaggtgggtggattgcttgagtccagaagttagagatcagcctgggcaacatggcaaaacccagttgctacaaaattagctgggcatggtggtgcatgcctgtagtcccagctactcagggggctgaggtgggaagatcgcttgaacctgggaggttgagactgcagtgagctgattgcacgactgcactccagcttgggtgagagtgagaccctgtctcaaaaaataaaaaaaaagaaaagagaaaagaaaaaaaaatcaagctatattcagttttaatataagctatagtgtaagtaatatgtactttactatatgtattttagaatccatcatttttaaattgagtgtttccatacaactatattggcttgcttctctacaaatcggaaatcttgccatcacaacttcacacatctcatctgtatcaaaagataaaaggtttgaatgaaagaaagtagattttacattttgaaagctctgagatatctcactgccctcttcgttttcattgacagaaataagtcattatttctgtattattgaaagtggagcaacatattcgcttcctcaagcctttattgtgtttcctgaaagccagttcaagagctaaacaataatccaattactactcagtgtttatgaggagcagttcatatccattaccattggaacatcatgttctttctatagactttcgccagtggaaagactgatagaagtgcgcagaatgaggggtagttataggatttccctgaagtttccttttcctaatgaatacactccttcattgtaatagattgacctttgaacactaatgtaagtcttatggctgggtgttttattaattgctagaaccttgctagttggggttgttaattcaccctaaacaaggaccacttgcaattaatctttttctaattcttgacaccatggtttacaattattgttccctttttaaaaaccaattatatattttagtgttttacaaatggacacaaaactgcaggtcccttaaatgattttagtgtcagaagaaaagagtccttagtaacccatcaaagttgggtctataatgcttaaactcatttacatacaagaatagcattaactattaaaaccaagagcatcctttgcaagtaatatatgaattaaagtattccattcaccaaaactacatttgatctgccccatcttattgtatgcttagttagtaacagacaaggacagttcagtcctgccttgtaccttatgaatcagagctgacaagaacagacacagtcctgactgccatgacactgtctatcacgctgatattcaactttcaggaccagggacagcagagagcagtcctaggaatctttacacaaactccctttgccctctgaacaactctctgaaacgaaatgctatctgcttgtcgtccaagccaattgaaatattacaatatgtttcatgactgagggatactttcattttatactttcaatttctcaattcacttatttctccagttaaatggatccttaaaaaaaatgtaacttccagtagggcagtagtggcaaatcctgaatgagaggaaacatggagacaaaaatttagtgtttgcaagattcacactgaactgtctcttcacctatcagctccttgctgtctctgcttggtttatgttaacccttcaattcatctcttgtacctcattttgacatccttattgatctgagctctcagccattagcttggtatcctctggccttcttgtctccttttcctgctttggttctttaaacttttttacaactaaagtcttctcctaggtttccaacaccctccaactgaatcctaataaggagctccatccatggtttttttttcttcttcttcttggccatagtgtcagagaactggctcctgaatactggtatataagtattttgtctttaagcatgttttctctgcttcctgaaaatttaggggaatatatactgaggaaaaacatgcctttggcattatatatatttttaagttgaaaaatatcttccagccaggcacagtggctcacacctgtaatcccagcactttgggaggctgaagcaggaggatcatttgagcccaggtgtttgagaccagcctgggcaacatagtgaaatcttgtctctgaaaaaataaaaaaaaaattagccaggagtggtgacaagtgccttttgtcccaggtactcaggaggctgaggtgggaggatcacttgaccctgggaggtcgaggctgcagtgagttatagagagagattttgtctcaaaaaaagtcttccagtaagcttaatataccaatgaatactttttatcattactagaaacatggtagctacatgatgaaaatataaagcattaacatttgtataatttatcttttaaatgcctatttgctcttgaatgtgctctactaaaacctttgccaccaacaatcccacaaaacatcccttgccaaagtcgctgataatcttcatattgttaaatctaatggccaattcttaatcttcagtttgtctgctctattaacattatttgagacaattgatgtccttcaacttacataatatagttatttttaatttatattctaagagaacacactctggtgattttctccctacttttgtggtcaatttttatcagtctccttcacttttttctcctctctcccaattctaaatcttggagtatgcctcagtatttatttcttgggcagtttcttcttcttcttctgtattcactgccttgattatcttacataatctcaaattaaaatgttaactggatgatgttaaaagccaaattaaatctccagccctgaaggtacataatgagtcctgaagcccagactcataaatctaacttctttttcagcattttcacttgagggtctagtaggcagctctcacttaccaagctccatatcaagctcttcatctccctacttgaaacgtgttactggttttcaccagctgaggaaatgacagtcctgctctgccagctactcagacaattggttctgagtgcctaccccccaacttcatgtgtttctttccgaacactctcacttgcattcttctttagaaggactgtctgctaaggaccacagttagggtattggaggagagagttgttgcccaaagctttcaagggccagagggctattgcttttgttttcaagtccctattaatgtctctgttcatttctctcaggaatgccttgtcattttcattgtagacacctaactatttttattgatgataatagtgcaaacggtttggttcccaaatgtcattttctggtttcttgctactgacatagaaatacaagtgatttttatatgttgattttatgtcttaaggtcttgctaaattaagtgttgtagtgtgtgtttgataagttctttacgatttttcatggaaaaaaatatgttatcttcaaatataaatagtttaacttctttctttctgttcttatgccttgtatttctttttcttgtcctagcaacttcaatacaatgttggctataagtggttagagtcaatatccttcttttattcccaatctttgaaagaaattataatatttcatgattaagtataatttttgctgtagattttccagagcttttttttcttatcaaattgagaatttatctttcttggtgatatgatttggctgtgtccccacccaaatctcattttgaattatagcttccatagttcccatgtgtttggggagggacccagtgggaggtaattgaatcatgggggcagtttcccccatactgttcttgtcatagtgaataagtctcatgagacctgatggctttataaggggaaaccccttttacttggttctcatttctctctttgcctgctgccatataagacatgcctttcaccttccaccatgattgtgaggcctccccagccacgtggaactgtgcgtccgtaaaacctctttttctttataaattgcccagtctcaagtatgtctttaacagcatcataaaaacagactaatacacctggctactttattaatcaattgttttcatgtgtgtcttcttattaaattttgctttttgggacctggcttaagacaggtaggcattacaaaattgttgttagccttacatgtccaacatttttacataaaaataacacaaggcactttttacagtagggatttgttcttttatctatcactctcataagacaggaacaaaacctgtagctgattttaatctcagaaggccaaagccagttccaagctgtttgctgaaacatctttgtctatctcatttctgtgtgctttcgcagattaatgcatgtagtattcaataaatggtcaataacaacatatgacaattcaaaatatattttctgctgttagagagatggatgttatgatccatgctgtaagtgatttgcagtccatgattttagaatactagcaaaacatgcttcttctccccataaaggcaagatgaataggtcacagattgagaagacatctgattcttcaaaaattcttcttgcttcacctccttaggcctctctaagtagtattcactactgggagtgcaatgaggttgaagtagaacttctctctcattcttctaattaactgttttatcattctttttttttttttaaatctctcctgaccaatatgcaagctaaagtactgaaagtaaagaaaaagcgatttcatgcccaggagcagtggctcatatctgcaattctagcattttgggagactgaggcagaaggattgcttgagcccaggagtctgagaccagcctggggaacatagcaagaccctgtctctgtttaaaaaaaaataagaaaaatgtgaacaattagaaagctacaaatagtacaagacaaattctcactaggttttatattctcagaaacatatcaccatttttctggcaaaaatgaatgtgatacgtatggtgagaagtacaatttgttttcagtgcaagctcaactctgtaatttatgctgattataaacaaaaggaataagggtaagttaaatctcaaacctaattccattcaatagtctcaaactctgtctcaatatctgcatgagcatgattatcaagtaatcaaatttactagattcaattttggctgctttaatttacacctctctctgactagcaacattgctcatagttaatgaaatggccccagaggatgcagacatagaatgatggcttaaattgcctactaacagatgcctaagaatggaaggggcatgggttttcaaggtggttaagctgtcggcaagagcaagctgtgagtgatacagtaacagctgtgtcaggcttgaatgagaaggaatttggacatgttaggtaattattttatacttgtgtcactttagtaatacagtttagctgaggaagttgctcatttagcagacacattgtagcagttttctggattgggttgccaatcccagcaagagctccacatgtctctttgcctattctctatttcttcatctagcaacacaaaaccaccatccaaccgttcatcattttacacctggattttgccatggttaaaatagggcttcattcagtcagaataatctggatcacacaacagatattatttaccagttcagaaatctgcagtctctccatgttatttcttagaatgtcaatgtatcattctcctattaaagagacccataacaatggaaacactttaatttcaaacacatattttcttatttcatatgaccagcctttgtatcgttcttggcttaccctctcctatctcccattccctcattgtcaggctctttctcatattatctccttttgtggaacacattttggtgcttcataattattgttgcttgttcaaatttcatcttctaagagaagccactcctgtcttcccatcccagcatccacaaaccacactttgtgtccccagagggcttaatttactgtttatataactgtcataactgaaaattcattatctgtttcaaacattttgagtttgcagtgatagtggaacatgtattagtattctcattaaatgaaaaatttggaactagaagtcagtagagtagtcaaggagaggaatatacttaaatttacccactccaattgcctctctgcttctattctcagtgttttatcaccaatttctttctacagacttccctattatggtgctggactagcataatcaaaatagcaagcacagaattaagacataatataaaaaatttgaggcatatgcaaatcaactaaggaggtagttcaagtgttgattttatcattgcttcttttctggcaaggcttgggtggtgtcaaggaatctgatttttcaaaataatgtaagataattataatgtaagttgctcaaacacacacttctagaatctccaaaataaagaataggctaattttaaactggtccaacaataggggagtggttatgcaaataataatatattaaattcagtgttgtacagtcataaacatatgtggttatttaacatatagccacatgtaaagatgcatgcagaaatagaaaacacattgtaatatgtttactttccatatcactaagcagtagtttctcattttatatttttatggacatttttacttgttagttgtattagtccattctcttttataaagaacttcctgagactgggtaatttataaaggaaagaggtttaattgactcacagttctgtattgctttggagacctcaggaaacttacagtcatggcagaagacaaaggataagcagtcaccttcttcacagggcagcagaacagagtgaatccaagcaggggaaactccagatgcttataaaaccatcagatctcatgagactcactcattatcatgagaacagcatgggggagaccgcccccaagattccgttacttccacctggccctgcccttgacacatttggatcatggagattgcaattcaaggtgagatttgggtggggatacaaagccagactacattattagtcaatcacagcatctaagagttgttcttaaaatcagaaccatggacatctccctactagctctctggagggcattagacaaatcccttgagttggcaacagttgtgtggtctttacattaaaaagcataaatggatcacacacatttatttatttcttcctacacccaatgatattaagataataaaatgataaagagaagagtggagggtgtatttaaataaatcacaaaaattctgaacacagaaacacatatagaagagtattggtattgagcgtggaaagtgggtgaatcctttttcttagatacttgtagagagtgattagggcaacggggaggaaaatgatttaaccctgagaaacttgtaaatcaatgaaacaaggtacatgatagttataagagacacacagggaggaaacagaagaagaaattaaaagatgcatatcaaatttttgagcctccatctttttttcctcttcactacatggaatactaagttagtgcctggaataggaatgcatagatttcctccctaaataaagtaaatgtgactgcatacaaattaaaaccatcttcattaaaaggaaaccagcaagtaacaaacaagtaagaaaccacggactgggaatgtttatatttgtaacatatacaagtgactaaatgtttgtacctaaaatatgtaaagaatttctaaaagtcaatataaaagacaaacaactcaatctaaaagtggccagaggatacagacaggtttgtgggaatgaatgagcctgattagtacttatgaaaatttaaattaaaataataatgcactgtcctgtaactgaaactataaaaagaggaggggaaattgtacactaacctcacaaaagtagttatctctagaaaagaaatagaggtagtaaatagaaggtagaaagaggtcaacggggtgagagttatatcttttgcattatattgtcttaagcaaaaacctctgaagctaagcagaaaagaaataggaaaggatggcagggaaaagacgggtagggaagaagaacttctcaggtaattatagagatgcttttaaattacagtactttatgccttgtcttctgcctcttcatacatgaaaagactttgtagaataaactaatgtgtttattagggttatttctgatagaacatgcccataggtatgcttacaagataccctgtgattggaatctacctttaaataataattttctcttaatataaagatggacatagaaattactgtctgcaagcctagttataccatttccataaaaactaacattacctatatattggcagaaataaatttcatgacattccagaggactttgctttgctcacagaattctgtagtacaatattttgaatcccaccatgcaaaatgcattaaagaagccaggaaatatttctcccaaaatttatcactattcttcttagcacgatgtttgcacaaaatattttacctcctgtgcgccatgatcctttaggagggaaatatctaggtgatatgaatgatgtttatctacaaggtatgtagagagatgtctggatcccttgatactttctagtgtcctggctaataatataggtaccaagaaatacctgcaaaactccacagaaatgactgagaagtcaagtgagaaattttgaaggtctgggtgtgataattcccacaaaaataagagaaaataagggcaaatgagatgtaaagaagtggtttcagtgaataaactggaagctattcacctttgtcgacagaaaacatatttgaagagacaaaaacccaaagattatgctccaaactagctattctgtttttaactgtccaaatctactgtggcatctcctttatggatattggttttaattattatccacctagggaactgaaactgagtttcctaaataagaaaatatatagtttttgttttaagaaaagctatttaatctatcttagaagtaagggtagatgaaggaaatgcatttactccatcttacaattcatgtttcattaggctgcccacaggcattctgtgtttatggtctgctgcactccacaataaagctattattcgtgagcacttccctgctggctaaccacattttggctactgcttatgtttatttatgagtctcgcttgggaaaggatttgcaaagtctgatggggagtcctcacatgtatgtttacacttctccaggcttaggtatctcgagaagggaagtggccacagtgtcaccagtctccagaatgaattatgcagcaggacacatcatcgataaccagatagaacactccctcaatatttaaagggcaatggcaatgatggaaagaaggaaactgagatgattccagttctgtgggatcactggattcaagcaacattgagaaataatttttctgctcaatccttaccaagcaaaaataatcatcagggagaaaaagcagcattatctctcccagggagagtatgacataagatgttgccactattgtctctgcagctcaggtttctgcttcctgaccattgatttcctgcacaggtaaagaactgtattaattggggttcttcaaacaataggatatgccaaagaactctatctatctatctatctatctatctatctatctatctatctatctgtcatatataatctacatatcttagtccatttgtgctgctattacagaataccatatataattataaacaatatatttttttctcacacttctggaggctgggaagtccaagatcaaggtgctagcaggtttggtgttatgtgaaggctgctatttgcttccaaagtggcttcctattgctgcactctctggaagggacaaacactgtgtcttcacatggtggaagggatgcaagggcaatagtgtcaaatgctgtgtgaagtctcttttataaagcctttaatccctcataagtgctcatgacctaatcaccttctaaataccccacctcttaatactattgcattggaatagtgttgtttcaacataaattttgaaggaacacaagcattcaaatgatagctcactcactgtatctatctatctatctatctatctatctatctatctatcatctatctatctatctaatctattgaaaaagagtgagaaagagaaaaatttactttaatgacttgattcatgtaattgggggtctggcacgtctgaattccataggataagatgacaggcaggaaactcaggcaagagtttcacagattcctactttgctgtttctcagtgcagaggtttattctttggactttcaggataaaccaaagctaggcacttctgtatgccagtcagcaaggaatcattcttttgtggtgtgcagagcgtataatacccattgagaatggattgtaaaaaattcaagagggttcctgtgctagttattaagcatttatctctcagttccaaatccaccatctatattctccacggtgatgatggggcaaatgtctttctcctttgtcagttgactctatatttagtgctaccaatagggggacctagaagatattggcggacaggaagaggtgagaaagaacttactacatcttgtaaggttgctattgctgtctccttcactccagcaacggcacttaacctggcaacatcagttggttccagtgtctgtgtgtctcacctgcacacttagtgacctttgccttgccagcttgttttttagccccaagattcttgctccaccacatgtttggggtcctggacactccagtaagctcttcctggatccacctcttagaaaagaggtactgggttagatatgatagcatttatattttgtgctatgacacttacacattctgacataagcatgtggaatttcttgttattttatttcccagggttaattttgtatatgtgtatgaagacaaaaaataggatgtctttttttgtttgtttattggtagctaccaagatacccaagattgattgaccagtgtttgttgatgacaccaaataatgttattttacaaggcctctttaaaaatgttagctttctgaaactgaaatatttatttaagcatcagacagataacacacacttcaccaccacccctcccccattcatttgtatcatcaattaaaaaagcttagaaaacataaaactttaatgcttattttaactgaaggcttgtgggctaacatccacagtttataaatggcactttggtattttgaagctaaacattacaagaagtctacgcatgatgttcaaaagaaggaatgataaaggtagctttaggaatgtaacatcaaatcccaacatttctgtctggcttgaaaatctttccaaaaattcggcagttttttgaactgttcaatcattatgtttgattaaagtggcccaatttagttttaggtagatacacatggcattctacacgtggcttagaagtttttgattgaaaggggaaaaaagggcaaatctcttgatgttcgattttttttttctttttttgagacagggtcttgctctgttacccaggctggagtatagtggcatgatcacagctcactgcagcctcgacttcccaagctcaagggatcctcccaccatagcctcctgagtagctgggatcacaggcatgtgccaccacactttgctaatttttaaaatttttatagagtcagggatcttgccatcttgtccaggttggtctcgaactcttggcctcaagcaatcctcctgcctcagcctcacaaagtactgagatagcagggataagccactgtgctaggttgaaactatttttaaatttaaacagttttaattgtggtaaaatacatgtaaaattttccatcttaacagttcagtagtgttaagtgtagacatattattgtgcaaccaatctctacaacttttttatgttacaaaactgaaattctttacccaaagcaataattatccaatctcttttcccaacccctggacactaccattctattttctgtttttatgaatttgatgactctagatatcttatgtaaattgaatcatgatgtagttgtctttttgtgactggttcatttcatttagcataatgtcctcaaggttcatccatgtagtagcatgtgtcagaattttcttcctttttaagtatgaataatatttctttgtgtgtatacattatattttctttatccattcatctgtcaatgaatacttgagttgtttccacttcctgactattgtgaacaatgctgctatgaacatgggaacactgatactttttcaggactctgatttcagttcttttgaacacacgctcagatatggaattgctggatcatatgataattcaacttttaatttttggaggaacctccattaaacagtagcaactacaccattcccaccaacagtgcagaagggttttacattcccaccaactgtgcagaagggttccaatatttccacatccttcccaacacttattttctgttgtttgtttgtttggtttaaacagtagccattcttatgggtatgagatgatatctcattgtggtcttgatttggatttccctaatgactggtgatgttgagtatcttcccctaagcttgttggccattttcatgtcatctttggagaaatgtctattccaggcctttgtgcgttttaaaatcagaatattttgttgttgctgtggttaaattgcaagagtttttgtttgtttgtttgtttgtttgtttgtttgtttggtatcctggagagtaaccccttatcagatatctgatttgcaattcttttctcctgttccataggttgctttttcactgtgttaattatattatttgctgcacagatgtttttacgtttgaagtagtttaaattacctatttttctttttgttccctgtaagaaactatttttaagaaattaggaaacatctcaagatgaagtcattaagccaagctgaatgaagacaagaagttgtttcacagatctggctgcataacatgctcgagtcttcctcctagtgggtgagtatggaaactactgacagtacaatgttctccaactagattcagaagattcccaatacattcagttcttctgttctcttatctcaagcaaacactaaatttttgtggttggttcaactcaggaaaagttacattgtcaaatttgattcaacacaggtgtcagaaacaaaaccccaaaactatatactctaaatttgcattttgttgtctataagttcaatttaaaagtcaaagtaatgttaccatgagtaaaattttcacagtgagcaagaaaacaaaatcagccacccctcaaactaaatcaaagtggcagagatgatttaggtaattatttttaaactgaacatctctctatcgttggatataaccatgccagagggtccatttggaagtggcccagatgaaacatgccataaggccagaaactgtaattcaaaagttctaaatgaaaacactcaagtttcattgaggcaagaggcttgagtgcacaatagcaatacaagcagctgtttttgccactcagccttaagcctgagtttgtttctttcttttcttttctttcctttttttttttttttttttttttgagatagaatctcactgtgtcacccaggcgggagtgcagtggtgctatctcggctcactgcaacctccccctcccgggttcaagcgattctcatgcctcagcctctcaaatagctgggattacaggtgcctaccaccacacccgtctgatttttgtatttttagtagagacggggtttcaccatgttggccaggctggtctcaaactcctgacccaggtaatccacccaccttggcctcccaaagtgctgggattacgggcatgagccaccacgcccagcctgggtttgtttctaacatgtgtggtgtcaatgtctggtgtcacctctaaaaaatgctgtttgcatgtaagctgcagttgggtctttgagacttgcttttgaaaggatgctggttagtgtgtttttcctcctcttctctgggtaacacaaataaggagctgtcactcataaagtcccagacaccaattaaatttccagcagttgcctatgacatctcccttcacagggggcctctgaattacatgttgtcatagtaagagcctatgatcttggccatgctgcctcagctcctggctctcgtattgcacttaaaagaccaatgcttgcttgtgtttcatctttccttatgcagtcttggagcatgcattatgagtggctgattttctttttttttttttttttaattatttatactttaagttttagggtacatgtgcacaatgtgcaggttagttacatatgtatacatgtgccatgctggtgcgctgcacccactaactcgtcatctagcattaggtatatctcccaatgctatccctcccccccccgccccaccccacaacagtccccagagtgtgatgttccccttcctgtgtccatgtgttctcattgttcaattcccacctatgagtgagaatatgcggtgtttggttttttgttcttgcgatagtttactgagaatgatgatttccaatttcatccatgtccctacaaaggacatgaactcatcattttttatggttgcatagtattcaatggtgtatatgtgccacattttattaatccagtctatcattgttggacatttgggttggttccaagtctttgctattgtgaatagtgccgcaataaacatacgtgtgcatgtgtctttataccagcatgatttatagtcctttgggtatatacccagtaatgggatggctgggtcaaatggtatttctagttctggatccctgaggaatcgccacactgacttccacaatggttgaactagtttacagtcccgccaacagtgtaaaagtgttcctatttctccacatcctctccagcacctgttgtttcctgactttgtaatgattgccattctaactggtgtgagatggtatctcattgtggttttgatttgcatttctctaatggccagtgatggtgagcattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccattttgtgggttgcctgttcactctgatgatagtttcttttgctgtgcagaagctctttagtttaattagatcccatttgtcaattttggcttttgttgccatcgcttttggtgttttagacatgaagtccttgcccatgcctatgtcctgaatggtaatgcctaggttttcttctagggtttttatggttttaggtttaccatttaagtctttaaaccatcttgaattgatttttgtataaggtgaaaggaagggatccagtttcagctttctacatacggctagccagttttcccagcaccatttattaaatagggaatcctttccccattgcttgtttttctcaggtttgtcaaagatcagatagttgtagatatacggtgttatttctgagggctctgttctgttccattgatctatatctctgttttggtaccagtaccatgctgttttggttactgtagccttgtagtatagtttgaagtcaggtagtgtgatgcctccagctttgttctttttgcttaggattgacttggcgatgcgggctcttttttggttccatatgaactttaaagtagttttttccagttctgtgaagaaagtcattggtagcttgatggggatggcattgaatctatcaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaaggtggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgctggttttcaaagggaatgattccagtttttgcccattcagtatgatattggctgtgggtttgtcatagatagctcttattattttgagatacgtcccatcaatacctaatttattgagagttcttagcatgaagggttgttgaattttgtcaaaggccttttctgcatctactgagataatcatgtggtttttgtctttggttctgtttatatgctggattacatttattgatttgcgtatattgaaccagccttgcatcccagggatgaagcccacttgatcatggtggataagctttttgatgtgctgctggatttggtttgccagtattttattgaggatttttgcatcaatgttcatcaaggatattggtctaaaattctcttttttggttgtgtctctgcccggctttggtatcaggatgatgctggcctcataaaatgagttagggaggattccctctttttctattgattggaatagtttcagaaggaatggtaccagttcctccttgtacctctggtagaattcagctgtgaatccatctggtcctggactctttttggttggtaagctattgattattgccacaatttcagctcctgttattggtctattcagagattcaacttcttcctggtttagtcttgggagagtgtatgtgtcgaggaatttatccatttcttctagattttctagtttatttgcgtagaggtgtttgtagtaatctctgatggtagtttgtatttctgtgggatcggtggtgatatcccctttgtcattttttattgagtctatttgattcttctctctttttttctttattagtcttgctagcggtctatcaattttgttgatcctttcaaaaaaccagctcctggattcattaattttttgaagggttttttgtgtctctatttccttcagttctgctctgtttttagttatttcttgccttctgctagcttttgaatgagtttgctcttgcttttctagttcttttaattgtgatgttagggtgtcaattttggatctttcctgctttctcttgtgggcatttagtgctataaatttccctctacacactgctttgaatgtgtcccagagattctgctatgttgtgtctttgttctcattggtttcaaagaacatctttatttctgccttcatttccttatgtacccagtagtcattcaggagcaggttgttcagtttccatttagttgagcggttttgagtgagtttcttaatcctgagttctagtttgattgcactgtggtctgagagatagtttgttataatttctgttcttttacatttgctgaggagagctttacttccaactatgtggtcaactttggaataggtgtggtgtggtgcttaaaaaaatgtatattctgttgatttggggtggagagttctgtagatgtctattaggtccgcttggtgcagagttgagttcaattcctgggtatccttgttaactttctgtctcgttgatctgtctaatgttgacagtggggtgttaaggtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttgatttaaagtcagctttatcagagactaggattgcaacccctgcctttttttgttttccatttgcttggtagatcttcctccatccttttattttgagcctatgcgtgtctctgcatgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatgcagtttcttcctagtctcgatggtctttacattttggcgtgattttgcattggctggtaccggttgttcctttccatgtttagtgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagagtttctgctgagagatccgctgttagtctgatgggcttccctttgtgggtaacccaacctttctctctggctgcccttaacattttttccttcatttcaactttggtgaatctgacaattatgtgtcttggagttgctcttctcgaggagtatctttctcacgttctctgtatttcctgaatctgaatgttggcctgccttgctagattggggaagttctcctggataatatcctgcagagtgttttccaacttggttccattctccccgtcactttcaggtacacccatcagacgtagatttggtcttttcacatagtcccatatttcttggaggctttgttcgtttctttttattcttttttctctaaacttcccttctcgcttcatttcattcatttcatcttccatcgctgataccctttcttccagttgatcgcatcggctcctgaggcttctgcattcttcacatagttctcgagccttggctttgagctccatcagctcctttaagcacttctctgtattggttattcaagttatacattcgtctaaatttttttcaaagtttttaacttctttgcctttgatttgaatttcctcttgtagcttggagtttgatcgtctgaagccttcttctctcaactcgtcaaagtaattctccatccagctttgttccattgctggtgaggaactgcgttcctttgtaggaggagaggcactctgctttttagagtttccagtttttctgctctgttttttccccatctttgtggttttatctacttttggtctttgatgatggtgatgtacagatgggtttttggtgtggatgtcctttctgtttgttagttttccttctaacagacaggaccctcagctgcaggtctgttggagtttgctagaggtccactccagacttgtttgcctgggtatccgcattggtgtttgcagaacagcagcttttcgtgagccgcgaatgctgctgtctgatcattcctctggaagttttgtctcagaggagtacccggccgtgtgaagtgtcagtctgcccctactggggggtgcctcccagttaggctgctcaggggtcaggggtcaggggtcagggacccacttgaggaggcagtctgcccgttctcagatctccagctgcctgctgggagaaccactgctctcttcaaagctgccagacagggacatttaagtctgcagaggttgctgctgtctttttgtttgtctgtgccctgcccccagaggtggagcctacagaggcaggcaggcctccttgagctgtggtgggctccacccagttcgagcttcccggctgctttgtttacctcagcaagcctgggcaatggcgggcgcccctcccccagcctcgctgccgccttgcagtttgatctcagactgctgtgctagcaatcagcgagactccgtgggcgtaggaccctccgagccagttgcaggatataatctcgtggtgcgccgttttttaagcctgtcggaaaagcgcagtgttcgggtgggaatgacccgattttccaggtgccgtccgtcacccctttctttgacctggaaagggaactccctgaccccttgcgcttcccaagtgaggcactgcctcgccctgcttccgctcgcacgcggtgcgctgcacccactggcctgcgcccactgtctggcactccctagtgagatgaacccggtacctcagatggaaaagcagaaatcacccgtcttctgcgtcgctcacgctgggagctgtagaccggagctgttcctgttcggccatcttggctcctcagagtggctgattttcaagaggacatgaagatacaacaaatggtgagtgtcttgtgatggagcttcctgtattttgaattacactttctagctggattctacttacctaaaacacacacacgcacacacacacacacacacacttctttttagctgttggaaaaaaatgacctctatactattgattcctccataattttccagcccttaataatattgtatttatgggacaaaatgactgttgcctcaatcttgcaaaccacaagactatgaactttatgtagcagagtttttgtgcatggcttacttaaaatctttcctcctactttggacaattctttgggaactatattattctgttccttgtggtcccagttagactgtcagtccaggtaggggatttagggttagttataaggttgatatgacaatggttataaagggtttccctttggttgattatagaacattttactaggaggatgtctatttatacctccacaattaagactataacatgtttggccagcagggatttgcaagtttttaactggtaaatcacaaggagtacttaatttcatgcttttattagaaagtgcctacagaaggaaaaaggtaacaataacctggtagagcaccatacccagtaaagatattggtgccctgaaattgagtaccatgcagacatgcagacatgcatcagaagctacttccaggcagtacatttccagctgggcagtgtttatccactgtcttaagaaaaaataactgcaaaaagtgtttttccttgtaagtccaaagagaaccagtaaatatttaacaaacatctatttattgagtagacagagattagtcatgatctataatttaggaattaacacaaaacacatattttgtgtggtaaggaatactgaagagaagaatcctagaagttcagccttttttttgagaaattgtgtggtgtagcattcaagcacagtacatactaatttttaatcagttgagtatgatcattgctatttcgaaatgggattgtttccaaagactaagtgcccttttccaattgaaacagttcctagaaaagcaaaaagtcttgggctggcagtaaccagaagccatgctacttgctttagagtgcaatcatccagaaggcaaggtttaaaaaagtaactaaatttaatctgcaagcatccagggatttaatcaatgacttcgttgtgattcatatgcctgctgttggaagagtagaatatctcctatttcctccgaaaatgtccatgctacatcttacactagtgggtctatttcatgcctggagatttgaaaagtgaagtcatttaagagttttagtgtatggctcaattctgtctaaatttagtggtgtaccagggcttctccatgtcgctcagaatctgtgatgggcttctctccatgggcaattccataaaaacagcactttggctgacatgagataaatttaccagaaacaatattttgcagcaaaccagaggaagcaatgcaggggcaatttccaaaggtgcacagctggtgaggatgtgtgtgcaatgctgttgttatgaagactctaaatctagaaagatgcctaattctaagtcattcatttttggtcaatcacttttagcctctttaaatttttaggcatcattttagctcccttaatggaactgtcatgcatggatttttctagtacttagttgaagttatttatatttgcagtctgcctctagttttcaaggttatgatttctgccaatgtggccattgctacttgctctgttttgttaacttatcctttctctgtttgttctaaatttccctctttcaagatataagggaaagactgttgtcctggcaaactgagatttagtgaacatgtttgtgttcatcacagccctaccttttatgagttttatagacttcagtcatatcccctgtcagcttcagtgtttgcagatggaatcatactaagcctctaaggctgtctgcatacagcaacggctctggacttttaatcatcctgttcttcttctttgagcctttttctgctgtgtttttattttattgaaatgcagagacctggacagtgggcaatatccttactgcaattttaaatatatatatttcaaatatatatacacttacaaatatacatatattcttttatgtatatgtatacatatatacattatatatcataatgtatatagtatatatgtatatacctaatatatacatatgttgtgtatgtatatattgtacataacatacagtgtatatatacatatataagtgaatatgtgtataatcgtaagtatatataatttgtttatatatacatatatagtatatatacacattgactataggtatatttataagatatctgtatatttataatatatattcatttgtatacatgtatatatgcatatacaagtgaatatgtattcacgtatgtatatatgtgtatatatacacacacatatatgaatatatatggatatatattcattttccgtaaactttgtggggaccattctcagaatatttaatattttaccagcgttttactaatcccaatatgtgtacatacttaaaaggtgaaagaatgacctcttaaatcaaaatttcctaatacgaatttactgtgagagataaaaggatttgaagccttatacaaatgtagactatgcctacataagaaatagatttgacactccacctgtgtcttcttggagtcagctggtgttatatccaatatatcctgcagaagaggagcccttgctaatgtggatggccctcccaggtggccagcattttctggaattctcctgttgggtcaagatagttagaattgccaagttagtttgaggatgccaaactgctgtaacgaataaaataaaaatgaataatgttctggcttaatagaagttgtcttcttgctaacaatctaagatgtggtacctagttatcaggattggatggaaggggttctctgctccaagcaatctttttttaaaaaaattgacaaccaataacagtatatatttatggggtacaaggtgatgttctgatatatttatacattggagaaagaacaaatcaagccaattaacatatcaatcagctactcttttagcaattttgaaatacaccatgcattattaactatgttctccatgctgtgcactagatcagtgaaactttcttcgaactgaaagtttgtaccttttgaccaacatctcactgtttccccacaaccagcccctggtaaccaccattctactctctgcttcagtgagttcaatatttttagattccacatgtaagtgagaacatgcagtatttgtctttctgtgcctggcttatttcacagagcataatgtcctccaggttcatccatgttgttcgaaatgacagaatttcccttttatttaaaagtttatctagtgttccattgtgtatatataagccatattttctgcatctattcatccgctaagggatagatacccaaaaattggattgctggatcatatggtaattgtgtttttaattttttgaagactctttatactgttttccaaaatgctgtactaattcacattcttaccaactatgtataacggttcccttttctccacatcattgccaacacttatctttcatctttttgataatagccattctaataggtgtgaggtgatgtctcattgtggttttaatttgcatttccctggtgattagagatgttgagcattttttcataaatctgctggccattcatatgtcttctttgtagaaatgtctgttctggtccttttttccagtttttacttgtgttgtttgttttactgctattgaattgagttccttatacattttggaattggccccttatcagatgtatggtttgccagtattttctcacagtcatctgtggtttgtctcttcactctgatcattgtttccaagccatcttttcaggactcatcttcaatgcatggtgtccaaggtttccctgtggggaagtggtagggtttatttctatcccaggccacagaaagtgagagaaacacagaggaaattcattggagaaatttgtgagccagtcttggaagtggcacacatcacttctgttcattaactattgtctagaatatgtccaggaactgcacctaactgaaagataggctgtgaagtactgtttggccaagtgccagtgaaaaagaggcaatcgatttggtgaagaagtagccatcttcctaatatctacattgtacattttggctttagtcttttcagcatgggtcccatatttcaatgcagaccaaagcttcaattttggaaggtctaggggaaaccaaggcaataccggaacaagccaaagtttagtgcctaaggaaatacagttgggtgtggaggtaaatgccacatcttgcttatgccaaacatcagagaaagactctattgtttatttttttgcttgttttgagacagagtcttgctctgtcacctcagatggcgtgcagtggtgcgatcgtagctcactgcagcctcgacctcctggactcaagctatcctctcacctcagcgtcccgagtagctgagactacaaccaccgccaagacacccagctcatttaaaaaaaaatttttttagtgacagggtctcgctttattgcccaggctggtctcaaactcctggcctcaagcaattttcttgccttggtctcccaaagtgctgaggttacaggtgtgagcctccacacctgggcatgaccagatttttttaagtagatggagaggaaggtcagaaagttaaatgtgtcacaacttgaaatacaaagctttgtgaggactaatcaaaaagctgagccaagaagagcaggctgaatattctcctgactgcagggaggagagggaaagactttcatatggccaaagttataaactaagccaatacttgggagaattcatagaaacctctgctttagttccaggtttatgtatctttaaatcttatgacaaattaatctttccctgaatgttttagtaacagaaacataaatccttgttgtgaaatcactatttgtatatccttgtacctccttcctttgatttcaggtgtcatttccatgcagatacatcccactgtacattgacttagtttctagtttctaatttccaactctggttgaatagtttcaccttgagacaccactagctcttcaatatttttcttctgaacaagtacaaatggcaatagttaaagaaacatgaatatatgaccagggagatgctaagtgctttgcctgaattaattcaaaatcataaaaatccccatgacctaggaaatattatgatccatatttcacagagatgaaactaagggttagaagttaaataaccttgtctagctcacatctttggagcaaagatagagctggaatcccaaaggtaagctgtctgaagaaaagtagccttaatttatttcagttgtgaaaatcacatataagttatttgtgccacactcattgggcagctcttcctgaatcaataatccttaaccctcaggcagggcaagcacgtttttgaacagctttatctattgcctgtttcttatgttcattctgtatttcagccaacctgattatgccttcctctttctattttttttcaaagacaaggtctcactctgttgcccaggatggagtgcagcgatgtgatcagagctcactataaccccaaactcctggactcaagcaatctgcccctcagactcccaagcagctgggattacaggtgtgcactatcgggctcagctaatttttaaattttttgtagagatggggttttgctgtgtttcccaggctggtctcaaactcctggcctcaagtgaacctcctgccttagcctcccaaagtgctgggattatagtcatgagccactgcacttggctttgttctttgtatttttacttaaaacaattcacacgaggcctgacatggcagctcacacctgtaatcccagctactcaggaggctgagatgggaggatcacttgagaccaggaagttggggctgcagtgagctgagatcatgcctctgcactccagcctgggtgacagagcgagaccttgtcccaaaacaacaaaaactccaaaaaccaaaaaaaaaaaaaaaaaaagaccaattcacatgattatacatctcctttttacacagttatagatatcaaaagcagctcataatttaagattaagttaaatactacattttccacctgcctttcttaattatctcagcccaagtcacatagcttcctctgaatttgacagttactgataccatgtgctacctagtatcaacaatggaatttctctttagcagactttaaactttttatgaaaaacccacataattaatggggggtgtccccagtagatgctaaataaggattttccaccttggttaagaagggttttattgtttctggtaaggcatatctaatttatctatttatctcctgagccatgattcatggtggaatattaccgccacctggtttatttcttgccaaaaaagagtaccaatactgaagcctctaatgagtgattctcaagtgttttccaacctccgtaagttagagatagatcagaattacctgtgtgttattgttttgagactgttgactcacacacttgatgctgagatgaagtgggacataatccctgatttgaaactagcagttatattgacctgttgttatcagtgagaacctgttaactttttaaaggaacaaggcaagttgctttgggaaaaatgtttaaggaaccacatgtctaaagtctaaagtacaactaccaagttagcagtctaagtatatataattccatcagtggatgatatttgatgctttgccatttttttttctcaaatctgtatttttgttttttcttattttcttacttatgtcctctgttttacttgatggctcaaatattattggctttttccctcctctggttatttagaaattatatcaaacaaaatatatttggatacttagctctatactagcatcaactgccctctgccccttagtaatgagagatttagcacaatcttcagtagcatttaacttcactttgcatagatttgtattaaaatgaattgagtttttagatcaagactagtgtaaccatgttagttacaatgtattatatatgttatatataacatatttcattatgttttaatgtataaatgctacatcgtttttttctcttctaagatttagttttggctcttgtcttatgcttagtcaccatgatatcatccagtgttcagacattagccaagagtttcactgttccgttgctcactgaccttttgtttatacgtataacttctcttcatggggatattaatttgattcatctattagcttattggagtacttgagtattttaaagatcagcatccatttaaaattcttgcatgacagaatattttccttgtttggttgtagaatttgtgagttacaatgctaggtccccaaatcctcatgtccttttcacagcttatactttggaggagaattatggacctaacttgatattttctcaaagaaaatatcaaaaatatcaaaatatcaaaaatatcttatttcttaaagatatggaggattgaagtcttcatatttgtgaggaatggagaagttcttcttcaaagtttcttaaaaccataaagagcttggcatttctttgctctatgcatgtctatatatgttccagtggagctcttctgacttgacctggcatgcctggacaggcttaagcgagccccgaaccatagtgcatgacattccttatttggaaaccctcctaaccctctcatgactagcttcctcttttctttgttctctttcccctttgcctctttagaacagtttcaagctgttagccaatcgtgtcaagcttagaaggtgaggtcctgttccagccaatggaaatgggacacagccataggacgattgcatcaggttacaaagattataaatgtccctgtctcctttgtttgggtgtgctctcatggcaagactgctagcaagagggcaccctttctgcagaaaataagctagccttgctgagagatcctttgtctcagtggtgatttcgtgacaccaagcacccatttccaacaatatttttttcatggctttgaatttaagcattttctcaagatatatttaggcatgggtttagtttaattaatttagagctcccactgacgtgaagatgaaagactccttttttttacagtatgacactatagcttagctaactctatcaccatgtctagttcctttcctcttaatttgcctctttccaaaggctatgaaaataactagattcatctaccttttctgcagcgatgagtgtccatgtgctgtgagagtggccaatgaaacatatgtatcatttattgttgtccgtttttcttttcccttttatttctgcttagaaatttagcacgatatctataggctcagcagacattcgatgaccatgcagataaaaccacttgtgagtaaagacagaagaagtcaatgtcataggtacatttcttgaataaccataaacacaccaatccctatagtttccagagatgaatcaaccttgtattcatcaggtttccctagagaaagagaaccaataggatggatagatgattgatagatagatagatagatagatagatagatagatagatagatagaataaatgaatgagtagaaggtaagtaggtaagtaggtaggtaggtaggtagagagatagatggatatagagatagatgaatagatatagatatatagatagatatgatggatggatgaagaagtatatgtgatagatgaatagctaggtagctgaatagatagatctgatagctagctggatagatagttaaatgtgattgatgaatagagagatagatatgatagatggatagctaagtggctggataaacagatctgatagctagctggatgaatagatagatagatagatagatagatagatagatagatagatagacagacagacagacagacagatagatagaatacatgaatagataggtgatagatagacaagtagagagagatatggagagatggatagagagatagagaaacggggatttattggaggagttggctcagacaattaggaggctgagaagtcccaccacaggctatctacaagctggagaaccagggaagctaatagcatggctcagtccaagggacttccctcagaaccagggaagctgatggtgtaattatcagttcagcgctagaggcctgagatcccgcagacaataagcagagtgagaggggcattgttggttcaagtcctggagtccaaagggtgaagaagctggggtgatgatgtccaagaacaggagaagtgtctcccagctccacaagagaaagattatgcaaattcatttgcctttctctgttttttcttctatccgggcctacagatgattgaatggtgcccacccatactggatgatggtggatccttactcagtccactgattcaaatgccggtctcttccaaaaactccctgacaggcacaccctgaaatcatgcttgaagagctatctgagtatctctcaatccactcaagttgacatctaaaactaaccatcacaaaccccttgtctatttaagttaccctagcagagctttgtgtgactcatagccaaaggatatggtaacagctaaaggaagtcctgacacatggtttttcatacatctgtgtttggagtcaagaccaaatactctgtatctactactgtatctaagaggaaagtcaccgtggccttcaggtctgcacatttacacacaaagttcaaagatcctaatagaaaactatcaattgtacttttaaataaggcaccctaaagatattttgtaacatatctgataaactctaggtcattcacctctaggagttgtgtagtttcaatgctacaaaaacttttcagtgacaaaaatggctttgctttgctacaaaaatttttcagtgacaagaatggatttgctttgctacaaaaatttttcagtgacaagaatggctttgctttgtgaaaatattgatggggtttctggtcaatgcattggcacttaatttctcctatgtgtaaagacatatttcagggtttgcaaatagtagcttccatcccaagtcattcaagaaagaaaatgcaactactgaggatgcttttaatcctcagtaacgtgcatttgaaaaaccacatctaaatggtttgctattggcctgagtgacagatcaatatagcgagcagaatgtcagcaaaaatgaccagatagacatgggaatttagtcaatgttagtgttatattttagaaacatgaataattaaaaaaatacagatgttggggcaactaaaaaaccatttggaaaaataacacaactggtattcctttcttacaatttgcaccaaaataaattatatgtaatgtaaacatctacttaaaaaatgaaaatatagcccaggtgcggtggcttatgcttgtaatcccagcactttgggaggccgaggcgggcggatcacgaggtcaggagttcaagaccagcctgaccaacacagtgaaactccgtctgtactaaatatacaaaaaaattagctgggcgtggtggcaggcacctgtaatcccagctatttgggaggctgaggcatgagaatcacttgaacccaggaggtggaggttgcagtgagctgaaatcgtgccactggactccagcctgggtgacaaagcgagactcagtctggaggaaaaaaaaaaagaaatcatttgatagctttttgagggggtaagaggggcttggaaacagcttttcttatcactgttaagcccagaagtcaaaaagaaaatgtattataagttgatgtcttccaaatagtgaagtctgtctctctctctctctctctcacacacacacacacacacacacacacacacacacacactcaccattgcataagcaatctaaaagtgaaatgaaaatttggagggaaaaatagtacttagaacagtatgtctagttaagttgcttttctttctaaaataaggtctcttagaaataaaaaagaaaaagatcacaactcaagtcaaatatggacaagagtatgaacaagaagtttaaagaaaataaagtaccaatggcgaatgacaaagattctctgtctggccaaactgtagtcaggcttctgaatcttctcctaggcccacctgtgtacctccctgtaaaatccagttttagcagagaaccctgctaagtcagtttggcaggaactccccacactcgatatcctatcaccctcaatacctgagtgagttcctcatcctccaccctccccaggtgatatctggtgactctggcctgtcttcagctagaatcctgttagatgggtttatccagaacctcctttacccctgatgtttccttctagtcattttccatccaatgtccaaatttctactgaccctccctctgctccttggctataaattcccacttgcccatgctatattcagagttgagcccaatctctctccctcactgcaagaccccatactgtctttctcctccttcttctctcttctccctccatcctttctcccagacctccaccccatctcttcttcctcttcctcctcctttcccccacgcaatgcaaatttccaggaagaatcggaaaccgctggtttccatggctatgggccctacacctaactcaaaggtcctgattaaagtcttccttaccatgctttaacaagtatcattgaatattattttctttaacacaaatatgcatagaaaatattcaattctacggaacactgaagaaatttttaaaagctaagatgctttttacacctattagattagcagggatcaaaagtggggtaatctcagtgttgatgaaaagcacaggtgaagattaggcagggccacgatgcccctgctcactgaaccctacttgaaaacaacctctctggtcattctccaggctgtgctgtggcttgggcaaaaactgaccttgacagagaccctgagatccatcaaaaagccaaacatgagtctctgcctttgttcattcccaatgaaattatttgtggtataacacaatgcatgcttacatggtcattattagaactgagcaatgcaaactgtgatttgcttttcatgttgttaaaaataataactgccagcaaggtgttaaatttagtacaagacacagcagctgttcaactcatttttgcaaattattttcatatatggcttacaaagtaccaccactctgaggtaaacacagtcctgtagattgtaagcatttaagctgcgtgacagatggctgcttctcatttcttgatgtgttttgtaatggaaatttaatggggaaaatgctaataataatgctgttaatttactgccttttccctaggagcttcaaacacttgacaaacattacataattaatggttaaatattatacaaacattcacgggaagtgggaaagaagaaaggagttgaagcgtcattctgtggttgcaaacaacgtggtgttgtgttcacatgcaggtgctctcccaacacaaagacaacttaactcatgaaccgctgctttatgagcagcggtttccaattcttcctggatattcgcattgcatgggagaaaggaggaggaagagacagggtggaggatggggagaaaggatggagggagaagagagaataaggagaaagacaagaggcaatagcattctaatctcctctgacaaacacccttcacaccctaatttaattcccatgagttggaggaagtgatcctctttttaaccacagctaggtacgtctaatagatgagacttctccatccttatgctcagatactccaccctaattgtgatggttaatagttaatactgagtatcaacttgattggatggaaggatacaaactattgatcctgggtgtgtctgtgagggtgttgccaaaagagattaacatttgagtcagtgggctggggaaggcagatccaccctcaatctggtgggcacaatctaatcagctgccagcaaatacaaagcaagcagaaaaatgtgaaaggagagactggcctagcctcccagcctgcatctttctcccatgctggatgcttctgccctcgaacactggactccaagttctttagttttgggactcgggctggctttccttgctcctcagcttacagacagcctattatgggaccttgtgattgtgtaagttaatacttaataaactcatatatatatacatgagtttatatattatatattttatatatatattaactaatatatcctattagttctgtccctctagagaaccttgactaatacactactttgtaaagtcaatgacagaactcaaacacacttgttgcatcctccattaaagacccccgttagcattcatatcccttcttaagagagatttggccaggcactggggctcacgcctgtaatcctggcactttgggaggccgaggcaggcagatcacctgaggtcagaagttggagaccagcctggccaacatggtgaaaccccgtttctactaaaaacacaaaaattagccaggcacagtggcgcatgcctgtaatcccagctgctctggagactgaggtaggagaatcacttgaacctgggaggcagaggttgcagtgcgccgagagtgtgccactccactccagtgtcggcaacagagggagaccctgtctcaaaaaagaaaaacataaataaagagagagtagttttgggtacaagatttccaaacctcaaaatcaagagttatggcaaccttcaagtcttgcttgtctcaccaatgtggtgagttttagcgctgcatgaagctaaagtattgcctttgaatggaggatgtggaccacattccatccttggccgaaggcagaacgcacccaggattgcacagaatcataaaaaacctgagctgtaggaataaaatgtggttccctacagtggatgcctttcattcaaaattccaaagcaagccttcagaaggattttttttttttttcgaagctgatgttttaattttaattttttttttatttttttttttaattttttttttaattgatcattcttgggtgtttctcgcagagggggatttggcagggtcacaggacaatagtggagggaaggtcagcagataaacaagtgaacaaaggtctctggttttcctaggcagaggaccctgcggccttccgcagtgtttgtgtccctgggtacttgagattagggagtggtgatgactcttaaggagcatgctgccttcaagcatctgtttaacaaagcacatcttgcaccgcccttaatccattcaaccctgagtggatacagcacatgtttcagatagcacagggttgggggtaaggtcacagatcaacaggatcccaaggcagaagaatttttcttagtacagaacaaaatgaaaagtctcccatgtctacttctttctacacagacacggcaaccatccgatttctcaatcttttccccacctttcccccctttctattccacaaaaccgccattgtcatcatggccagttctcaatgagctgttgggtacacctcccagatggggtggcggccggacagaggggctcctcacttcccagtaggggcggccgggcagaggcgcccctcacctcccggacggggcggctggccgggcggggggctgacccccccacctccctcccggacagagcggctggccgggcggggggctgacccccccacctccctcctggacggggcggctggccgggcagagggactcctcacttcccagtaggggcggccgggcagaggcgcccctcacctcccggacggggcagctagccgggcggggggctgaccctcccacctccctcctggatggggcggctggctgggcagaggggctcctcacttcccagtaggggtggccgggcagaggcgcccctcatctcccggacggggcggctggccgggcagggggcggacccccccacctccctcccggacagggcggccggccgggcagaggggctcctcacttcccagtaggggcggccgggcagaggcgcccctcacctctcggacggggcggctggccaggtggggggctgacccccccacctccctcctggacggggcggctggctgggcggggggctgacccccccacctccctcccggacggggcggctggccgggcggggagctgacccccccacctccctcctggactgagcggctggccgggcagaggggctcctcacttcccagtaggggcggccgggcagaggcgcccctcacctcttggacggggcggctggccgggcagggggctgacccccccacctccctcctggactgagcgtctggccgggcagaggggctcctcacttcccagtaggggcggccgggcagaggcgcccctcacctctcggacgaggcggctggctgggcagggggctgacccccccacctccctcctggactgagcggctggccgggcagaggggctcctcacttcccagtaggggcggccgggcagaggcgcccctcacctcccggacggggcggctggccgggcggggggctgacccccccacctccctgccggacgaggtggctgccgggcagagacgctcctcacttcccagacggggtggctgccgggcggaggggctcctcacttctcagacggggcggttgccgggcggagggtctcctcacttctcagacggggcggctgggcagagacgctcctcacatctcagactatgggcggctgggcagagacgctcctcacttcccagatgggatggcggccgggaagaggcgctcctcacttcctagatgggatggcggccgggcagagacgctcctcactttccagactgggcagccaggcagaggggctcctcacatcccagacgatgggcggccgggcagagacgctcctcacttcccagacggggtggcggccgggcagaggctgcaatctcggcactttgggaggccaaggcaggctgctgggaggtgaaggttgtagcgagccgagatcacgccactgcactccagcctgggcaccattgagcacggagtgaaccagactccgtctgcaatcccggcatctcaggatgccgaggctggcggatcactcgcggttaggagctggagaccagcccagccaacacagcgaaaccccgtctccaccaaaaaaatacgaaaaccagtcaggcgtggcggcacgcgcctgcaatcgcaggcagtcggcaggctgaggcaggagaatcaggcagcagtaccgtccagcttcagctcggcatcagagggagaccgtggagagagggagagggagaccgtggagagagggagagggagagggagagccagaaggattttatgaatgtccttttgtgtgaggattaatagataaataagaagtttattaactggaaaaatgctttttgtttggtaaaccgtaagtgactctcatgagtgagaacgcaacgcagctatagtaacccaaaatttctctaataaatcaatatataattgttgctgctgtgactgcacaaaattaatgaatagagcagcttggagcagctttatttgtaggtccttctgtttgaagcacaatcagtctacttattcaatgatcaggcctgggaaacttagcctgaaaaccaaaacatccatagctgagcagtttctaaacaaaaatcctaaagagagatgaattcctatctcacagcgaaaggtagctctgaaatgaagctccttgatgacatctcatacttgtaacagagatttcaaaaatctgttcatttcatctagggaacatttttctgcaaaggctggtttgagtggttatgtgatccagtatatcattctgcactacacacaatgatgggcaatgttaaaaacagatgaaaatggctgtcttccaagtccagctatgaacctccccacgggatgttgctggacagtacttcggtagcacagttattctacaaaaaaaaaaaaaaaaaaaagtcctttcctcaaagaagggttgaaatgatgctccggtttgatgacttgggagtctgtagaattctttttttgtttgtttgtttgttcgtttgttttgttttgttttgttttgttttgagacagagtctcgctctgttgtccaggctggagtgcagtggcatgatcttagctcactgcaacctctccctcccgggttcaaatgattctcctgcctcagcctcccaagtagctgggactaaaggcatgcgccacaaggcccagctaatttttatatttttagtagagatgaagtttcaccatgttggactggctggtctcgaactcctgaccacagatgatccacctgccttggcctcccaaagtgggattacaggtgcgagccaccatgcccagcctgggagtctgtagaattctaataaatgatatcaagtgatactaagaaaatatataatccaaatcatcactaagtaaaagtcctaaggccggttatttttttagcagcacatgaggttcttcacggcttcagtagaaaccagatttcttcaaccttgtcactctcggcatttggggctgaatagctttgttggggggaactaccttgtgcattgtaggatatttggaagagtccctggtccctgcctaatgctggtagcccttttttcccgcagttgtgaaaagaaaaaaatgtctccacacattgctgactgtatcacataaagtgtgtgtgtacccacatataaaatccccccatttgagaaggactgatataaataacacaatttatataattctttaaatagaaacttacttgctgcactactcaatattgatgttcttgaaattaaatacaatcttatgagttcctcttatacatatgcttccattctcattgtctttttctgaattgtcatgaaaaacactccagcattttttaaacactttgacaaacatgtgtgcctcgctttctccctacatgtcccgatttctttatctggattttttgtgtcctctattaagaccagaatgctgttcatcctctcagcttgtcttacgtgatccttgagcaatgaaaatgttatttttagaaaaggactttagtagaattttgaaaaaatatatatagtaattaaagtgtgtttggcctcattggtgtggccaatcttcaactaaatgttgaagatatacgttaggtacagacaacttagtactacatttattcaaggtttttgcgtggctttagttaaaatgtaattagagttcaagcaatgaaggcattgcaaacgtatttactgaaatttctttttcttttttcttcttcttttttctttttttttttttttgagacaagttctcactctgttgcccaggttaagtgcggtagcacgatcatagcttactgagccttgatctcccaggctcaagtgatgcttccacttcagcctcctgggtagctgggactacaggtgcacaccaccatgcctggctgatttttaaaatttttgcagaaatgagacctcacaatgtttcccatgctggtcttaaactcctgtcctcaagcaattctccccctttggcctcccaaaatgctgggactacagacatgagccactgtgcctggctatttattgaactttgtcccacagctgagcactctatggttgcaaaatacaagtttcaccaaccttctggcagctttaagatgcccatcgataagatggaattatgacacactcagagtgcatatggggataaggaaccactacctgagcagaccaaatcaatcaacatgagagctcttggaactagagatggctgggatcacattctggccctgccatttattatctgtgtgaccttggatctaaatagctcccctctctacgtgttactttctgcacctgaaaagtgggatgatgagatgcgttctccatggttttatgaggaataataaaatacctctgcaaagtggctgtgtttggcacacagcaggggctggatacatactgcttctcctacataccaagactcaggctcgccgacttgttcagggagagagggcatagagaacagaacttgcaccctgtacttcgctgaaacctcaggcatggacagctcagataggagtggggctcagaggcaattcatcctgtattctgaagggcagctaaacttcagctgaaaagctggggtccggaagccatgcaaaagacctgcagtctcctggtgagggagatgataaacatgaaaccatgtggaaatgtggattaaccaccctgaaagacaaggtccctcattgttcccgagacaaggaccatttctttcttttttaaaacagctgtattgaggtgtaatttatataccatagaactcgcatgtttaatggcttttaataatttatagagttgtgcacccaccaccacaattcaattggcgttgccctaaaaaatcacttgtgcctaagtgtaatcaattccttcttccacctccagcccctggcaaccactaatctactttctgtgtctacaaatttgctattctggacttttaatgtaaaaggatttatgcaatttgcagttgttttttgtctggctttttcacatagtgcaatgtgtttgagggacatccatgttatagggtgggtgcgtctgcatttcagtattttctttctttttaatgatgtgctgatattggaccagttactctaaaattttagatttggcatctatatgagtggagttttaataagaccaatgtcaggttatttagatgttggacgaaggaaacaaatttcaatgagacagaaggagtaagttcaagagatctattgtacaacatggtgactatagttaaaaacaacatattgtatctttgaaaattgctaaaagagtaaattttaagttttcttaccacaaaaccaatgataagtacatgaggttacatatgttaattagcttgatttaaccatttcacaatatatacatataccaaaacatcatattgtacactgtacacttacacaggtttttgtcaattaaatttttttctaaattaaacattttaaaaacatgcaaaaagctatagcatggcctctggcagggatcaagagcttcctacacgttagttttgatgttaggatcatcccagttgtaattagttatccattttagtagtattaccaccacagatcttatccatttagcagaagcaataagggaccatctctgggtagtcattgttcctagggactcctatgtaatctgctgggcgattcaaaaattcactgcaaaattcagtttttagaactaggaggtatccaataaaagttgttgaatataggaagaaaaaataaattttaaataacaaaaaacacatacaaaaagggtcaccctttgtggtgaattccccgcacgtggctcagggtctaatgcacagtggtatccagtaaatatttgttgaatgaattaatgaagagtttggattttaaaatattgcacacctataagccggagtttaataaccaaaaggcatatgatccttatactttcaatgttatcactcaaccatctatgtttccattggactgttgtctgatttatgggactgggatttgacgtaaattcaggaattgttggaagtagctgttcagtagtgagaagcagaagaaaacactgacacatggaaccaggtgtctttgttttggcaaggacagcaactgtattctgatactaaggtgggggatgggagttccgggcaaagacattaatagcactcatattgttcttttcgacacagatttgagagagctcttcaaatggcaaacacctagcatgtggggatctgaagcacctctttgtgggtttcactctcaacactcttggaaaatcaccgagtgtcatgagaggtgttattgatgcaggcctgtcatgcaggggactgacagagaggcctcctcagaaagactgagatggcccacagcagagggcagaaaaaaaaaaaccctttcctgattattgcaatcctggcaatgtcagcacctggttaccaactgcagcgatgaaaagtaatacaaacatttaggtattgatatatagaagacataagagtgaggggaaaatgttttcctataaacatttctcaaataattttgtgttgtttcagtaaaggtcactgtgattttgtaggccctcaggtgtgggtttaattgtgtttacttatgatgtatgattacagaaaggtattattcctgaaaaaccatcataatataattaaaaagttggcaaaagtgacgtctcattgctctctttgtttatttttttaataaaaaagaaaactcccattgcgctctgcttggagtacaatgaccataaaccaagagacagaattcacattcttggaaaatcacacactgtggtttccttgaaaagggagatgacttttgctctggaaaagacacatatatagagatcccaattaaaatgtatctattcttccaaatattctttctcatttaatccttggatacctggaactgataattaagaggtaacatcggcaactatgtactaggtgcaaaggcaataatggaatcctcatttttgggtgggtctttgcacagacccttacacgcacacacacacacatgcatatatatttatttttatatttagattccattcatgttaaatacctatagattttatattctgagctgttttctcagacgttctttcacactctgcaaagcctatgcttttttgcttagcttgaaaccacctccatgagtctcttcttatcccccaaataggagtcctgcattacaatcttctttgagcaaattcacaacctagattttggttggagttgaacatgcaataagttatcaagagttaaatctaggaagtggatttgggatagttttactcttttcattataactttccctatttttcatatcgtatataataaaaaatcatttttaaataagaaaaaataaatgactataatttatatatgtatatgtgtttgtcgtaagctcaggagctcaaagcattctcaaattttcttgtgtcatctaatcctaaataagtcatagttagaatctcctcaaagccacccagggctggctgggcacagtggctcatgcctgtaatcccagcactttgggaggcagaggcaggcagactgcttgagtccaggagttcaagaccagcctggccaacatggtgaaaccctgtatctacaaaaaaatacaaaaattagccaggcatggtggtgcgcacctgtattcccagttactcaagaggctgaggtgggagaatcttgaacccgggaggcagaggttgcagcaagccaaggtcccagccactgcactccagcctggacaacagagcaagcctctgtctaaaaacaaacaaacaaaaaaggacccggggcttgtgaaaatgaagtgtgttaatattcaagctgagtgagcagcccgtctaacaggctgtttaaattttgccatgcaattgttgaaggcttaaagaaaatcttcatttcctgggtgaactgaaacctggctaaatgcttttgtgaggcacttcttgttgagcaatcattatgtctattaaatgcttgattccatcacatctggggagttcactccccagaaaagaattgggatggtggtttcataaatgtaaaacaaacttcaggctaagccccctccgtaaatgtgagccaagaatccatcagctcacctgtgagagctctgtcaggcagtgtcacttcaatgcccctaaatattaaggcattcagtccttgaatctcttagctatgctcacttttctaggtgatcttattcagttccatgattctaaccagtacctgagtgctgatgactctagcagtgacttccaccctgaatacacacccacatattcaagtgcttcttgaataggaatcttaaatttcatatgtctaaagtgagtgatttttgctattttacccaacctgctcctctgttcagtaaacgaaatcttcatcaagttaatttgacccaagctttggatacaacttggactttgctgtttctctcatacccccccaagctctgtgcctgtctgtcagtaggaggaagtttatggtacaacaaattgccctttaccttagaagtgatgttccagcatgccccagactgctggacccctcaaactccaccagtgtggcaggccgtgaagtcttcattgagttaatctctccccttttggtgtgcctgtcttagtagaccataaacagaacttgccacttcctgctcaatgatgtgatgttataaatacaatagactagtgtgatgctgtgcagaatgtcaagatgatcaaaaatagagagagagagagcaagatagcgagagagtagaagagtcaacatgtgaaagggaaatgcttttgatcatccctgatgatgagtacacagaaggaataattctcaaatagtgacacaccaaacatgattttgaactgctccactaaacaacataccatttctggagtagtggctgcagttggggctactgtctggttaggtctatggtgaacagcaattactttctatgtcccaattgactttggcacagattagacaagtgatttgaataggatatgatggtacttacagctcctgagtccttcatgtcttcatgcttcccctaacctttgccatttctcctacatgtatgattgctactgatgcactgtcttgacgagtttaggggattcttcttggcttttcctattataatgacacttacttcttaggtcagaaaactcacacgaagcctctgcccgcttcagtagataatctcagttatacacttgcaaacttggagaatgacctgggaaactctacagaaccagtgaatctactgtgagaagaatttgggtcaaaagttcatatgtaaggctcctaaaaatttctgggtattccattctccctaatgtcctggcaattgtctatggataccattgaggaaaagtaactgaaatatttacccattatgttcttgtaatagtgctgtagggtctttcctcagcagaatctagttttccctcctatcagtgggctctaggtctgtgagctgccttagctttgcaaactgattaaggggctcggcactgatgcagctgatagagttttctgtttgctagttctagtttctttttatgaaagcaatagagaaacaccactgaaaccacaggttccccaggcatcagacatcctgactgttaccctgggtcgacgctagttacaggaattagatccaccttgcatctgatggctaactgctggcatttcctccaccagaattcagtcatgtcattggtattagggaacctagttgtatggctgcatcattcagtctcaaccctggcctgtagataacagccactgagtagcttctaaaatgggctaatgccccattcattcatgcgttgcttagagccacagtgaagtggggaggggtccctttgaatcctcccagagaacaaagtcaggtaggaggtctcttattttccatgtgcaattcattctagcatcccagcttctcttatccttctcaccccttcccatctctatgctaaggagatctggcaactccaccatatttatagaaggcattgctatgtccactattccaggtgccttcacgtcagactctcatgatcagctctagatgtccttccagaatttgaacctcaaggaacgtgtgagtgctacctaatcaatgacttctctcttctttagctttatattattatcctccaattccactctcattgttttaagatccaagtcccaaagcaggcgcagtggctcacacctgtaatcccagcactttgagaggccgaggtgggaggattgcttgaggccaggagttagagaccagcctgggcaacacaggaagaccccatctctacacccaagttaaaaacttatcttggtatggtggcacatgcctgtagtcccagctactcaggaggctgaggcaggaggattgcttgagcctgggaggttgaggctgcagggagctgtggttgtgccactgcacagcctgggtggtagagcaagatcctgtatctaaaaacaaacaaacaagcatacaaacctatgttttcacaactgatacagatgagcccagtgttgcaactcctctgacatacaggagtttatttctgaggagttgggcttgtactgcccaactcgggctatgataagacctggttataggactaggccagaggttcctatatagaccacttgtataagagttcttatctgccagaggttcctacacgtgtggcctccagaccaccagcagcagcatcacctggtaaataattaacaggacacattctcagcaccaactccaacccaaatgaatcagacaccttgagagtaggtcttagcaacctgtgctttaactagtcttccaagtgattctcatgcatgctcaggtttgaaaaccacagttctggagaacacaaacacagatgggggtgggtcttgcagaacctgtgcttcattttcaaggcacctctgccaggtgaggtcactgcaatggcagaaatgtttcctctgctcggtggaatggggctgcttgtgccatttaggaatgttccaggagatgttgggagcttgagatcctcaagcttgtccaccgaaatatttccatcacaggtctcaaggtgctgctcttggggctccttgtttagtcacttttggagcttagtcttattattatccaacttgggactgatttgttacataatcagccctgtagctgcagaagatgaaagtcttctctagaccttcccaaggggcctcctggccatcacagtatcccttaaatgggcaacatgccactctgagtctctcattttcttttagtgcggtccttcttcagtcctgttgaaagtagccctcccacaccagactcattccaatgatcactgcccgcatagcagttaaggatagcagccactcgtctttcaaagccttttcttccatctgtaatgcatcccaattatccacaggtgaaagcttttgctaccatgaggccactgtttgcaaagtgtaatcaccatctccacttacctccagcgagctagtccctactgcttcaaatgacatggacgacttaagtcctgaatcctctccagtgggtctgttttctagtccaagaaggtgcttattgtctgtacctggattccatagaaactagtggctaaggcacagcttgtgggattacattatttatttctttatttttagagacaaggtctcacccagactggagtacagtggtgcaatcatagctcactgcagcttccaactcctgggtgcaagcaatcctcctgcttcagcctccagagtagctgggattacaagtgcaggccaccacgcccagctaatgtttacatttcttgtagagatgggggtctctctttgttgcccagcctggtagtgaactcctggcctcaaccaatcttccgcatgagctggtatgcccagcctactttttttttaataaaagaaaaggcatacacatttatcaacatgtcaacatgtacatggggagaatgagagagtgattacccccagaattacattttaccaagagaaagtaagctcaaggaaatcaaggaggaattgatgcatttaaagaactggctatagcttgaggagcaagcacagctggctgttcaggcaggctggacatgtctgcataggaagaatgacatcatccagagaagtgcaccgggggaggaaggggtatatattaataggtatggctttgcatctgagctcccctacggggtcttaacactgttgtacttcagggccatccaagaaactctgggggctgggggcagcggggaggaccttagcagggcctgtttgtttagattcctcatggcctctttgtgcagcattccttccctccaggtatatatggcaggatccctctgaaatgaggtcttatgacttcatttcaggggaggtaggccagaattcttttatggccagctctcagggaggaaggatgggatatggtcagagagtgaccatccttgcttctgctattttctcagtttctgaggtgctaggttttggggtagcattttttgcaccccgacactaaggaggtatgtaaaataagttccaatacatgtatgtgctaggcaatggcctacctgtttctcagggctttttccaatacactatgcagcaatcttatttctttgcgtttataatctgtttcttcctcttccatatttaaagaccaaaaagcaaaaaaaacaaaagaaaacaacacttttctaggtgaaccttgtaaagaattaacattaataacttagtaaggtcatttatgaaaaaagaaaaaaagaattaacgttaatatgttgatcatttaatggtaagagactctaatctgatgctctgtattttttagtttttttttcccctaaggggagcagtcaagaaacattagtttagcaaccctctaattttcttgccctctcataaaccccaaagcaatagaaattttccatttcccataacaatcagtggtccattaatttttaatcttattttctacacgtttccaagtacagtagcttttcttagccacaatcttagtatttgcctctatttctcctctctctcgtctcatgcctgaatcattaccaaaacttatgcaaagaacaaagaggcaaaatgatagatgtataaacaaacctaagacgacctaattagtgtgaggacctgtcaggtgtcttcctctactttacctgagtcagtcctgacagcaacttggaactcaatggtattactccccctttggagaggaagacattcaggcacacagaaaattgtcttactttccaactcccatcttcataaatctgctacatcttaccttctgtcagagtcttcatttccagacacctttctgtagtacttccttgctgtggtcaaattaccaccccaacattgagtgttgggacaccctccgtgtgcactccagtctaggaaaagggccaccattctctctttcatagctactattacagctaccatcttacagcttccctccctccctccctcccttccttctctctttccttctgtcattttctttctcccttatttctatcttgttagccttacaccttttttcctccctccctccctttctttctttcctccatcctttcgtctttcctttctatctcccttccttcctcccttcctctctttcttccttcctccttttcttcccaccctcccttcctgctctcctctcctcccttccttgcttcctttctcctccctcccttcctgtctccctccctgctttctttccttccttcctccctacctccttctctcccttccttcctccttccctccctgccttccttcttttccttccttccttcctcccttcctcttcctctccctccatccccctcttcctcctttccttctttcctcccttcccctccctccctcccttccttccttctttcctcactccctcccttttcctcccctcccttcttctgtccttccctccctcccttccttaatcccttccttccatcctcctccctccttctctcccttcctgcctccctccttcccttccttccttccttcctccttccctctcttccttccttctttcctttccttttccttccttccttccttcctccctccctcccttcctcctcctctccttccatccctctcttcctcttttcctttttttcttccttccttcctccctatctccctcccttccatccatccttccttccttctttcctccctccctcccttcctctgtccttccctccctcccttccttaatcccttccctccttccttccttccttcctccctccctccctcccttcttcctcattctgtttttctttcttcattatcctttcttgtactatcttctcctttttaagttgacatcgcttcatcttagccctaagcttcctatggacagaaactaagtctattttgcttagaattctatctctactcctcatctgttgaataaatggacagataaataaatgaagggatgaaaatatgagcataccatatgaaaagccaacaacccaaatggtagtaactctctccccttgtgtcatataccaccccacacatgatagctcatttaacattcacaataactctataggctggtatttatactccctttctacagttctgtttccattacaccacatgttttcttctagtaacatttggtgcttggtattggaaatatactacagggttataatagtatcacctaccagaatctgcttatgtgtggccagggttattatagtatcctcagtaagcagtgctgtgtgccctatggatgaaattgttattcttatgagtggctatgcaatgacctaggaagagaacatgcttctaataagcttggctctgttccccaaactgctgtatcactcattgcatctcctctgtagtgggcaaaggtagacaatccaagtggttctattcccagacctttctactgggacctagaaataaagagcacctattccagcaaagagagttgattctgttagataagccaaaaggcaatttttggttaagaggaaataattgtctaaactgtatgagagaggctgtgctctgggaaacagtgtgcataggtgacaggctgcagtgtttctctgcagagactttattgacaatggcagtgagcttcctaaattgccaaggaagctatcctgtcctcctggtgtaagtcatttttcttttttctttgatttaaggcaaacaatgtttgagcctttcaattattaaagatgctctcatctgtcctgcatccaatcaattcttttttgaaaattagcaattatttagacaggaagcccatggactattcattcatgaaatgcctgagacctcgactttataaattgttatcttaaaggtcttgggagttcagggatagggtgtccctctgccacggcttgggcattatgttagagccttttatttgctcgttttaagtaatgtgtggctgcaggatacctacccttgatgcctcctcaatagagaaggcatattttataatctcagcattttctttaggtggagaaatgtctatccctgccttggtacacaacatttatcagactgaaaaaaaaaatgattattaaggaaggttcacagaaatagctcctacagcagataagatggtcttgccattactactttaaattatttatttgatcttttaaaagacaatttcctaagtgtttgagattttttaaatattttaatcacaaggttctttgtcctgaaagtgttactaaatacctgccttacagaagtagctaatcttatctctaagtacaaaggactgactacaggcatttattttcttgccagttcaagtggatgaaattgaagtatggatttgcatagtaaaggtgaaaggcattagcattgagagtattacaaaagtcttgttcacagcactgacttgtattagcaacattcccttttgactcctgtaccaaatcgcacatctaagcatctctctcaacagctcaaagggccttagtgatcccttctcagtatcaaggtaaaatctcaagtgctctccaggcccttcagctgaccccattctagcctctcccaaggccctcctcaacctatgccccaaatggaccatagtccaggcacacaaattactcctagaaagttctttgtcctgtcagtgggtatggttttgcatctgtgcaagtatccacttctagtatgtggttagtagaatgttgacttattctagggcagcagaaagatcatatttccccagaagccttccctgaccatacttcccatgtcctgggagagtccccattcctcctctcctcccatccccagtgaacttttgtttaactacatcccagggctcccagtggcccagaactgagtggaagaaagagaggcagtggggtggtccctggatgagaagcaaacatttccatcaagggctgggcagtactaatggatccaggaaagcctgcagagacatctcttgagcagtcagatgatcagtttgagtgctccctgtccacattccatctcagctcaggaaataccttttatccacggacactggctgcccgcatcccatccctgaacatcatgcacatggcggtgttggccccccaggagtatcttatcaggacctgtgatgaagaccatgctactctgccagccccactacaggataggataagggattactcctccagctgctaggaggtgctgtccctgctagtagccctcaactcttcatcctctccaagaattacccttctctgaagacatctcttttcctaggtcgtgctgttacttcaggaccatcctgcatccagtaactgttcagtgcaagggtataaatcttcctccccacaaacacacctcagagcactctaccaggccactgcaacctcatctactcaatagcactttaccaggccactgcaacctcatgtactccagagcactctaccaaatcactgaaatgtcatctactcaatagcacattaccaggccactgcaacctcatctactcaatagcactctaccaagtcactgaaacgtcatctactcaatagcactttaccaggccactgcaacctcatctactccagcgcactctaccaggccactgcaccctcatctactccagagcactctaccaggccactgcaccctcatctactccggagcactctaccaggccactgcaccctcatctattccggagcactctaccaggccactgcaccctcatctactccggagcactctaccaggccactgcaccctcatctactccggagcactctaccaggccactgcaacctcatctactctggagcactctaccaggccactgcaacctcatctactcaatagcactttaccaggccactgcagcctcatctactcaatagcactttaccaggccactgcagcctcatctactcaacagcactctaccaggccactgcaacctcatctactccagagcactctaccaggccactgcaacctcatctactcaatagcactctaccaggccactgcaaccttatctactccagagcactctaccaggccactgcaacctcatgtactccagagcactctaccaggccactgcaacctcagagctctcatgggctcagccaagtccttactgtgagagcactatagctcaaatttttccctttgctcagatgtgcctccttcctttcctcctcctgagaggatgccccccattccccaaacttctcatatgctaagctctgtctccttggctttcccaggacagccctgcaacagttccaagttccaggcatagcaaaggatgcacataaacagcaaactgctttagcaataaaaacaacctggtccttccttttctgcaagttgtctgcccaaatctaaacttccaggcagattcaagtaagttctagaaggtcctttgtcccttaggtgggtatgattttgcatctgtgcaaatgtccaccttctactgtgtggcgagttgaatgttgacttaattcttctagcagcagaaatggcacctttaccaggaagccttcccacgtagactaccatgaacaggggttatttattggaggtgtgatgtttgcttgtgtctgcacacctgtgctcattaacaaccaactttttcagcttaggtgaaggtttcctattgatctatgtggtaggcatatctcctgccttccagagaccagatgtatccagactagattcactcagttacagaagcctggtaataaaaccaattaactttaggagaacccacttcctcatcttctaacacattatcaaagttttgataatacagggcacaaagagggcatcatctcacaaaacagaagcagatgaaattgaagttgcagtgctggacccaaagaaacatgcttgtttggggaaaaaaaaaacagagggatcagtccatcgcttagaggtcacctaagcaagtcccctaaatatttgaacttaattcctttttaaaatagcaggaagctcttaatcagagttctgtcttctacaagcatatcttgttgaggaataacaatgcaggtgtatctgtgcttctcactttttttctttccttgtctgtttaaaagaagcgtggatttgcctgttcagctttccccatgccccaggctacatctaaatgaggagctttagactaagtctggaacgttgcagtgctgtaggagccactgattaggagggaatcagatgcaactcagggagaaagaaattaagtttgtaaactatcgctgtgggcaatctatcatgccatggtgttcaagaaatacaagtatggagattgagcacagtttcaaagtcaccttttggatgctggattttattcccttgactgttaagccccactgagaatggtccacctagatggtgacttcaatgggcttatagtagctggcctgtcaagggtagcctagcatgtgttagctaaagcacatcatctagtcttatttggagctaaaatcacgactttaaacctgaatcatgaacacacttcactcgaatggccagactattggaacaatgaccaaatactgagatttgatcaaatctctgtcgtgacagtttttggaataatgtgggaaataaatatcatagtgaagatacaatgtacatttttccaatggcagagtttggaactaaatgttcctgtatttagtcctgagagaggtggtccaagaaatatcttttctgtagtggctcaaggcagctgcctgctaagtcatgctcatgtgtggtcttgtggctgaagttgtgaattttaaaaccaaacaacttttgtagcctaggacacagactactttctaagagaaaattaagagtcacaagcaagtactatgctaggtttagagaaaagtagtcagattcatgattagaacataccaggaaattagtacaaaatggactggctcaaagggaggaacttctgtatgagagagggtttacctaaatcctcttgatattaatttctaactttgcaaagtctcacattgctgtgaacaattactactatggacaggaatgaatttatagctgagggctgcagaacctggatatacaatggcatttctgagattacaaagcaattgtctgtgtttttttctgattggaagaaatgtaagcaacatactgtctgcttatgggtagagaataggtcccatgtcttaaagatatccaagcagagtttgtgtagactttaataatatgataatgagccacccatcttgtcacaacttctgcatctattggtgaatgaagaggaaggatgttgtaatcccagtaatcacccctccaaaattagatatgtgcccctgggtatggggtgaacttcaaaactttaggtggcaggatggtgctacactagtttccttgaggcttgggtatcctcttggttcctttgcctccttataatgaagtccttgcctctgtcccagctccagggatacaatgcacgaactgtgttgcaccttaggggactctgctgcatcccaggggaaaacagaagaaatattgggctttaaattgacttctcattgaagagggccacaaacattttccagggtgaaattggatgccaccaaaattactaacatgcaaactcatgtactgtgatcacacaccctgttcccattttgactcgtgggagcctaagcttagttaattggttttattaccaggcttctgtaactgagattgagtgactgtagttttgatatatctggtttctggaaagtgggagatatacctataccaaagagatcaacaggaaagcttaagctaaaaaacttggttgttaatgagcacagatatgtggacacaagcaaagaagagagtcctaatgacagttacagacaggattgaataggtcctcactttggagaagaatgaagcctcctgaagcctctcctgttactgaattgcacaacatttccatgcaggggctactaaagcttccctactgcattgcctatccgcattcctcttggtcttcacactggtttttcctgtgtacgttcaattcccggttcttctgtttgaaagccacttatctccagacagctcagacttcagcctatcaatgcagattccctcttctatgtcctgagtcaccgttcttccaaattctgttaaatatatcttctttaggtaattttcttggctaattttaacagttatagaatgcgatgtatgagaggcagtagatttctcaaggaagcaagcaataatttttaggcaaaagttatatcaaattgaagaacagacagacagacagacagacacacacacacacacacacacacacacacacattttctgttaggaaaactggagtcatataacaccagtgtgattttttaaaaatgcctcctctttggtgcaccatgaaaattggttgattcaatttgatcattatgctttctatggcttcgttataatattacctagttatggaaatatgggtgagtcatttccaatgtgtaattcatattctgggtgtcagacgtggttgtacgtgtgaggaatacaggagcgaacaaaaagtataaaagactgccttattggagctaaaattagtacacattccagttgcacggagtgtcttcattttagcctttgcttcctttcaaatagctcatttgataatctaatagtattattaagtctttttaattcaaataaacttaccctctattgtgttccaatatccagacctgatctgctatttctcaaattctgctgaaacagaggtctcagcagccgtatgtatgttaagactggttctaaaggagaattgctttgggttgactgttatgtcattgcctttccattcatcttcctctgtgctctacttgctgctgattttaattattttgctgagattacacaaccaaatggtgccttctctgatgtctttaaaaataatcacatttgctcttataaggaatattttctgtttcaatctaagaacatttctacagtcattagctgagttggcaaaatacagagcccttcctgcattaatttcaccttctctggtctagaattcaacacaggatttattctgtaatctgttctgcaaacttgaaattctattcataaagaaatgtttaaataaacttcccaacagtgaccctatcttcctccttgattattttgtttcctacgttctgtaccgcttttctacttctgatgaaggatcaaaagtaaaagattgttttgactttattttaaatttaattagaaaataaaaagtcagtataaagcatttattaatataatcagtcttatgcaaaagcctgttcccaggatgtttctgatgaagttaattaagacacataattttgtatataaattttggatattagggaaatatttgatttagaaaaaaattagaaagctggccaaatttattcccctttctaaaaatcttcctatggtatttaaaaaatttatagtaaaaatatcatccactatgaaatatattatttgcatctaaattaaatatttttagtgatatggatacttgtatacataaacatacccacacacccccaacaggtatagttgtacaaatatattaaacatgtacatatacatttagaaacatacagctatgaagaaatgaataatgtttatggtaatctggctttaaaatccttccaaactagagatttttaataaaaaaaccttttagataactgcataaacacattccaataagacagtgtactatgaccatttcatatggtgtctgttggcattttcttctaactaggtccatattttaaaaacaatttctagaccatatgtggcttgcccaatcttgagaaaatgtttcattcttgaatttaaatttcaatacttggagtgggacaggatggccagctagacatagccaggaagtactgttcccaccaagagagaccaacattttgagtaaaccatcataatttgaatagatcttagagagaaaatgctgagaatggatggagatgtgatgtggacactgaggctcaaaaaggaggaagctgggaacctggcgttgggtacttgaacgctagggctacttcccagccctgaagggctcctggggaaggggtacatgaaggactgtgggacttcccactcttgcggtggaccttggggatccttagctagagggaaccccacaaaccccatggacatttgagccagccaggggatcatccagagagtaggcagagatagggctttagccagtgaacaaccgggggcctttgtgtatggggcagctccagcaagcccgaccataggcgccaatccccctggggctccccacctccctccaagaagctctagcctcagctcactgctgggccaggagagagtggaaccagcttccctgtgggactggggcatgtctgttatgcaggccctcttgcctgccagaccctctcagggcccctatctggccaacctacaagagtgtgtgcatgtgcatagtacagtctctgctgcccagcctaggtgctttgctgcacctgagtacattcccagcatcctccaagcactttggatctcctagaacatgaggaacccaagcccaggtgtctggaggatggaggtgtggggtgtcccaccacccagggctgtgatgtgcagctcaggagtgctgggctgagacctgtgggcagcacttgagctggggaggaacactcactctcagagaactgagaggggtgaaatacacaggttcataggctgctgcagaagtggggcatgcctccttccatagagccagcccagaaagggcgtggcctagctccctgccatggattttgcccaagggagccccacggcccagaacacctaacaaaagaagtgtaggcataatgccagtgattggagggggctcccccaaggcccaggagtgggcctggtgaggtagtcacctctcttccctccacactgcagagcatggctgcaaacatgaggaaatacaggcagctaagagcctatcagccattactcttatgcattatctactggaacacagcccaaactacaacaccaaaaatattttgctaaaatacccccctgtgaagcaaagggcaaggattcagccacaaataaagaccctgtgcagagccttgaccctgtaaaaacacccagaaacaaagccaactgactatactcaactttcaccacagttaaaggaacaccaaccctcccagatagaaataatcagcataagaactctggaaactcaaaaagccagagtgtccccttacttccaaacaagtccactagttccccagcaatgatttttaaccactcagaaatgactaaaatgacagatgtagaattcagaacctggatgacaaggaagctcatcaaaattcaggagagagttgaaaaacaatccaaaggatccagtaaaatgatccaagggccaaaaagatgaaatagtcattttataaaagaaccaaactgaacttctaaagctgaaaaatttaccacaagaatttcataattcagtaagaagtattgacaacagaatagaccaagctgaggaaagactctcagagctcaaagacctgttctttgaatcaactcagccagacaaaaataaagaaaaaatattttttaaaaatgaacaaaacctttgagaaatatgggattatgtaaagagcattggcattcttgaaagagaaggagagagaataagcaacttggaaaatatatgcgaagctgtagtccatgaaaattttcctaatctcattagagaggattacatgcaaattcaagaaatacagaaacccctggctagatactatataagaagcccattcacaaggcacatagtcatgagattcaccaaggtcaatacaaaagaagaaatcttaaaggcagctagagagaagagacaggtcatatacagagagaatcccattagaatggcagcagatctctcaacagaaatattacaagccagaagagattgggaactatttttagtgtccttaaataaaagaaatttcaatcaagaatttcatattctgacaaactaagcttcataagtgagggacaaataaaatcctcagacaagcaaatgctgagagaatttgtttcaactagaccagctttacatgaggtcatttagggagtgctaaacatggaatcaaaagcatgatatctgctaccacaaaaacgcatttaagcacatagcccacagacactgtaaagcaactacacaatcaagtctacataataaccagctaacaatacaatgggaagatcaaaatctcacatactaaccctggatgtaaattggctaaacaccccaattaaaagacacagaatggggccgggcatggtggctcatgcctgtaatcccagcactttgggaggctgaggcaggtggatcacatgaggtcaggagttcaagaccagcctggccaacatagtgaaaccccatctctactgaaaatacaaacattagccagatgtggtggcacacgcctgtagtctcagctactcaggaggctgaggcaggagaattgcttgaacccaggaggcagaggttgcagtgagctgagatcatgccattgcactccagcctgggcaacagagtgagactttgtctcaaacaaaacaaaacaaaaatcaaaagacacagaatgacaagctggataaaaagataagacccaaccatctgctgtcttcaagatacccatgtcacatgtaatgacacccacaagctcaatgtacaggagtggagaaagatgtactatgcaaatggaaagcaaaaaaagagcaggagtcaccattcttatatcagataaaacagactttaacccaataacaattaagaaggacaatgaaagcactacatattgataaaggatactatccagcaagaaaacttaactattctaaacatatgcacacccaacactggagcacccagattcctaaaacaagttcttctcgacctacaaaaagacttagccacacaataacattggaagatttcagtaccccaatgacaatgttagataatcatcaaggcagaaaactgacaaagaaactctggacttaaactcaacatttgcctatttggacctaatggatatctacagaacactgtacccaacaactgcagaatatgcattctcctcatccgcaaacagaacattttctaagtttggccacatgctcagtcataaagcaagtgttaatgatttttaaaaaaatcaaaatcataccaagcacactcttgaaccacagtgcaataaaaccagaagtcaatatcaagaaggtctctcaaaactatgcaaatacatggaaattaaacaacttgttcctgaatgactcctgggtgaacatcaaaattaaggcagaaatcaaaaaattatttgaaatttatgaaaacagaaacacaacttgccaaaatctctaggatacagctgaagtaataagaggaaagtttgtagcgttaaacatcttcatcgagaagttagaaagatctcaaattaacatgtaataaatgtacacatgtaacccctgtatctaaaatatattaggttggtgcaaaagtaattgtagtttttaccattactttcaatggcaaaaccacaattacttttgcaccaacctataagttgaaatttaaaaaataaataaattttaatacttggttcacttaaaggtttctttgtagttacacatttacataactaatttagcatatgatacatattttatataagctgtgtatattgtatatcatatatagctgtatatatcagtatgtaatatatattataactaattgtatcaatatctgtgtatctaaaatctttcaacctaccttttctacagtgatggagtattgtatctgttattctgtagtcagctgaaatagcaattctccaacaacctggagaaagcctccaggtcccacataaagcagatttgtataatcaaagaaagcagaaaatccttgagaaaaaaacagacatttttcaaactttcagcatttgctggattataaaaggaggcacatccaggctgacagttattagaagatctcaagaaatcatgttagtaaaacttctgtagcactattaactcccctttgggcagagactgagaaagatgaaaaggatcatgcccaaagaggtcagagcttttgaagtacctcgtttaattaaaaggtgaaagttctgttaattcagatataaaaaatttaacaagttaacatgtcaagtagaagccctgttcatgttaatcatgaagaaaatgacaagctgctgcttcttttttttttttttaaattttggcgaggaaagggaatatttaaattttacaaatcagatgaaatgttatttttcaaacagttgataaaataatgtttttgtcaattgcaaatgaattttgacataatttattaatgcattagagttcattttaaaacatttttcagcaaataagattttatgaaaggaaatactgctttaaacaagtcagtgtggtcccttgtaagtgagacagtaaacacaaaagtgtagaaaaaagtctcactaaagctgtcatctcctagtctcagtacagaagtctggatctaaatgtatgcatgactttgaatgcatgactcatacttcgctaaaagcagtcttacatcgaatgaatttttcaaacaaaaagatcctgagctaactggattcgattcatacagatgtacaggggagttggggtgggggttatcttcttttattttagaatattaaaacaaaattattacattaagactgccacaatcatttaattcaatgacaagaatcatctttaaatgactagttgagaggcagtcgcagtagagaattaagtggcctgaacagaagactgactttgccaaccaccttgaccatgagaaaatgatttctgtcctcagcaagccgccgtgtcctgtgtgtttttgaggaaagcacatgcaaagagacatagaaacgttttgtaattagctgcacttttagatttgaaaaacaaataaaaacgatagggagctaatatggtccaggaagtacagagagtaacctacttcttgacctaagcaagaaaacctaactgccctagaacccaagcaagctaaagcacatgttttcagcctaccaatttcgtggaggttcagattctatgacctgaatggagagagttaggttcaatcacctgaacacctgctacaaatagggggttatgtgttcccagcaagaatggaggtggaggtggtaggtgcccaggtgccacactttgtatagctttagggcattagtacacagtaccccaatcagacaccgagacggaaagccctggagttccccagggcctccattctctgctcttctttctctctctatagctctagcaggaacaggacttaaagaatatcccagtgtgtggctgccgtttatttttagggaacaaatggaatatcttgaaagaacagatgagggggctggatgtggtggcaacttgggaggctgaggtgggaggactgcttgagaccaggagttcaagaccagcctccacaacatagccagagcccgtcactacagaaaataaaaaattaacttggcatgatgacacacgcctgtagtcctagctactcgggaggctgaggtaggaggatcacttgagcccaggagtttgagctatgatcactgatcacaccactgcactccagctagggtgacagagtgagactccatctcaaaaaacaaacaaacaacaaaaaaaaaaaccccccaaaaaaacccaaacaagtaggtaaaggtgaatacatcaaataagattaaacacttcattcaaccctgtatcctaaggatctaatagattttccatcttagcatcccaaatcatctcttcgtattggaatcctgcctgacttcctgagacacatgccaggaggttccctttcatcatctggtaaacatttcattcagacttggacataatgatggcaggcctggcagtgcacttgcacatggtatttcagggcctgcttcctcaaagcaagtgacctttctttgtcattgaaatacaccaaagaaagtctaaagcatgttacactgtcttcagtttcttttttttctggaatctgtccacatttttagcaaacagctgtgaagcagccctaggcttaggaaacagaaaggaaggaaccatgggtagcagccttgagcttaagaaccagcaaatttcaccaacgaaacagtcacggtgcttctttcatctctcccacaacattctgactgactgtcaggttttgggtatatatatatatactttatttttaaaaggggattttgtgtctgtgtgtgtgtgtgttttaatagactttacacttttagggcagttttcttttcacagcaaaattgagtacagaaatttcccatatacctcctgcccctgcatatgtacagcctcccccattattaacatcctcaccagagtgatagattttttacaatttatgaacctacattgacacatcattatcacccaaagtcgacagtttacattagggttcacgcttgatattgcatattctatgggtttggatgaatgtataatgccatgtatctaccatcgtaatataacacagtaggttcactgccctaaaaatcctctgagctccacctattcatccctccctaacccctggcaacacctaatatttttactgtctccatagctttgcctgttccagaatgtcatccttatagttgaaatcatcttctaagcgttttgtagttttgcattttactagatttaatttttaagaagagttttttatttacggaagaacctgagcagagtacagataactgccatgtaaccctctatatttgattttaatgatgataaaatcttttattattttataggggaaaaacagaaaagaaagactcaaatcctatttttcaaaaagatagaagacaattggtttagttctcaagtgatagctgatatctggtaacccggaacaggttttatgcccccttcaggcaggaattttatttcccaaagggcattttctttgtcccaatttaccgctagctcagacatttttattacgatggtttcccgagagtgtctttttctccttcttaaccaccattgtatcacgttttaagtttacagaccttttatcacccacagcaatttctgagcaattgatggtgccacccataatatcaagttattgtcattaaaaccagtgcattttcatggcagcagttgtcacattttgcaaagaagtgcttgccagacatgtaagtcaccgcagccctaacaaaagtgcaaataaactgcttgtcatcagtgaaaagagtcttccagaaactggcattctagggctaaatcttttcaaactctggtccactgatcttaaaaagacaagagtgtgggtgcattcgtgctccttaatgattgtagcccaccctaagaattctgttttattttctaccatcgggaaatggctagtccatttcaatgagaattgatccattgttcctcaactttgcacaagctcttttgagtggatagataagttttgaagccttgccaagcctagtatcattagcacgatgcttccattccccttataaagggaatggttgacactcaatgtcaatggtacacaatttgcaagtttgagaaagcttggggaatcttcccataaaaccaggccttctggacacaactgtcagcccacaaagagaaaaaggaggatactggttgccatttggaaaagataaatgatagcatctgccctgataacttacaagacacatcactgtctttcagggttgagggaataagagacatcttgttaccttcatccggcctcctaaaccacccttcatcaatttctgtccatatattttactctttacatttgacttattcataagaccatggttgtgccatggtggaagggggaatgttaccaatgtggaccattggttctagcaaaagccctaatcactgagaattctactggaggagagtcattataaaatgagaatgctacaatgaaataaaataaaatcacagagagttataattatgtagccaatgaaatagaagatgattctagggaaaattagcatgtcactgttttagtcttctttcctattaaaagatggcattattcactcagctggcgaatttattgtgtagcatggattcgattagtgctgtttccccacttatgtctttagtaattacatttcttcatggttatttaagcccatgaatcataaatcatcatttatagttgagcaattacctcatcatgtagcacttcaaatggatagagacgctgtacttggtgtcaaacataagcaactgtgcgtgtcttggtactatattaatatatatcagtaaaaccttgaatatagaataaaaatgttatctacagccctcatcgagattccagcccaggactcagcaagctttctctgtaaaggatcagagaataaatattttaggcattgctggccaacaagacatacactctgcatttgcgtcaagaaagcagccacaaaccgtgcagaaatgaatgaatgtggctggcttaattcagggcagcacagaacaagcattggccagatgtggcctctcaggctgcagttagctaattcctgttctagccccaggatagaaactgagtgttaccacatgggccacctctggatacctctgaatattggtgaaggctggcttagaagggattggagaggaatcagtgagtgtgaatacattggaatagagtactctgattcccaatactagataagtgttactaattccttagtgtgtactagcctctgtgttgagacttacatccccctaaaacaaatcagagcttgtcttactcttattactcccattttacagattgacaagatgaggcaaagtgacattaagtagctttcctaaaatctcacagatgagaagtgaatgtctgtgtatgaagagagtagaggggagaagggcaagcaggatttgaactgtaggggccaagggaaagcttccctctccgctccaaacccttccccccactgaaggttcaagtctactgaaatgaactgacaatagacagattaacagaagaaaagttaaacaaatttactaacgtgcataagcatggaaaccatacaaaatatgagactcaaagaaggcactgatggctgacagttaaataccctcttcataggagagaggggaatggaaactgtaggcaattgtgagggctagtaaattattttcaagagaaatgaatgagcccaaagaatacacaatggctgggacaaagttcctcggagctctggaggaagtggagggaaggtgaggagcagaattgcacaatgaacaaaggttgacttattatgcaaatgaaatttcccaggtaatctcttggaaccgtcctcagaagaatagatgaaaaatctctctgggcacatgataacttttggtcttttctcttcttcagtggttaatcatttctgattatttcatgagattccaagggagggggccttaagacaattaacatgtcttttggaagaagttttcctttgtcacataagggaatttccagagaggccctacctgagcattggaggcagaaatatgagaagattagaaagtctttgaatctgaggcaacttctaaggccttccaatgtcctttaattcaaaagttctcagcatgccaaaatagcaaatgacactttgaggtatcattctctgagtcccagcagaaccaagaccaggaaacaggatgatggaggaggccttaggccatgggtttgttcttccaaaccagcctcttaaaaagaaaataaactgtttttctatagtctcaacacttctgacaacaaatttatggggatccccccgatactaaccaattctgcagttctcagctaatacagactgggtgtcctcaattccgatactaactcactggagttaactcagactcacaggttaggggtttggtagcacaagactgcccactcttaccccaacactaatagcaagtagtggtccccaggttacccacaacttctatcagacttgattacaaattgggtttggcaatttgccagaacagctcacagaactaaggcaaacagtttacttactattaccaatttactatgaaggacattttaaaggatacaaaagaacagtcatatgaagaggtgcatagagtgaagtccagaaggatcctgagcatgacagctttggccccatggagcttggggtgcaccactctcccagcatatagatacattctcgttcatcaacctggaatctctctgagctcctccatttgggttttttatggagcttccattacataggcatgattgatgaaatcattgacctttggtgtttgagtcaagtctcagcctttcttcccttctgggaggttgggggtagagcttaaagtcccaactctctaattacagggctggttcctctggtaagtggaacccattgtgaaactatccatgggcccaccaaagtttaccttattagcataaactcaggtagcatcaactatggttgaaaggggctcattacaaataacaaaaatctctgttacttaggaaattctgagcttaggaattttaggacctctctttcaagagctagggatgaagatcaaatatatgttttttattatatcacaatatcacacctctcctaaatcagtaatgtttacctttatgatctcatatatatatacatatgtatatacacacacacacaaacactataaatatgtatatataatatgtatatatatgtgtatgtgtgttatatatatacatgtgtgtatagacttatatgtatctatatgtgtgtgtatatatattaacatgacgtgttaacaatcaacagtcaattgttattcacatgtgcctagcttctacgttttagttactcatcatcattgagactaaaataatctagaatattaaacagcctgtaactcgggaagtagaaaaaagcattaaacatttgacataaataatttatttgtactaatgattgatttgaactaatttgagggggtaacttgggtgggcaggcacagacacacagatgagcatatatggccatgaaaattttatatttagggaaaagccatgagatgtcactcaaattatcaagatgtattgatgtttacagggttctttaactcttttgtaaaataattgttcagaaaacccctccacacatcactaaatagttataattttgatatgtctctttgcagctttttcttttacattttttcttcttaatatttatgtatcagagcattatatagctatgtctatccctcacctatctacccattgcttaaatttaataaaacagtatatacacaatgcatacatggacaatatgctacttcctccttgaatctttcaccacaaatattgtcccatgttactgaaaatttctcttaagccacgatttttcattttcacaattttgtcctttgacttgggcatacattatttgatcattaaaaaaacatgacattttagatgttgactcatttctgctatcataattaaagctgtagtggcttatttaacagtaagtttaaaagtgtgctgattattacattttttgcatgatggagatgagaaaaaaacatctgtagaacatagaaatgttagaataggttaaagacgttgctatccgaatgtgttgcctctgtattgtgttttaaaaggttgtgcgaatgtttgtttgcttttatctctttggccatgttttgtcatctttggtatcatctcatcctctgtgctttgtgactgaaattgaagtgtatttgttcagaacacaatgatactagatcgttgattgcctacagcattatggcttggaaatgaacacagtaaacagaacagagaaatggagttgtgcagttccaggagtggattagtacgttatgttgttgtagagcagtgtgtattcaaaagatttaaagatgccttatcaatggagacaaagattattttcaattgtgagtggcttaacaacatcactcactctgacatggcctaaatgctaatttaggtgctaaaccaaaacaaaattaaaaaaaaaaaaaacaccaggtgaagagcatttcctacaagcttgaatccagagagagttcatatataagtttacatatttatgtatagtatgcagtcattacatatctgactacatatacacatggtaacatgttatctatatgtgtttatgcacagaaatgcatgacaaatacttgttatggcatgtgatgaatatgttcttcatgtatgctcacctaaactatttacgttgatttaatgaaattgttctgtctgaagaatgccactacaacgttaagaattatccctctgtaccgtaaatgaatctgagttatctgaaaatcatagccaaaaatcttggagtcttgaaaaattctagaaaaggagagtatttctcataatgtatgtgaaataaggaaataaatctttaattttacaacccagagttttagtttttacctattcacaataatcaggcagggtcccatcctcccagggtaagctgtagtcaaggcctgggagaccaaactgtaaaccagaagggagattgtcccaagatttttgtttttctcaggaaaagatgcaaaatatttgtgacatttacatctgaaacagaaggacattccagagatttctcaaatcactaaaaatagaactaccgttcgacccagccatcccattactgggtatatacttaaagggaaataaattattctaccaaaaagacacatgcatgcgtatgttaattgtagcaccattcacaatagcaaagacatgaaatcgagccacgtgcccgtcaatggtgcaatggataaagaaaatgtggaacatatacaccatgaaatgttatgcagccaaaattatatcttttgcagcaacatggacgcagctggaggccataaccgaagcaaattaatgtagaaacagaggaccacatgttctcacttataagtgggagctacatcttgggtatacatggacataaagatgggaacaatagacactgaagactccaaaaggaaggaaggagggagggagaagggcaagggctgagaaatttcctattaggtactatgttcattatctgggtgatgggatcagtagaagtccaaacctcagcatcacatattaaacccttccaacaaacctgcacatgtacctcctgaatctaaaataaaaaataaaaataaaattaacaaatgaaacagaggactgtgaagacttatagtttattgttttagctgatttccttttcccactacccactttaatcttttttgggcaatactcactgtattagttcgtttccacgctactgatgaagacatacccgaaactggaagcaaaaagaggtttaattggacttatagttccacatggctggggaggtctcagaatcatgccaggaggcaaaaggcacttcctacatggcagtggcgagagaagaatgaggaagaagcaaaagtggaaaccactgataaacccatcagatctcatgaaacttattcactatcatgagaatagcaaggggaaggtctgcccccatgctattctcatgatagtgaataattctcacgagatcttacgtgtagacctcagataaggggtgaatgaggactgaactctgactgctgttctgtgttctaagtttctgaggtggctggaggagctttcacctataggccaagctcaaattcctttgtctaaaacccccaagtttttagacaaagcttcacttccttaaccaatcccaaatcagagaatctttgaatccacctctgacctgtggacccccctttcaatgtggctcacctttttagcacaaaccaatgtatagcctccatgtattgatttatgactttgcctgcaacctctgcctcctgcctttgaaaaccctgacacacaaggcattgaagagtttgggtcttaagtgttagctactgtattcttctttctcagagccctgcaataaatgcctcaccttcttttgctgcaaatcctgtcaatgtttgcctttgctgttccaggggtgctggatccaagctcggttcagtaagacggaagtcatagagctgactcgtggtctgtggtaccaggaagggccaaagtcaggccacaccaaccagagaggtctattgggtcctgacagggaccaagtggtcagctctctgggcttcagtggtgacttccagcaggacaagcagtgaccaggagacctttagggtgcacttcccaggagaacatgggagccagagaggctgtgttcagacaccctgactatccctctcatcgagttaggacaattcacacacatgaccttccatgtacctagagatcagtatagtggtaccattcagagaacagaccatagcaagtgtgagagactgagattaacctcataacaattccaaaccagatgagattaaagaataattatcctctaaaacaagggtggagtatcccttatccaaaaatccaaaatccataatgctccaaaatccagaactttttgagcaccaacatgactctcaaaggaaatgctcattagagtattttggatttttgattttcagattagaaatgctcaacccctaagtaaaattcaaagattccaaaatccaaaaaaatccaaaatctgaaacacttctggtcctaagcattttggataagggatagtcaacttgtatgtgcatatgtacatatgtatattatatgtattatatacatacataatcatatagagacagaatacaaaggatatacttttgtccctgaacatccaagttggttgcagtatgaatgaacttttgaggaaagcctcattggttatcttcctagtttagtagaggcattccttggatcagaaggactgtgtcctatttatcttaatattctcagtgcctgggaaaatgtcatccacggaccatcagtatctatatcttctggggggttgctagaaatgcagaatcccaggccccacctcagacctactgagttagcaagtgcgttctaacagaacccttggctgattcgcatgcccatcaaagtttgagaagtgcggccctaacagatgatcagtaatcacttatagaaagtatttatagaataaatttgtaaaatttattttcacgtgcaacattcatgaataaataaatgaatgtttcacattaataaataattgaataggctgggcacggtggctcacgcctgtaatcccagcactttgggaggccaaggcagatcacgaggtcaggagtttgagaccatcctggccaacatagtgaaaccccgtctctactaaaaatacaaaaattttccgggcgtggtggcacgtgcctgtaatcccagctacttgggaggctggggcaggagaatcgcttaaaccagggagttggaggttgtagtgagccgagattgcaccatagcactccagcctggtgacagagcaagactccgtctcaaaaaaataaataaataaaaataaataaataaataaataattgaataagtggagtaattaaaactgagtccagttgtgtctttctttacttatttagaatgcttgcagacagaggctgagttctggctttcacatccagcttctcttaaagaagggccttaattttcccccttcttcttcttcccagacaggacatcttggggcctgaagtggggtggggttcttcctctaagcctttctggcagatgcacagacaaagtcttagcctgttcactccatgaattgtaaactgcaggttcctatagaatgtagttctcagaatgtgcacatttatatctgtgtgacatgcttttccattcctttttcgtatctgcctatattcagaataatatgcctaggactccttgtcacaatattcgacatctttaattttacttgatgattgtataataagatggcccatgcccttgtctgtctgctgacacttagcagggagtttgtttagtgctgtgtattattttgatttatgaataacttctgaggatcaattggcattgtccttgggagcttcctatcatcattacttttgaaccattagtttgatgcctttagcaaaaggatctacgaccttaagaccttaaggactcgcttcatcattttggagttgagcaaccccagttgaattaccctccttatggtgttgtagggcttagaatagcaactggtacttggtaagctgaatgggtgagctattgctcttattcatgcattcattcatttaataagcatttattggcatccactgtgcattggatatgaagaatgtacatcctagcactttgggaggcagaggcaggaggatcacttgcacccaagagtttgagaccagcctgggcaacatagggagaccgtgtctctaagattaaaaaaaaaaaaaaaaagtacaaataagcaaggtcctgctgctgctgtctctgaggttctcccatttatgtgggagagatgatcttctgaatgatcagtaatgaaatgttataagaaataccttgaaggtacaatggacagagctgtaaattccacctggaggcaatgagaggaggcatcacagaaaaggtaccgtttaggatgggccctaaagatcagcctgcatttaccttaatcttctctctccattcagcctgcgcaggaaatccctgatcagatttcagccagcaaaacagatcaagtagcttttatggtccacggagcaatttaaagtgaggtctacagagcaatttaaagtgagactctgttttaggccatttcactgctcctgtcccccagtgaagaagaaaggctggatttaaaaaaaaaaaatcctggagcctggtatatatcatgttaggaaagcagcctgtttgaattcctttatcagttagtgcattttgttttattcaaattgaataaaaaccttgcccgaaaagaggtcgagactcttctcaatctctacattttatctatcccctgaaatgcttttccaattctttaaatcatcacggacaagggaaattgtgctctcgagaggaaagaggggcttctgtgaccaatgcttctgaaaatcctccaagcttacttttctgtcaggtcaatcaacctgtctatgcactcttttatttttattttttatttttgataacagaaaacaaagttcacacacgacaagacataacatggcataacatgaaaaatgccacgcaactctgtggcactgaaagcaaacgtcttcagactgacttaaaggacatattgtgttttcttaagttaggaaaataagcccgctctgtagcaaacagccaagtgctggggtagttgtggtgcaggagtgttcccctgggcttaaggtctgtgtctatcaaaatggccaaaaggtcagtcctggcagcaggaactagttcctttatcctttccctctccaatacctgcctctttgcaaatgtttgtttttcccactgagaaaataaatgcactgtggagatggaggataagagagcagtcagatgagcgaactaaataaagcaatcatgttggagacagagtgggggagatcagccaagacctttagaggaaaacagagacctgtggacacagagtggggaggtaaatgtctgcaggatcatcattttgaagagtcttaaagaaataagcttgaattatttttttaaatcaaatgatattatgacaaagagaataaattttatcctgaaagcaaaatcatcccttgcaactatttaaacttatgttaaaatttttagatgtcaacttaaaataattcagagcgtttgaaacttatcaaaattctttgaatgccaaagactgatattatgcttgaattttctacgtgagcatgaattagtttttctaattctaattagatatacttaacctattttaatttgaaaacaaaggaattggatgaatgcaatggctcatgcctgtaatctcagcactttaggaggccaaggtggctggatcgcttgagcccatccatgactttgagatcagcctgggcaacgtggcaaaaccctgtctctactaaaaaaaaaaaataataataataatacaataattagcagggcatggtggtgcatgcctgtaatcccagctactcaggaggctgtagtgggagagtcgcttgagcctgagaggttgaggctgcagtgagctatggtcatgactctgtactccagcctggccaatagaacaagaccctaattcaaaacaaacaaacaacaaaaataaacaaattagtaatcatgtaatctgaatgggtgagtttgtaaaattttaaagtaatgaaaacactaaaagagttacaaactgtatgtaaaaatccaaccattaggtggaaaagtacctgtagcagacagaaagacagaatccgtaactctaatgaacaaaaaataaatgtaaatttaaaacataaacagaaaaagaaacagactctttacatttttttaatgtaaaaccaactaatcaaccaaccagaaacccaccaaacataacaaatttcaaagaggcgccaacttgtattttgtattctggaaaccattaagaatctgcttgtgttggctgggcatggtggtttatgcctgttatcccagcactttgggaggccgatgtgggcagatcccttgatgtcaggagttcgagaccagcctggccaacatggggaagctctgtctctactaaaaaatacaaaaatcagctggggatggtggcaggtgtctgtaatcccagctactcgggaggctgaagcacaagaatcatttgaacttggcaggcgaagactgcagtgagccgagatcgtggcattgcactccagcctgggagacagagtaaaattccatcttaaaaaaaaaaaaatctgcttatgcttatcccctcaagatctttagttttttagttttgtttcccctaaagctatataagctcacattcatagatattaattatagagtttttcactggaaggcattttagaacccttttgcccacagttaaatataattcatgaggaaaatgtaatgtgcccaaggatatgaatatttcttttctctcccttatttccacattatgattctgtatggtatgaatttattaaggctcatgcgagttgagtccagtttaccctctcaggagattacactcccagcagccctaatagagtgttgtcacctagtattcctctgtggatttttcttagcatatgaggctttctcttattttttttttctgatccctgcctcaaggccagtggcttatcaatggagtattgaagtaattgggcacgtgaaacaacagaatgggtttcactccacttttaagcgtctgatatgtgctagtaaaatggacaactgaagcttcagggatacagggattgcttcttttccaagcaccactatcctgcaacctgtaccaagttattgtcagtggatttttcctatacagactttgggcaaactttctcaaccttggcactgcagactttttggaccagataatttttcatagtaggggctgacctgggcattggaggatgtttagcagaatctctgttctctacccactggatgccagtagcacatcctgcctccagttgtaaatttaaaaaatgtcttcagacattgccaaatatcccctgggtgagggcataatcatccctaattgagatccctggtttagagtagttggaaagccctaatttatcttattggagaactgacgtattacagcaaacaataataacaacaacaaaaatgtatgttccaatgtttggaggtattctcctaacctaagtgtgcacaaatgtctgccctacagaatggagacagtgtctatatatatagtgtgtgtatgtgtgtgcatgtacacacgtgtgtgccttcttatatacctccacacacagggtgagtggaaataatctcttctcctatagataatatgttgagtaagtggtgctatagtgtttgaattactccagcaattcaagtcccatcgtggggcaccataacagaatgagttttttcccatctactcacacgccactcaatataattcttctgacaccagatgggtgggcatttgtcccaacacgccaagcaattctcccacggacaccagctgggattcctctagttaaattaatttctggcactatctacccagagatggtgtcaaatcccacaggttgaagactgagtcccacaagactgccccccacgctttcaatgctagtcacaagtcccaggttgtgacctgtgcttctgactggctataaattgggggttcccacaacctcctcctcaggttcagtgaattttctagagtggtcacagaactcagtgaaacactttacccatttattaggaaggatattacaaaggatacagatgaatgggcagatagaagggattcacagggcaagggatgtaagggtacatgcagagcttccatgccctttctgggtccatcatcctcgaggaagctccgtgtgttcagatatctggatgctccctgagccccatctgatatggtttggctgtttccccacacaaatctcatcttgaattgtagttccgataatcccatgtgttgtgggagggacaaggtggagataagtgaatcatgcgggcagttttccccatcctgttcttgtgatagtgagtgagttctcacgacatctgatggttttataaggggctttcccctcctttgctctgcacttcttcctgccatcatgtgaagaaggacgtgtttgcttccctttccaccatgattgtaagtttcatgaggcttctccagccctgtggaactatgagtcaattaaacctcttccctttataaattacccaatctggggtgtgtctttattaacagcaggagaaggaagtaatatgccatccttttgggctttttatggagactttatgatgcaggcatgattggttaaatcattagccattggtgattatgctatagtctgaatgcatgtatgctcccaaaatcatacattggctcctaagagccaatgtgatatgatagtattaagaggtggggccttttgggaagtgatcaagtcaggagcactctgctcttatgagtgggattagttcttttagaaaggaacttgatgggagctctgtagtcttttcagccccttcctccatgtaaggacccagccacaggcaccatctctggagcagagcaagccctcatgcaacactgaattggcagatgccttgatttggacttcccagtctcgagaactgcaagaaaagaatttctattatttacaaattacccaggataagatagatattttatcatagcaacatgaaaggataagacagtgatcaattcaaacttctccttttccctccccagaggtcaagagttggggctgcaagctccaaccctctaatgacaaggttggttttcttggccatcagcccccatcctgaggctgtccagaagcccaccaagagtctcctcatgagaaaaaaaacatgctcctatcacccagcaaattcctacaaatttaggagctctgtgatgggaactgagggtcaaagaccaagtgtagaaacaaatgattctcctagcaatcctacatatgtggttttaggacctctgtaccaggactcaggggacagagaacaaaaatatatttcttagtatgtcacaatatcacaggcactttggagagtattggaactggacacacatgtcccgggtcctccaagctatttcctgccaggtcattactaaggtgtaggtcgttcctcgctcaaacacaggccagtagtgtcacactgagtgacttgagagaacagaagtagatattcctgctcctccactcatatcccagaaaaaccaattgtattaccaggaaaaattatggtaggtacttgcttctttgctgtaggtgctgtcttttctttctgcattcagctttctttaaattagcacctccttcctcctcctcctcctcctcttctcccatcgcctcctccttctctctctttctttttcactctctctcccccaaccccctttctctcttttctctctgtatctctctgtatctctgtctctctctgtcacacacacacacacacacacacacacacacacacacgtgtgttgcccagttatgaaggacgattctgatttctctctttcaaagaaagaaaaaatgacttcataatctcattatcaatgagatcttagtggctaaagcatggcttcttccaagatagtatttgaaaaaaggttctttgggaaaattcttaacaaagattagattaattccaggaaatatttgttaagcactgtcataggcatctgacaagcaaagaaaagtaaagcatggacattcagtgctgctgcaatgtggtgtgtgtgtgtgtgtgtgtgtctgtgtgtctgtgtgtctgtgtgtgtgtgtgtgactgttttggagcaagtgagtcttcctgaaggaaaactaagtaagcacttgatccacctaaacctagtcacaaatctaaatgaaaaagtaggaaaaatcagaaccaattatttggccataatgaagtgtcagtattttaagctctaagagattcctctctaatttgagaagaattgagagattgcccattatgacctattgctggtatcttgttaatgtttctaatcatttttttttaaatggtgtatatctttttatcaattacttatacattgcctcccttcctttccagtagcaatatttatttgtttcccattttaagggagtaggtctatgttggacttgaattttcgttccctaattgtttaatgtataaatacttgtctgttctcagacatagaagtaggcagggtttccaccttcaaattaaagagtcatagcaggatagttcagtaataacatatttctttatagaagtaattcactaatgagtcttatataatgtactactggctaaatctatctccatcatgtaagaatacattttatgcttggtctttttttcgtgatggatgttgcccagttgtctctctcctcctgacgagtcgcgtacagagtgtgggcactatgcagttaacataaaagtgctggctcagccaagtttccccaaataggcccacgaagcaggtggttcctccccagtggaggcatttgtcattacagacaggatctaaccacagaaaaggggcaatctgagtaatgcagagagtttagaagcagcattgaagtgtacatgcacacacacacacatttgctttttttcctctttcttcttaaagcatcctcttgaacaacctaaggaggaagacaattgcaggcacaccaggatcttcataggacaacacagtgcagaatccaaactccagcagtttctaattttaccaactcaggggggactgaaattggggacagaaatagcacaaaaacaatagaaatgcatgtcatgaagcctggacatgaacaaagcaggttctgtcatgctgaactttgggcagacagaaatggagggactgagcttgttctgcaattcttttcagagctattttgcacttttgagacactcatgtggttgaacataacatatataaacaggagtataatagctagtcagagcagcagcatggaattcataccattgtctttgttacaagtatttcatagttatctatagcttttcatcccttttggtttatatttcaagtgtctgtgaaagcacatcacattgtgcagccctgatccactcttgtttttactggcactctgaattttctcattggcctccctttgccaagctttgaagcaaagaaatcaaacaagtaggacattcaggtgggtggtcactggacttgggaaattctaaaataaagcaactgatgaatagcacatagtttcaaaggggcttttcagctgcaagacatatagatccaggtatgttggtgtaagcctcaaagaatctcctagcattatgagggacataatcaaaggagattaggaacatgaatccaaggcttagaaatcattctcttgaaagagtgtggaatcactcactagagtatggaattagagacttattagtctgagtttacagtttggctctgtcacataatagctgggtataaaaattcctacttcatgtggttggtagaggaattaattaaattgcattctagttaccagcaggggagacaggggagaagaaagttggacatgaagcagtggaaagcaaggacaaactggagctttctaggataactgggcactcatggagagtattggaactagaaatactctccagtactcatggagagtattggaactgaaagctgcaaggacacctagagccaataaggataacctggagcccatgcagactagttggagtctaccaagacaaactggaacccacatctatttaattccacattgaaactggaccattcagtgatctgtagaaaaagccagtgccctttggatgaaattgcatgtggacctggcctggggcctggagtcactggaggaagtgcttggaaggatttggaggagttataggcccagtgaccactccataccaacatggagtggaagtgaccaatgaaaacttgaactggtacatccttgcttgtccccatgtcagccttctgtaatggctgctaattcctcataacttccctgtattattaaactcaacttgggtttacccatttggcacaacaaagccaaattctgacatcagggtttgcagtgcgagaaagtgggggtttttaaggcagggaggcagaggctacaggcaaagtcataaatcagtacacagaggctatacattggtttgacctaaaaaggcagtttatcttgaagtgggagcttacaggtagattcagaaactttctgatttgcaactggttaaggaagcagagctttgtttacagacttgggatcagcagaaaagaattttcactctgttctatgggtgtgagttcttccaggcccctcaggaataaatttagagcaaaggatggcagtcagatgtcagtcctcggtcaccctttatctgaggtccagatccaggtatgttggtgtaagcctcaaagagtctcctagcactttgagggacataaagggaattaggaacatgactacaaggcttagaaattcttctcataagacagtatggaatcactcactagagttttggaattacagtttggaattagtttggaattagaaaatggatggcatttttcatttggtagtagcctggattcctgaaaaattagggtcatatgtcaagatattatctttagtgtctataaggaaccaaacattttgggactgtaacttccttaaatattgttttaagctattattacgtccttgcttatcaggttgcttctttacttctcaaggctagctaggtgcctggaatttcccttgtaggaactcaagactttcctttatttccatacatggcaggggatgggggaagggcactggcaggtccctcagagggttctctactccatctcaccagtctcacaaaattttctgtgtggccaaccttaacccagagtcatacaggtaaacaaattctgaaaagcgtagaactcccttagctacattaacacaataaaaaaaccttaaacagactttcttctattacaggtgaaggttaaatagtcctatctttaaaaaccagacaacactggttctctgaacttctgacagtgaatttcatctggtgcacaaaacagcctatttcaggagatcaagtgcacactcaaatctagtcctgctgtatcccaggccatgttgagaaggcttttggttagaacacttctttctctgagatcacgtaactgcaggagaaaacaccaacatcaacaacccgaccaaaatattttgatttggtggatattaggttctaagttttgcctagagactatttagaggggctcagaaataccacgatatgtttcatttcttagttcatgtctcgtctctgtagcatcattttcaccccaactctgaagataaatagcattgagccattgaagatgaaactcacttatcaatccctatgtggaagataatgccatcgaccaccttctgtcttaggaatacatttcaaaaatggaaagaatgcttctctgacctactctttcacttgtacctccttattaaaaaccaggcctcctttgaataggagactcagcacatttgtctaccctgctggcccaaaccaagtgagcataaatccttaaatcctacaagcacatgcacatggtcaccaaggcacaagcacaccatgcagtgtgaacttgagtaaccaatgaggactattccaggacttccagaggttcctgttctgagccactgttacatcctgggagatggccactctccattcaatggagattttttccccctttttgtagcatgaggtataagcacctgggtaaagtgcagttatttttgagtttgacaagtgagcatatattattgtttagcatgccttctttgatgttcaagctcaggagaaaaatctaaaaaaatacacaaaacgtccagatagaggattattgatctacacttcaacagtaaaaaaaaatacaatagatttttcacccacagactttttccccttactctgggaaagaccttttactagcaaagtatgactctagattgtcctggtctgtagatatacaaatattgacatggaatgcaacataaagcatacaagtagtttatcaccctaagttattatcctttttaaggaatcaatcactgtaaaattggccatgttgacactcatatggatattacttacttgataaatgttgaaatagaccattcaaacagatgcattcttaatattttgaagaaatgcccatcttgaaaatgctgcagagattttcctccatatatttttatctgaaaaaaattggattcagctaccagagaatgctccatatttactattagatttactggaaactgaaagaacagaatgatgttgcctctatagtctgacatatgctgggcatatgtaaaaagaaaatgaaagagtacgtttgagtatgaaatgagcattcctttattttttccctgcaaaaatttttccttttttatttttttactgaaaaaataaggtacttaacattctcagatatatgatactccatattttgtctggtaacagggaaaaaaagttattaggatacagtttgtgagtttttgaaaaacaacctgctatagcacatactctgccaggtctgtcagagtgaaatacctttgaaaatagaactgactatattttatctgcttagtttaaaaatggagcgagttcccttgaaatatgatttccaagttttgaagtcattatgagtgaatgcattctattctaactccagaggctttccgagggagaaactgatgggcccaggaaggagatagtcacccgtccatcctggtcttgtccatataattcaataggcttcatagagacatcttttctttaatcaatttaaatgtcatttttaagactaatttgtacagaattgttgtccttattaattcccttgttctctatggagtgatttttcagaaatcattactcttctctctttttgcagttttaaagctttgggcattaaaaattaatttttcatttttttcttcattttgatcaatttcctgaaaaagtaaaatgatgcagagtgtatactatggggtaatactggctggttactaatcttaagtctgcatttactaaatgtgtgatcttaggcaaatgactggacttctgggttattctagattactttttggtttgttttattgtaaaatggggataataaaagtatctattttatgaggttgtggtgatgatcaggaatatatgtgaagtgtattggacattacatggtgtatagtaagcaagtcagaagtgtttgttattaccgttactacttaacaacattaaattatattaaacattatttaataacattgctgacatttgctttgccaatgtaggaaatctccttcttcaatcctcttgcttccattctcttaagctaaggtgatagtttaatcaatttggggtaatgttgatttgatctcatacctgaatatttgatatgccttaattcctcactttcaactgtgttaggtttttgtttgtcattttgtgtccacatagaggagggacttcaattcagcactgatttttcaccttgaaaaacagcataatagcagctttcctttggggacaatcaaagacaaaaacaagcgatccacttcccctgcctagccccttttctcttttcctctccatttcttccaaacacacaggtattgcagaaggtacctttgagggctgtgtgtgggtaatgatgtggggaagagcctggctgaggcacgcctgtctatattgacattttattaaacttatctacttaccatgttaacatgtgatgctttttatcaattccttccttgaaggaagcacagaatatccatcatcttttaagtgcttagtgcttgtaagtgtatgtcacttcacagaaaataaatacttttcttatgagaaattcaacatagttcgagggcagctctcatgagcatcttctggtttaagtacctgtcaggactttagccagtgccgactggggtttgaggtccttgaaatcacatattgagtactgacctgcagagagggcccaatacatgttatgcaaatgaatagctgactggaagttcattctcactgcattgcaacaagtgggtgggaaagaagcagggggagagggaggaaggagagctgaaaggtagcaccgtcacccaggagagaatgatgggtgtctgacccaagccagaggcaaggcatgttgacaggagaaaacagattcaagggcccatggaagatgagaaatagtggactcagtcccaggtgttcattcatccagtggtgggagagggagggtggggaagagaggagtcaatgatgaagttgtgtttctccacattgaaggagaaattgtgatgctttttatcaagctggagggcacagaagggaagtcaagggtagagcacataggatacgtattaatgagatgtccaaaaatcatgtcatttagggttccccagagcaggagacatccctggggaaactggtgacttgttggctcctgggttgaaggagctggcaaaggccagactaagacaagaggagggtcaggaaggaatgccttggaactgagccatttcagaggatttggataaaggaaagtgggggtccacgagagatactaagaagacatcagaaaggagggagcgaaatgaagatgtccacggaaagcagctaagaagagaaaaccaaggatgccatgtacagcaattgcatcaaatataccagggaccagatatgtctattttaaaaacctatttattttattgtggttgtcagagccaagggaaaagttcacacctttgccctctgaagttttgctgaaaaatcaactcacaaaaagcagattaattggagaaaaagcatataaatttatttaaaatgtgcacacaggagacttcaaaatgaagacccaaagataccggagaaattgcccatttttatgcttaggttcgacaaagtttgaaaagctgtgtagaaacagggttggacaaaaagggcctgatctaatgctaatagactgagcagggaaacccagcaagacctgtctgtcgagattcttcttggcctctctgagcaatatttctcccttctgggtgtggggcaggaccctctggggtcttaaagcacttaagactctgaggtcttaagaccctctggaatagggggtcttaagacctaaagtctaacaaggtaggtcagggaattttgttatggccaggttttacacagaaaggcagagggaaaattagagtcatacttttagggttttatggctgaatttggagaaaaggggttttggtttctaggacctgccttggggaagagggattctagtttctgtggtgcctctggaaagaatggaactgagagacagaagggcaggagaagatcagagaaatccttctgtttctgagaccttcactttgggatattgttttatgagccccaacatgatgtaatttacatacagtaaaattaaccctttaagtgttcatcatgtgaatggcatatacagtgacagttgtgcaacaccacaaaatgaagaagatatagatcaactttattaacatcactcttcctacacaccttccagaagtacatgcccttttacacttaacagcatccacaatgcaggccctggccagtactcacctgttctctgtccatatagtggtgcctttgcaagaatgtcatataaatggaattacaaagtagtcagtctttgaatttgccttccttcacttaacatcatatacaagagataaatctgtgccactgcttacaagtggttcattcctctttattgctgagtagtattccattgcatggatgcaaccacattccccattcaaggggcatgtgtactgtctctattttttcatctgttaagttgagttaagaaaatgttactggtaaccaaggcaaaagctgttttagttcagtggttggaatgaaagctgaacagacgttggatgaggagggaatggggagttgtgaagaggagaaggcaattttagtttaatattttatgaaatttggctgggaagcaagggagagacagtgatctgtagttccaatgagaaatcagctgaaatgaagattgttacttttattgtaggaaaatagatatttaatcatacttaaagggggatacttaaagggagaatacagagtttttgttcctgcttgtttgtttgttttactgttatgatatatacacacctgaaaaacatatccagtagttagcaaaattgttgtctaaaaatagcagggctcgtgggaagatatgtgggaaatacttttctcaaaattttttgaactcaactttctaacctaattaaaaaaataaatataactgtatcaaaaacacaggaaatgcagatgtttaaagtcctatttttaaaaggatgccaaaatgagtgtagaatattatcataaaataaatagtgatagtttaatgggagggggtgcacagaaggtttcagaagaaacaggcaaaaatgcacaaaagtcagggagcaccaggtaataactgccagaaagagaaaatggggtgaacgggaattgttatagttctctttttttcgtatggggctgatgccttcatgcttttaaaagtacactttgtattcctttgctgttatttggtggtatgaaacatttatctctggaatcaaagtaatataagccaatgcaactttcacatttttctgacattattcttccatttctcaatggcctatcagctaattaatgataaagaaatgggtatgtatctgtagaaataatgatgttaaaggtgcaggagagacaaagtaggtggagtgaggtctcaaataatttaggatgagatagcatgaatgtgagtaatcccttaaccatgaagtccctttaggaggcatctaagtcaactccaccatcttatgagtggaccacattgaataactcatagatcgttaacttcacctcccaagtttaattggaaacatttttcaattgttgaaatcattatctaccatttttttaagtgtttagtacacatctcataaaaggcaaagatacagtagcacacagtggatacattttggataaatcgcaaggtgaagagttatgaaagctatcagtagattatttcattttcatctctctaagtaagctttctattcgttctattgtgtgtcacataccttgttcaagtgtgaacttatattaccacctccagcttgtcaggcagaaccggacaggcttgttcaaagatcagggcaacaacttcaaaatggcggtgccatattgcaatggccacagaatttgaggggacttgaccagtgttcgggcttatcctagatgaggtggtacaatatcaatttcagtctgcgatgaccataatctaacaagcaattgtaattcttcctttttcaatgctccaataatttccctgttcaggcttcaatgatacatctaggaagtagtttcataattatctgtgcatgcattgatatccccaattaaatttgaactttaagagcaaaaggtttatatcccttcatctgtgaattcaagctgctagtctcctgtctagcagccagaatgtgttacaatcagggactattggatatatgcatgaaaagttaaagaagcatagttatattccaactactgtccatttacttaaactgactacactcattctatcttttaccaccagacctgaagcactatagctaaacataaaggtagagataaaataccagaacctgagacagttctaggaagagtaaagctaactccctggcacagcattgctcatagacaggcagcatgaaggaagagagagggtatcctgtgtgagaagcagacctgggttcaaattctgactctagcattttgtagctgtaggagtctgggtaagttatctagtccattgcttctcaaagtatagtttcatgagctgcagcatcagcatcagcatcacctgcaagcttattagaaatgcagatttgcaggctccattccagatgtgccaatccagaaccagagttcgaattttaactaggtccccaggtgatgtgtgtgcatgttacattttgagaagcactggactagacactctgaattttagtttcctctattgtaaaatacagaaaaattatcaatcttccgaaatatgaagtctacaaaaatgcatgtcaaacacctagcagatagtgactgtgcaaaaatgaaagctattaataacaggaataataaaaaaaacagtaagaagtttagatattgaaggtgaagagaactggaagaaaagacaatagatatagatatagatatatctttctctctgccaatctatggcaatgaagtttctagatttgtatttaacttctattatggcaatggttctcaagtggggactcttttgtcccaggagatatttggcaatgtctgggaacatatttggatgctatggctgggtggtaaaaatgtgactggcatctagtgggcagaggcctagatgccactaagcttcctacaatgcacaggacagccccctataacaaggaattatccagccccaaatgttagtagtgccaagattgaaaacccctgaaatagatgcttctagaaatgacacatgttgcaagtggaggtcttccaatagggacacaagtgaaaactatataaatgtactcaaaatatcaactatgagttggattatgcaaatggcttgggaaaggaaatgaggaatgaatcaaagactttaccaaaagaaacattttccccatctccaagctcaagctgttctattagttgtatctccaagaaagttaaattggtatagttcttgtcctctaggagattatagtaaaagctggggattgactattaaggcatttgatgatacggatgcaacacattatgatataaaatgcgagatattttataaatcaaacgctgaacaaacatttaaaatgcgggcttatctcttttagttacaaaatactcttaatgattttaatgctcaactttatcttgcctgagtacttggttggtgaatattacttggagaattctttcatttacaacaaatggtcacattagttctctgtaataaaacacagtctgggtcataaaaacacacatcaaaagaaaaatttgccttatttattacttcaatttcatgcccaagtttctcttgccatgcctctttttattaattttatgatttttatggtttatttgtaagcagagtgctgtcccaaaatggatgaacctgtttaccagtaaatcagtaaactgtaaacattgctataaaataaagaatgttgttgtgataaatcaaaaatgaagaattctaggtatcccaagagagcatttttggtaggttacatcagctaactcaactcctgcacccatgaatcagtaatgtttgctggtttatgagccttggaaagcacaaatattcccatttctcctgctcagcacatctctgtagtaataagtaggtaattggttttgtcctattacactctttctatattaccctttgcaataatcacatataaatccacaggattatggtttcctttatcataaatttttcatactctaactccttattcttcctttcttagttgtagcacatactccagaaaaatatcacaacagtcaaacaacacagatgcttttgctttttgtgttcaaattattacatttctcaccattaattattttattaatgctgtaagtgaacttaccatctaaaaatacattatttttttctctcccatatatagatctcctggaaatctccaatacagagcaaaaattccacattaaatttccatggggaaagcaaaattatcatcatattaggataccattcctttaaaaactgaaaagggccttggagaagaatttgcacagtttttctacagagaagagtaaagtttttaccctatagtacataaaacacatagatttaaaaaatccaaatacaactaattttttttaattaaggtgaaaaagaattgcagaattttaggtaaaaacacataacatttttgccagtgctcaagatatttttgacaaaatattctccctaccttaataccttaatcatcagactagcatgttttcatttatcctctctctttctctctctgtctctcttcatgagtattcctaaagtcccactcagaaaatatttttcctttagttgactctgagtcagctgatgcagacattttattattcattgactaaattccccttcaatgggacatacccttagtagcagtattgtgaagctgaggcgtccatgtttgtgtatggggagcttttcatgcccctgtatccccgtgttaggtgttagtagtattgtctggcgtcacagacttggacacttaaggggaaatgtgttcttctacaaggggacagagaagagccttgggagatccaggaggctgcttccttttcacaccatgtgtaatggtcagtgttcatagaagacagtattaaccctacctgggcagcacttgagatgtcatgattgcttacattggtctcattccatcaagtaaagaaccctcatgagtagaagagccatctacaataaagagggatttgaactaggtagtgaaggatgcaagcggaaaataccatatggagtctgtaggttctacccatatttcctgttttggtatctcacttatttacatttttaaatcaaatgccttatttccttgtcttttgccctaaaatgatagtgtatgttggctgtgatggctaaatgtaccacttactacctctattgttgaatattaacatggatccaaataaagccagagaggagatagatattcccatgatgtccaggactcaaggctgggctttcagttgtctcctttcagggagaagtcagtcaggattttattgtacatggaattgttgcaacgtgttaggtggaggataattatgaaaatgtatatatgaagaagagcctatttttgggtagtggagcagcaaggaatttcatgggagtttttgtttttgaacacatatcaatcattcatcactccccagaatagtatcttcacttctttgcgcggtttgctatgtcttcatcgtgtgcggtcttataagggactttatgataaaatggcctccaagaacatcgtgaaagggtgagcatgtaatccatgttagagaaattggattctcttttcaaggcctttgaatgttacacagggcagaaaaataattggagctcatttatcccaggagctgtacacaaagaagcaatcaagcaatcattatttcctggattctggagacacctttgtccttgttagtttctggccctaattctttctgagctatgaatgatcctattgtttaaatcatttttgtttctttccttaagttagctagcaatggtttctatcactgggactaataaataaatccacattgacattccttatgactaatttcaacatacgatagtttgttaggtgaatatgatttacttaaaatcaattatccgtctggttcaaaacactagattagtcattttcctgtttttttaatcattgagggtgcccagtgcagaatattgatattattgtaaatcttatatttattacaggaattgcattaataactgtaacagtttaaaataaaaatcagaatgcctttagtaataaagattcttccattgaaggactcaagactgtgaaagtcacaataattaaattaacacagtagggttccatttcctatggggaaatagctgcagttataaacaaccattagtattcccagtctccaagtcacaaccagtagaatgaggccaggctgggtattaagtcagaggcagattaatggacattctggtaatatgaagggtaggaatgattaaagggcaaactcattgcgacatgttgtaaatgaggctgtagtgatgtggaccaaaactgatggggccataaccactggttgaaattgaatcagaaaacccctgtgtgggcatagatcaccacaatgccaataattaagaaaagatacagatgatcgattaagtttgtaaatagcatgtgacagctgatttctatgcaaatccatttaatgacagctaagtaaatgaaattgattgataagtatgactgttttaacttgagaggtttaactagatgtcattgtcttttacaaacacttccacaccctccaatattttgaaggttaaaccttttgaaatttctcaccctaaattaaaattagaccaacagaaaacatatgcattggtgagaaaaatacctggaaaatgataattcattgaggtcatcccttctaacctggactacataccttattttgggaaaattaacaattgcccaaggaaaagctactacaatcctcatcttgtcagctcttcctctatgattaatgaccagagaagacatttctaaggattgtctggaacaccctcagaagaaacatgggcttaaatttaagacatacagaatgttaagagtttaaactactctctgagtatataggatacttgagtcatctttaagaaatcattgtccaaggaagatgaaatttcaggctgaaaatgtcaaagtgaaaagcacaatacattgcttattctgataactggatattgactaattggttgtggtacctgtcccacagaagtgatctgtattagtctgttttcacgctgctgataaagacatacccaagactgggcaatttataaaagaaagaggtttaactggactcacacttccccttggctggggaggcgtcacaatcatggtggaaggcaaagggaagcaagtcacatcttacgtggaaggcggcaggcaaaaaaagggcttgtgcagggcagctccgatttttacgaccatcagattttgtgagacccattcactatcaacagaacagcacgaggaaaacccgaccccataattcaatcatctccatcctggtccctcccacaacacgggggaattatgggagctacaagatgggatttgggtggagtcacagagacaaaccatatcatgatctaactgactttttaaaattattgttattttttattataatagtatgcaaccttagaacatatatccccttgtaatcttcagtcttctcttgcacagatgaatgagtttatatggtgctcctgtttaattattcagatacatacagtaaggaacagttaagatcaattatgaaagaaacagtaacaacaaactactacaattaagcaagtgtgtggtttacaaaactaatctagatttatatttgttattttcttacattatacagttgtttagggttaaatccaaaatttcctcagagtattgccccatgaaagctaacatctcttcatctaatatttacttctcaactatgagctatggtttgaatgtctgtcaccttcaaaactcatgttgaaacttggttcccaatgtagcagggttgagagatggggcctttaaaaggtgactggatcatgacagagccctcatggattaatttattcaacggattaatgggttaatgcactaatggcttaatgggttattatgggagggaaactggtggctttataagaaggggaagagagacctgaacgagcgggttggcacattcagccccctcaccacatactgccctgcatcgccttgggattctgcagagtctccaccagcaagagggctctcaccagatgcagcctctcaaccttagacatctcagcctctatgattgcaaaaagtaaattacttttttttaaataaattaccgaattttagctattctgttataagcaacagaaaatgaactaggacacatcgtttccatgacttatagaagttatgaatctgtttgtttgcattttctcaaacagatatcctattcttgattaatatatagcatatccattttttaaagcagtacttgtcaaattttaatgtttatataaatcacctggggatctttttaaaatacgaattataatttagcagctctggagcaggaactgggattctgcattctaccgcccagctgctaggtcatgttcatgctgcttcaggtccttggggtagtcaggcttaagtcagggatcagccaatgtgttctgtaaagcaccagataggaaacatttctggtctagatgatctgtgccatctactcagtgctcccagtttagcccaaaagcagccagagacaatgaaaaaatgaaacactgtagctgtgtttcagttgagttttatttacagacactaagttttgaattttatattattttttctttcaggcagggtctcactctgtttcccaggatggagggcagtggcatgatcatggctgaatgcagcctccacattttgggcttaagtggtcctcctgcctcagcctcccaagtaggggggactacaggcatgtgccaccatacctagttaattaaaaaaattttttttgtagagacagggccttactatgttgcccaggctggtcttgacctcctggcctcaagcagtcctcttgccttggcctcccaaaacactgcgattacaggtatgaaccaccatgccaggccaaaatattatattttaagtttttttcaaacatttaaaaatgcaaaaaacttccttagctcatggactgtatgaaaacaggtggggggccagatttgacctgggaccatagtgcactgatctctgctttaattcatcattctatagtagattgagctatctgcaagaagtggattatacttgaataaaaacaagacattctcctccatccccagatgcaagttgtttatgggagttatctgaaaaagcaaaagaagtaaagagtttcatgtgcttttaagaaaacattatcctgggagattagacactaagaccacatttgttttttcatgtttattttaatttctggaaattatatttagagaagatatcaaccatctgtttaattgttctgtatttaatattacactatggatcaatgggacatataaaatacatttagtatgatttatagagattaattattgtccaattatggtttaattggagctttaggacatgactgcaatttctttttatttaatatttccatatgtccatacagttaccactaggacaaaatttaaatatctatataaaccattacattagagttttgagcctcgggtactgtacttagcttggggaaaactgttatatccaggtaaaatctctcaccctgttcttacagaactctgacaggactgtgttactgttgatgtttgagttttactttaacttcttttggccttgactatgtaacatccttgctttctggggtggtgtagctttggaaaactcagaataagggtggcctaatcctggaagaacagaaactgtatggaaattataattctgaaatccagaacatggcatgccacttcatcaattctaagataccatagattgaaagttgtatccttattttacatgccactaaagaatgagggcatgtaaaatacacacccacacacatacacacacatctaaaacaacaagctatccctttggcaatgtcagtccatcaattttgagtcacatgctaatttcatatctgggtcttagaatcaatgaaatatggtctttaaatcttaggtgcacatttaggctggaattatctaattttgcatttatgtgagatgatgattatgataacactgcttataatactgattacagcatccaaaatatattattttcattgcttcttttccttctagatggactaatgtgattttttttatgataaaatcgagtctcagacatgtggaatatcttattcgatgttgcacagatactacattcgtcagggaattctagctgctaaaataagtgaatccgagcacatgtaatggctccaccatgctggaagttcatttatcattcctgcaaagaccaaaacaggcatccttgatggaaggcagctgttccccaagcagccaatgggaaccctgagctcttacatcctatggatctaccatcttctatgaatagtttccaagttctccgtgcttgtagtctcaagtccgtgcaagtggaaggaatacaaggaagtgcacatgggaggtttttatggtgtcgctcaacacttccgctcacattccttcctctggaagtcagtcatgtgatgcccaacctcaaggaagttggaaaatgagtctagccttggaccaggaagaagagatgaattagtattcaagctagaatcctccaggtttcttgtcctctccttctgaactgaacccctcctaacccttttaatgtctacattccaaattctacctcaaaggtagaagagagccaagatcaatgatttaagtgatcctaacagtttcctgaatttcaagttttgtctatacattagcgccttcttttaatttcagtgctccaagatgggcaattatggatttcatttcctgcaagtttactatagcactcattaaattatgcagagtagtatttcttcctatgctggggatattatctttgtgttaatctcctagcctatggtatcggcaagtggaacttgtaatattttagcaccttggaattttagtgtaatggttctgacagcaacttacatttgcatgggggtaggagattctttctgaagatctgtacacatgttcatgcatttcatccacactgcaggtttaaaaaaatccatgacagtgctagaaataaccaagctataagtagccagtgctagaagaaaattggctcattttaactagagactggtagaatagatgagactgtcaaagacacaagagtgtttttgccttcccttttccctgtggtactttctgaatacattttatgtttcttatcctggtcgtgaataagagcccatcattgccaactggaggagagtctgccaggcacaccagcagaagcagttctctttgctctacttccttattgaaatgtcccagtgataggtttgaagcctcagtcatcaaacagcttgagtttgtgataatctcatttagcctgttgttgtgatttttaaaataacgaatcaattatccagatgtctttgcagggttctgcaaagcagaaatagtgtcacttatgggaccatagggacaacttcagtaatacaaagattagagatcaaaaatgccaatgttgatttttacgtgtaaaaaaccctaaagactccacataaaaaactgttagaactaacaaataaagttgcaggagacaaaatcaacacacaaaaatcagttgcatatctgtacactaacaatgatctatcaaaaaaaggaaattaagaaaacaacctcatttgcaatagcatcaagaagaataaaatacttaggaagaaacttaaccaaagaggtgaaagatttatatactgaaaatataaaacattgctgaaagaaataaaaaagatgaaaatgaataggaagacatcctgtgttcatagattgaaagataacattgttaaaatgtccatactacacaaagagatctacagagtaaatgaaatccctatcaaaatgccaaggcatttttttttgcagaaatataaaaaagcctacaatttacatggagtcagaagggactccaaatagccaaaagattcttgaaaaagaacaaatttggagatcacatgcttcctgatttccaagcttattacaaaactacagtaatcaaaacagtgtggtacaggcataaagacaggcatgtagaccagtgggatggaatactagaaacacacgagaaataaatcctcatgtatatattcaaatgatcttttacaaggatggcagcactactcaatgggaaaaggatagtctcttcaacaaatggtattggggaaactagatatccacatgcaaaagaataaagttgagcttttaccttatgccatgtacaaaagttaattcaaaataggttcaaaacctaaacaatatctacagctataaaagtcctagaggaaaacatagagcaaaagcttcataatattggtcttgacaatgatttcttagacatgataccaaagcccagtcaaaaaaaccacaaattgacaggtgagactacatcaaacttaaaaaacttctgcacactaaaggaaacaattaacagagtgaaaaggcaacctacaggatgggaaaaaaatttgaaaatcatgtatctgaaacagggttaatatctagactataaagaaattctacaaccccaaaacagtaacaaaataaaacaaaaaaactgattaataaatgggcaaaagacttgaatagatatttctccaaaacaaacctatattaatggccaacgagcatatgaaaagctgctcaacatcactaatcactagggaaatgcaaatcaaaactacaatgatatatcaactcacatccattaggatgtctggtattaaataacaagaaaataacaagtgttggtgaggatgtggagaaattggaacccttgtgtactgttggtgaaaatggaaaagggtgcagtccttgtggaaaacaaaatggagattcctcaaaaaattaaaaatagaactgctatatgatccagcaatcccacttctaggtaacaggtaaaagaattgaaaccagaatatagaaaagatatatgcacactcatgtttattgcagcattattcacaatagccaagaagtggaagaaccattgatagatgaatggataatgtggtggacacatacaatggaatgttattcagtctttaaaaaaagaaatcatgtcacatgctacgatatgaatgaaccttgagaaaacaatgctaagtgaaagaagccagtcatgaaaacacaaatactgtatgcttccacttatatgaggtatctaaagtgatcaaactcatagaaacagaaagtagaatggtggttgccaggggctggtgggagggaaaatggggaatttttgttaatgcctacagagttttagttttgcaagatgaaaaagttctggagatcttttgctcaacaatatgcatatagttaacattactgaacagtgcacttaaaaaaaagatagtaaatttcattttgtgtgtgtgttttattaccacaattaagaataaagggttcaaggattgaggctagaggcttgctcatgatacttggcaaattgagtctaggtttctgggtccagtaatcgggtttgtaaaaaaagaaaacaaccaataaaaacaccttttactaaaaggttctcaagccataaacttgtctaaacagctgggtgaatttcaacaaaggatcagggttacagcgatattgacagactctctagaacccataaaggcttggaaattagttactagcatcagcgttagtaattagtccactcttttctgtaggcccagaactttaaaataaagacatttgccacttaggtcctatgtctaaaggccaattaagggcatcgtgtgcaaaatgatttaaaaatatgacatttagagtaagagagatctgactttacatatatatgccaccatttctttcatcgttcatagcaaacaatacaaaatgctacataatgagactgaggctgtgacacttcatatattcagaaacaattatgagtcatacccacaaggatctcacatatgtctttggaaaacactttcattatttaattcctgttagagccaactaactcttctgggtatctaattgaaatctgtagggccaagtgagagtcaattctttctggagaactggcttgctagtttctatcttacaatgtgtgattctggggattatagcactcacctgttttttaaaatcttccaacaatgcaaatggttgcaattttattggaagtattaaaaaacctcacctattgaaaattttacttttgactatatttttataattgaacacacacacgtatacactgtttttggagaaacagtttttttatacttactgtgtattacttgaaagtaaaaacataaattgttattccaactgtagggggggattttattatttgcctttgtttggcttccctatatgtatacatggaaaccggtgttcaaatgcaagtgacttattagagacataaaactaggtgaatgagaacatgagccaggaagtagaatgcaagcattaaagcaatatagtctatagaacaatactgagagctaaatccataaataattttaaaatttctaatagctacacttcttaaaatgtaggaaaaatcaggggcaatattcattttaataatatattttacttaacccaatatatccaaaacattatttcagcatgcaatcaatatactattattaaaaagatattttctatactttttctatataaagtcttcagattgtggcatgcattctgtacttaaagcacatcttagttcaggcagtctgcatttcagatgctcaattgggttgtggttagtggctaccatattgagctgcgcagtaataaatgagatgttataaggcagctatctctgtgtttgactggtgcttaatcctgctgagaaaatgctggtaactaaagtcagaaatatcctatgagagagcaagtgagttgtggtatgtattcagcaagtcctgtcacttgagggttgagagctcctcccaggggcgttaactccctcatcacttctcacctgccaatgggacagaagaaagtggagttcagtggcccgagaaatcccactgagaagtgactggggtgccctccaatagcaaaggtgagaggatattggtgggcagtgggcagcatgtgctacattattcaacactatttatacaaaggtcaaaacaagatctcactcccagaccagtcttctcttagacaattaaagcaagatacttggaaatctatctttaaatgtttctttcaggttcaaagattccacacttgctttcagaaaatactttcattacctaattactgttagagtcaaatagctcttctgggtatctaattgaagtcggtaggacaattttaaagcctttactcttgttcttttaggagaactggcttgctattttctcttaaaattcatgattctgaggactataccactgcttttaaaggctaccaacaatgcaaacttgttacagttttagtgaaagctcaaaaaaatagcctgatggaaagcttttacttttgtttgtttttttttttcataatagattgataagtccagctcacaaattactttggtatattttagtcttctattggatatgttcaagtatcacaattcctttaaacatacgtaggataacaaaatgaattgttaaacaataagactgaggctgtgatacttcacatattttaaagcaactactgagtcccacccataaatcttggttaatctatcttcatggcacctcaatttcatttcttaatatgcaggacatcgtttgtggaattttctagtttttccttactgatctccagttgagagatcaaaaccatcaaaagaacatgacgtacagagtaacgagattgaggactgcatcctgctatgtttgcttggttgagaaatgtactcaatgtcatagtttccagacatgcacaataaaatagcaaaaacttagcatgcatggatgtgagtgtaaacaaaaatttggtatttgaaggtacatacggcccatctaagagaccttcagggccagactttgaggccaaatctgcagagcgtcatctgattatctcaaggtggactctggtcttttcatagatggtgtgtgattgccatgaaaataaagataaacaaataaacaaacaaacaaaaaaaacaaggatcttagcccaaggctaaggctaaaactagggctagggctagggctggggtttggtttagggtagggtagggttaaggttagagctagggtgagtttatgttaggattgggttaggggatcttagccaattttctctagaaacaaaccttaggcaaagtgctggctggtgctttgctggaagcagcaatcccaaagccatggagagaggacctaaaaggcacagaggcagcgaaagatgggaaggaaacggaatgatgtgcactgcccgtgttttagtctgaaccacaagagatggagctggaggttgaaggcataggatgtctcattgtcaacaatatggtgcatccatgctttctgtgctttggagcaggatgagagaggacttcatctactcattcactcttgtctcctctctcctcttagcctctgttgtcccatagagagttgacattcctggacatctatgtggcttcacccgggccccttcagcacctactgaggcctgaaacttcaaccaagtttggaagtgatgggagatgctggagacttgggcgtgtgtcttgttagcttgagatggtggaggcatgcatgtctaccaaacatgtgggacattaggaaggtaagaaggtgtatgagagtccatacaatgacctatgccgcaagtaaattgatttttgtcctgcaattgtgccttgcagcttatttgctgtaggtcagaaattaagggtcttttggcatggcttcaaagtgtcatgtggtccagctctgttttaggtattttctgtatcaatacatggctatttgatgtgaaaaagtggttaacacttgaggttatgtgcaggtgaagcaagcccaatacatgaagtactgcgaagagccagcggcttttctttttagtactgtataaagaaaatatacacaaaattaaagaaatcctttagaaaacaaggtaaaatcatcatcacatacaatcctaccataaggtaaacgtttaattttagcacattatgttttactcattcagatattgtagggaaataaaattcatacacctaaagtattaaacataattttttaaatgttctaaaagagttctcaacttgcttgcaaatcttcctaataaagggaattataggggcataaaccttccagacaaggcttttgtgctgatgaaaacagtttttcaggttaattcactcttccctggtaaacactcagtctgtcaaaatatatcacccttttctctctttgactaaataggatgatatctaagattaaagggaagcttaaaattatctgacattatgaatattttattaaataatactcaatgtcagttgtcttgatcccatttttaaccataatcaataattctttcataaacatcttcatttactagttatttgttaaggcattaaattgattccttctcttgaatcaactttcttgtggaaattatctaagatattggtttgcttgttaaattatattttcctggtaaaagttacaatttttattttgttttactttctgttttctgtgcccccccccgcccccaccatttttaaattttaatttaatttaattttaagttccagggtacatgtgcaggatgtgcaggtttgttacataggtaaacatgtgccatggtggtttgctgtacctatcaacccatcacctaggtattaagcgctgcaggcattagctatttttcctaatgctctctccctgcctcgccatccccagacaggccccagtgtgtgtcgttcccctccctgtgtccacatgttctcattgttcagctcccacttataagtgagaacatgcagtgttcggctttctgtttctgccttagtttgctgaggataatggcttccaacttcatccatgtccctgcgccaccattttgatttttttaaaaaatatttactcaactatctagaataatgtcatctagcatattttttttctgctgtaaatggaatttgatttaaaaagtttcagttaccaagacactaaaagtgtctttgcctttgaatttctcctggatggcctcctaaacagtaggcagggattcacactccatttatgtgtgcaaaaaatgaagcagggttatatcatagggccaattgtatccatttatttagctcagatttccttaccattaagataggtatttgggacacttcacaatatacttcaaggcctccagggaaatctaaacaagagaccataaatgctcctaaacatgtctaacatatctacactgtcctgcggtgatgctaatgtatataccctttcaaagtgcacattccaggcagctcagagcagattatggggctctttgcagaataagcacagcccctggctatatgcctgaataataaccctaacttccatcacactttacagtttacaaagtgcttttaccatgcatatgggtgagcatatggttcagtttttctctaacaatcctgctttcaaatatattgcctaccgtcagatttggcaacagagtgcgtgagcctgttttggggcaagagaatgtatcccatcatcacatcctcacacagacaatatgaggacgtgtctgagatgaggggtctcttcactgaatcctcagaggaaccctatgagtaagcatctttgatgagaattctaagttccatggaagtaaaataattagtccaagttaagcttgcttataaatgcccatgctgggagtttaacttggatctctgccccccagtttgggcatttttacattattaatctatactagtgactatggcatatagctaaaataattattagcccaattagaaatgttgtaattaaattttatcttcaaaccagaacacctctgatgataggctaagtggaaagatggattctgaaaacagaatgttctttgaagtcatgatagtgagggatactatctagtattaggttgtcaatcaggatcaatcttaattcccaatatcctattaggattgagtctggacctgctgtcagttttgcttccagacccctggataattgaacagaacttttaaaaaatattattattatgttttttagagacagggtcttactctgtcacccaggctggagtgcagtgtcatgatcactgcagccccgatctcctaggtttaagcattcctcctgcctcaacctcctgagtagttggaaccacaggtgggtgctaccatgcccagttaattttttaaaagattttgtagagacagaggctcgctatgttgcccaagctggtcttgaactcctgacctcaagcagtcctcctgcctcagcctcccagagtgttgagattacaggcgtgagccactgcacctggcctcaacagacctttcactttaatctaaagagatgtaagagtgagctgaaaacacccccttggatgcaccgtgtgatgcttcaccctggtgcatggataccagatggtgctaacagttctgaagtgtagaattgaagtgttgaggtcaagtgtagtaatcatctgagcaagacagtgctttgagactattttccagtataaagaaacggtaatttttcagtatgcaatattatgataatgctgtgatactactggaatcatcttagcagcataatatgccataatcagatatccagctaaggatgatgcaaagtctagaagtaatgttctaaaaggggccaaacattcttcaaaatgcctgtaatcctgagccacgaggctatactcctccatgtgctgccaagtagggaaataatctcttgcctggtgttcttgagatctgcaagttctcccatacacagggatagccaagatgggttagcatctccattatttaatctgcaaagtatttccaattaaatgcagtactcttatttgatagtcaaggcactgccaatactgttttaaaagggtaatcatcacaaacttggcttacctcgtaattcacttcacggaccacccaaatcaaatattagacacaggaaataacacttccaggtctctcccttaatttaattctgaacaccaagtgacctcccattttgcacaaattgcagttattggagattaaataactgcactaaagaatcaatatcctggtgttgtaatagtatgtatctatctagtgagatgataaggagttaggtgtccatgtctgaaggcaggaatgttaagaaaatggtatttaaaggactttcctagaccctcggtctatgattaagatagaggaggaaataggaggtcataggaagcaggaactggggagtctgccaggcctggtgtggaatttctttctcaattttgctctgggctagggagtgcttacaagtgggatggctgatttgtgagtattttgcaccttccaaattattggtcatgacaaattaatgttgtcccagtgattgacacacccaccagagagtgtgggagtcccatatccttgagcctatgtatctcattggcattataatgatagtcggacatcgcagggctgttgctgacagatggaaagagaaaaatgtacagtatatgaaaccactttgcaaaatgcctaattgatagttgccgttcaacagtgttggtttccttccttgttcttttacgtgctttcacagcatgctgcacactcctttgctaaaccacttatttaatctattgatatttcattatttacaaacaaaattatgagtttctggataccaaaggctcttttattattcgttagacacctagaacttagtacatagcatttaatgtctgtcctttgaaataaaattaaaaattaatggtccaagtttatatgagtacttttcaatatcttagaacattaaccccataaaatttatctggtgataatactccttcataagagaaaaaaataaatacattaatttttaaaaataactttatcggccgggcacggtggctcacgcctgtaatcccagcactttgggaggctgaggcgggcggatcatgaggtcaggagatagagaccatcctggctaacacggtgaaaccccgtctctactagaaatacaaaaaattagccgggcgtggtggcgggcgcctgtagtcccagctactcgggaggctgtggcaggagaatggcgtgaacccaggaggcggagcttgcagtgagccgagatcgcgccaccgcactccagcctgggcgacagagcgagactccgtcaaataaataaataaaataaaaataaataaataacgttgttatgaactagtccatctaaggtacatgaggtacaaccagtagcaaacatactcatctacacatcccagcttcagcaataaaatatttaaatattattgaaataaaaggatgctctcttaaataaacaaataaatataattgaagacagtggtgtccatttccaaatttctccttcttcctcccactatctttatcattgtgcatattgctgtcttgcttttccttatagttttgatgtatatgtgtgtaatctaaacaatatgtttagttatgcatagactctgtagtttagattaatagtgttgtatcacattgatctctaacttttttcattcaatacctttgtgtaatccatccatatcaatattaaccatagtggttccttaatttgcactgattgtatatatatgtatatatttatgtaattccttatatataattatgtatattatcagtgaaaatgaaactactttgtgaaactatatatgcactcacacatatacacacacacatatatatacacacacagtgatatatatttacatggatatactatcttatgaataagcaccatcatttatatatactcttttttaagtggttatttgggtagctttcagcttttttactttttttcaatggtgtgctactataaagaatgggtctgtaaaattcttgtgcatgtccgctctatgcatatacttaagagtttctctaagaggttttaaacgggtgcttaggaagggaattactggatcacagaacataagcaacataaggttccagattatactacatttgtttccaaggtggttgtaccaacttacgctcccaccagaagcatttgagagttttcattcctctgcatcttgcatagcactagctattgttacattctaatattttctaatctggtagatgtgaagtgataaactttttaccttgtgtttttcattagcatttctctgatgactagtaatgttgaacatctttttacaggtccatttctggccacttctgcattctccctcctggcaagaatgttttcatttttacccatgttcttgaagggccccttctgtcccttagctctgcagtctctgccatttgttaagtctatgtgtgggtcagtccttgaggactccgttaggttcattaggacatttgtctactcttctgccaatcacacccagccttaactactgtagcttgagctagtccataaccacactggtccaggagtattttggttaatcttgggtctttatatttccatatccattttaaaatatcccatccagttctatgaaaaactccattttcctccctcattaatccttcctgtacttcagatatttcttttaagattattttctttttctcctaaatatttcctttagatttgagggggcttctttttatgataaattttcaccgttttgtgatctaaaaaatgtacttatttctaccttgtccttgaaagaatgttcatctgtgagtataattatgggatgtagttcttttctcttggcaacatgaaggttttttcctaccctcctctggcttttgggaagtcagttcccagtctccatgtgacaccccggtgggtaatcaatgtgtgggtgtgtgtatatgtgtatatatgtgtgagtgtgtatatatgtgtatatgtgcctgtctgcttttaagatctcttctttgacattggtattattactattcagcattttcgttattaagtatggatggatttattttcgtttatcctacttaagatttgctgtagtcgctgaatgtgatgtatcatgcgttccacaaattgcggaaaatgcctctgccaaggttgaccacctctctttccgtcatttcatccaaaaactccaattagataggtattagacctgttcactcaatcttccacatctcttaacctgatttcatttccttgcatttcttctcataatatcttcagatctgtattccagttcgctaattttccttttccttctgtctcctccgctcattaaatgcagccattaagagatgctattatgtagtggttgagaggtcgggttatggagacagactgctcgtctttgtattctagttctaagacatattagccatgtggctttagggcaattaatacctacctcataaaactgttaagaattaaatgaagtaatgtgtgaaaattcttgtaactgtgtctggcatagtagttagctataaattattttaactttagttttcagtttcaaatatatataaagttctaaatgttccttcaacccctttaacctttttctttttgataattttttcatgattttaattatttcctttttgtgtgatttctgactgggatctcatatttgtgggaactttacatagggtaaatccttgtggcctgagttatcaattcactccttcacagaagatttatgtttaaatttgtcaaagccctgaagatactaaaaatgtaaaacttgaaactataaaaaccctggaaaacaacctaggcaataccatcctggccataggcaccggcaaagatttcatggcaaagacaccataatcacaacaaaagcaataattgacaaacaggatctaattaaacttaagagcttctgcacagcaaaacaaaaacaaaaacttatcaacagagtaaatagcctacagactgagagaaaaattttgcaaactatacatctgacaaggtctaatatccagcatctataaggaacttaaacaaatttacaaaagaaaaacaatcccgttaaaaatcggcaaaagacatgaacagacacttcaaaagaagacatacatgcggccaataagcatatgaaaaaacagctcaatcatcactgctcattagagaaatgcaaatgaaaaccacaatgagataccatctcacaccagtcagaatggctattattaaaacgtcaaaaaataacagatgctggcgaggttgcagaggagaggaaatgcttgtacactgttggtgggagtataaatttgttcacccattgtggaaagcagtatgtcaattcctcaaagagctaaaaacagaatgatcatttgacccagcaatctggtatatacccagaggaatataaattatgctaccataaagacacatgcgcatgaatgttcactgcagcactattcacaataacaaagacatggaatcaacctgaatgcccatcaaagatagataggataaagaaaatgtggtacatgtacaccacagaatactatgcagccataaaaacaggacatcatgtcttttgcaggaacatggatggagctggaggctattatccttagagaactaatacagaaatagagaaccaaataccacatgtgctaacttataagtgggagccaagtgatgagaactcatgaacagaaagaagagaacaatagacactgggggtctacttgctggtggagggtgggaggaggaagaggaggagaaaaaataactattgggtactgggcttaatacctgggtgatgaaataatcatctgtacaacaaatgcctgtggcatgaatttacctatatagcaaactttcacatgtacccctgaacctgaaatataagttaaaaaagaaataaataaaaagttaaaagttaacaaataaaaccacattaaatcaaatatttcaggtcttggggtttttttaattgaattcaggctagaaacctatctgaacatttaggacttcaccttccctgatgcgtaagagccaatctcaaaaaggaaacacttcgctgttctgtgtttcagatttgttgttgttattttggtttgtagttcactttctcattgagatggtagcacttcaagaattttggggctgggtgtagtagctcacacctgtagtcctaacactttgagaggccaaggtgggagaatcatttgaggccagaagttccagacctgcctgggcaacaaagtgagacaaccaccccatctctacaaaataattttaaaaattagaaaagaagagtttggactttatccttatcttgtaagagcctataacacgcttttgattttgtgtgcaggcaggcattaaaattgaagctcctatttcctgggatgtgtagatgacccaagggcagttatgggccttagcactggtttacttctcttgattcattatttcattttacttctcagaatttgtattactgtttttgcaaactcaagtatgcattcaaagagatgttttaaaatgatttatctggcatttctgtatgctttataataagggagcatttaaaaatttctagtctgctgctttgctaaaagcaaaatatcataatgagtagatacccattcaaatatttgttgagtttttattgcatgttctcttcctcctccagcaattttctttcctgggacattttttttcctagttgtttttcctcattttcctcattgtggccactgatccctttagctggtttgctactttttctctatagactcattggcccctcctagagtatccttcatggtggattcaggtaatggcaggataatcagaattattgtaggcaactttcattaactgtatcacttctccacatgtggcagtctgctgcctatgaactggattagaacatgcttttcattatgtaatgcacatgcatatcacctagagatctccttaaaatgcagattctgcatttatactttgtagttaattattccaatatctaaagtatctgactttgctgttttctctttcttcccactctctcttgttctccttgctttgttctgtgctctgtgatttctgactgtgacctccggttcatgggaactttatgcaggctaaatctttgtggccagagttacggcttactcctccccagaagatctgtgtttacattcagtgggtttggagtggaccctgagattctaacaagcccccagttgatgctgatggactaggaatcacactttgcattgcaaggggtgttaaaacataagtatcaatcccaggaaaaggatcttcagtgaacggtggcattcctagctaaggaaatgggtgtcagaacctatctccacctccaactagaataagtagcatgatgtggtgaaaagtataaagatttggaagtcagacaaacatggactgagtatgtattacaactatttataaacatacatgctgcttctactccctggcaaaggagtgaactccactttttatcctttccaagttatgcatagccacgtgacttgttttggccacatagtgttgagctgatgtttctctttcttcagatggaatcattttcttgccagacagtacttatgacttaaagtggtcaccagaactgcagcatcaacatcacctgggagtgttagaaattcagatctcaggccaggcacggtggttcatgcctgtaatcccagcactttgggaggctgaggcgggcagatcacctgaggtcaggagatcgagaccagcctagccaacatggtgaaacactgtctctactaaaaatgcaaaaattagctgggcgtggtggcaggtgcctgtaatcccagttacttgggaggctgaagagagagaatcatttgaatccaggaggcggaggttgctgcagtgagccgagatcgcaccactgcactccagcctgggcaacagagtgagactctatcaaaaaaaagaagaaagaaagaaagaaagagagagagagagagggagggagggagggagggaggaaggaaggaaggaaattcagacctcagactccaaactcttgtatcagaagcttcatttgaaccagatcacaggtgacttacatgcatgataagtttaggaaggtctgctctagttcactcttcagttaccatggggaacttttataaaatagggatatatatttagggagtgcaaacgcagttttgttacatggatatattgcatagtggtgaaatagtgaacattgtatccaataggtaatttctcatccctcacccgccctcccaaccttctgagtcctcactgtctgtcatttcacaatctatatccatgtgttcacattgtttagttcccacttgtaagtgagaacacgcaatatttgactttctgttcctgagttagttcacttaagataatggcctccagctctatcagtgttgctgccacagatattatttcattctttcttatggctgaatagtattccattgtgtgtgtgtgtgtgtgtgtgtgtgtgtgtgtgtgtgtgtgtgtgtatcacattgtctttatcataccattcactggtggacacttaggttgattccatatctttgctattgtgatagcaaagataaatatatgaatataggtatcttttatgtataataatttgttttcctttgggtggttacccagaagtgggattattggatcaaatggtagttagttctttgagaattcttcatactacttgggaggctgaggcatgagaatcgcttgaacccgaaagttggaggttgcagtgagccaagatcgtgccactgcactccagcctgggcgacaaagtaagaattcattttaaaaaaaaaatcttgatactgttttccatagaggttgtactaatttacattcccaccaacagtgtataaaagattgcctttccttgcatactcagcaatatcgtcgtttcttgactttttatcagtagccaatctgactggtgtaagatgttatctcactgtggttttattttgcatttctctgatgattagtaatattgagcattttttcatgtttgttggctgcttgtatgccttcttttgagacatgtctgttcatgttctttgacaatacaatgttggtgggaatgtaaatattgagttgttgtaaagatgagtacatttccacaagctacatagacatataataggtagacatataagattcaacagatggcaattattgttggataaatggtcagcaccccgtgggttagtgataaaagaaaaactcacaaccatgtgtcagcaaaccacaacccatgtgccaaatctggcccactacttgtttatgtaaataaaggaaacagccacattcatttatctgtgtaccactcacacctgctttttcactacaacagcagggttggatagttgctgcagaagtcatatggcccactcagccaaaaatatttactttctgtgtcttttcagaaatgttagatgatctctgttctatagccgtgtcctagactaacatgaaaagacaaaggggatatctgtgatttagttgccacatgaatgtatggacacccttacgattgaagggaggtgaaacgtggtgtttgtcaaaggaaagatcagatgcagaactaagaggctaggacaccagtttcacaatgcccaggtctcatgttgggtcaaacttgatatggtgcttatacaaaatgaggatcggtacacagtatacttatatagttgcccagaaatgtgatacatggatttataataggagagaaaaaatccttctttagttatgtgctccttcccgtagaagtaaaaatcaagaaattgccatcaaccttatccttccagatggcaggcttctttataactgttctcttaacaaacatgattccattgttttcatactgtaaaagacacgggctctttaaaagaggcaccagcaggctgtaacagtaaaaagaacgaaaaagatatcttgaaagaactgcaagtaaaatatggcacaatttaaatggtgtagaagcaaagagcaataatcagaaacgagaaaattcatggtaagggacctgccttcgggctcatctctcccacaggcggctggacacctgctaggtcagcggagtcctccctgtgctcacagcttgtggccaaggaaagaatggcaagaatgccaaacctaacggtggataagatacagacatatgcagaaaaaaactggcagaaggggctaagttcttccctgcttcgtggactcaaatctgtctacaaggggaagcccagtgattagccaatttgtacgaacaatgcaagccaatttagatgtaatgttttctttctctctttcttttcttccttccttttcccatgctgttttctttctttctttctttctttctttctttctttctttctttctttctttctttctttcttttctttctttcttttctttctttcttttctttttttctcccttccttctttccttccttccttcttcctttcttctttctttctttcatctttcctccttcctttaattctttccttccttttcttctttacttctttccctccctccttccttccttcctcccttccttcgttcatccttccttcctttattccttacttctttcattcttttttctttcctccttccttttttctttgtccttaccttccttttttcgttctctgtttccttctttaccatcaaacacccatctctcgtttttagtgaaacattattgcaattttcttttggagaagcacacctcctatattgtgtgcagtactggtgaggatgtgactacaaatgccctttccacctcttgtcaaggaaggagcaatgaatgaccaatgctaggttagttggacgctgaactagagcactgcctcctgttatggctaagggcaggtggctggttctcactcactccagcagcggtatggatgtagcagagaaattattttttcccactgcatagattccctggagcctctgggtgccttttcaattcagtcctgaatttttaggtcttccttgaatttcatacactatgcccatttcttttgaatcatttcttttttctcttaggtcagttctgagtggttttattgcatgcaaccagtgatccctaactgatacacttaggcaccaaagtgctctgttttgctcttgatccaacaattctgtggtctctaaaatcagcgtttatagatagatggtggctgttacgctctgaattgtgccctctaaaattcatatattgaagccctaaatgccagtatatcagaatgtggctgtgtttggagttaggctctttagaggggtgactaaggtaaaatgaggcctttaggctgggccctgatctaataggactagtttctttataagaagagattaggacacagacacacccagagggacgatcatgtgaaaacagagagaagacggcatctacaagccaaggagagaggcttcaggagaagtgaactctatgaacaccttgcccttggatttttagcctctagaatggtaagaaaataaatgtgtatttttttaagctagtcagacagtggtactttgttatggcagccctagaaaacaaatacagtagccattctctttatctggtacagaagcagctttcttaatatattaagataggaattaccttgtgagaaatgctcaaaaggtaatgttactttactgcttaatgaatagtcctaactttactattgttgatgagcctatatattataatacactggaataagattgaatatatggataccatattagtgcagatgcagaaagtttcaaggctattgagaactctatgctgaaatgaaaataattcccaatgaggctgatatgttcacctttaactacttgttccttttccttaagaattttgtaatttttaaaatgcaaatgctctgggaaatggtgcatcttatcctgactacactagaaagcagaacctgaggagaggattatgtttagatgctttatgtgggaggtgcatcccagagcagaaaggctgagggaaaaaggaagtgacactaaggagaatgcaagacgatgtaatatttagtgcactggcgtctgctacacaacaaatcatataagaagatatatagcagatcaacaggtgcattcactcagccaggttagtagtctgcagacaggcagaacaaagaatccattggaagattacactgtagtgaggaaaggtgaaggaatttattggttgagttcccttctgccttctgtcttccactggtgacaacttacctcatggcacagacctctctttgtcatccagccccgttgacaactttagaagccaggaggaaccaaggactcgaggagatgaaatctcatggtcccatttccacgtgcaattgttcagcctctgcagtgattgaagtagaaggagttgatggttcaggagacagtgatgtcacaagaccctgaaaaggcacacaagatctgagagttacgtagcagtatttaaactagttatttatatttcaattgtgaatgtgattgattaaaagattttgtagtaaagcctaggagtcaggcttagaaaggttgcccatcacttttgaccatattctgtcacccagaaccttggcacacattacacagcctcggtggcttggtgcctggttggaaaaccaacagagtttggagaacacatagctgccttcctgcaacaccaaaatcacactgttattcttcttacctctgcactgtactgcacataatttgaattgtgcagaaaagagttcacagttgtgggatatattataaggtgtccaatacacaggtaatattctttcatatttatatgaaatgtgtccagtttatgccatcttatctaaaagagcttcaatggcattagaaagcatttaaaggagactactaaagatgatcaaagggatacattacaggcaggtagattaaagaactggagttgattagcccagattaaacaatgactgagcaagaagcaagagagcttttcaggtcaggatcacttgagcacctacattttaccttcctcttttcccttatttttcaattccaacaaaaaaagagcaaagaatgaacaactaaagatcgatttatttctggaaatacagcactagtgcttctcacatgcaaaatatagaaaagaaagagggaaagggacatttaaactacagttcacacttaaaaaagaaactcaccctagacataccccttatgaagcctagtccaagatatgaagtctggaatccagaggagactgagggtagacaatgcgggcggagaagaaaaaatgctcgtgtggcatcctctgtgaagtgggcaagggacaagcatcttcagagtgtgaccctagccctgaggtgcatgcacacctggtgtgtatgtcaggaggctgccaaagtcctggaaatggggcactgttgtgcaggctcctcagaaggtgtggtgttcattactgagggcactctattttccatccaactaccagcagccacaccaaacaaacaaataaacaaacatttcttcaccaaagaggctacagctgccctaaagtggatagcctccttctctgtactccccagggcccatggcattatttatagggagaagtgaagttgcaggaaacctaacgtttcttttgtttgcttgtatacatttcctatgtttctcaacccaggagccaaataagttttgcatccatgcatttcaacttccaaaacattcaaagacaaggcaaaacaaaacattaaactatgaaaggacatgaccgtgcagatgcatttaaagatccatcagaagtatcctcaagggtattgtcaataggatttgagagattatgaaacaagagtagtcatggaaaaagagcaaccacacatcacgaacatgtgagattaaatggaatggtttctgaatatttaaaattgcaattacagcagaaaagtgtggattggagactgagaaatgtgagttggaaaatgaaatgtagactaccctacaattcagttttttgaaaaataaagggaataaatggatgaacaaaaagacatgttgtagagggaagactggaaacacaacacgattataagagagcaaaggaaagtcaccagaagcagtaataaaccagagtcctctgagaaagggatttcagattttatggtcaaccaggcaaaattaaaagtatccatgtatcctggtgatttttttaaaaatcaacattaaagaaaagaaatcctataatttctctagcagaataaaagtatcacatgaagattgtacaaagtgggaagaataatcaggctgctcctttttaatagtaaattccacagcataatatagcaatcaatagaattatgagaacagatggttgtgacatagattcaatactcatttaagatactcatttataagagtgataaaaacattcttacaaaggaaggtagttataaagtttaacagccacatttttgtcctgaaggctacttaaataatctctgcaacttctggtggatccaaccactgcaacttcatggtagatccaaccactcattttttcaatcttaaacttcagtaataagatggggataaagaagatattgatccatagagattaagacacaaagacaagtcaatagctgatgaagggtgaatattaatatttttggaagctagaaagcatgtgggcatattgtaactcacatgaatggactgaagctgaaactcatcctaaagcagcatttgataacctccaaaggctcaaaatttagacataaagataactctctaagtaagcgtgcttagttggactaatggtaaggttgatcaaatgtctgtctataaagtaggtagatatctgaatcacctgatccgctctgtgattctggtgtaaatctaggaagtttgccctctggacactcagaaccaaaaatagtctggaatcaagatggtaatacaatgggacttaactgaaaatctacattttaaaaatagtgagtgcaattgtacatatatttgatcagttggagttgtctcagggctcattgatgttcttttctttattagatcccgtttttgtccatgtgtttcattttgcatagttcctattgctatattatcaaactcactgaacttttcttctgttatgtttctaattggctattagttctatctagtgtattttcatctcagacactacaatttccatctctgtaaattttatggggttgcttttatatcttctaagtctctgctttttgagcatatgaaatacatgtataataactatgtttaatgtctttttctgtgaattctaacttgtatgtcagtaagtttctatgggttagtttccattgattattctatcgttttattcttctttctggaaagtttcttctgatctatcttgtacgtgaatatgaacaaatgataaaactgacttaaagctattattgccatcattattattaatgcaaccttattttagtcatcaatattgaaataaggatttccatgatgtaagtaatagtacaagaaaatgtttgctgccataacatatatttaatttgttagaaaacatccatttctaccccaccttacatatagcaccctggaaggcatgtaacagctgaaaaataacttacgatttaattctcggcatgattatttctttgagagggatctgtttacttggatataacacagtgatcccttccattaattccctctggtctgcgtaagcattcttgtcttttaacatcttcaaagttttatttgattcacagaacaacattgctaaccttaaataatttcagcccaggacacagatctttaaaaataaatttaattttatcttgcaataaagaatatttgaacattgtaatcgaagagtattagaatttataaagccagatggtatatgtttaaattacccaaaaagtatcataagtattacatatcttttatatactttaagaggaaaagctcattcagattttttttttgcaatgaccaattccatttattttgataaactctacgaatggattctactttgaatcaatgtttgtacatatgaaaagacatcctacaggtattttatccattctcacctctcagcttacatcctgcaatgttttctttttctgagctccttcagtgacagtgtgtgtgggtttgtgtgtgtgagagacaatgctgagggcatgtcttttcatgccccagaaatacccacccattcttttatccaccgtcctgagggggacaccagtttctgctgacctcttgcggcttgcttgttccggaagctgtttattatgtttccaatctcctgccaccctttttcgttcaatctccacttcctggatcattttctccccacctcatacttcattttttctagtcctcctcttgtagcactgacaattttgatttataacgtatcttgcacgcccttctcttttccttgaactggtaatgtattttctttttcacccctattgcccatgtctctgcgtctagcttatttatttctcagtgccgaacacagccatcaaatcccttgtaatttaggctcggaggcttttcactcccaatctttaccatgactccattttttgtatttcatattttgttcttaaaactaaacgattccccagcatgcctgagcaccagccctggacaccccctccccacaacctcactcaaatttgcttctccagggttctgttacatcagtgcattcatttgggggattttcctgagtcccatttccaaccctaattaagtctgccttgctgctttcttctgttcagtctcatctccatagactgattttcagttccaagtgctccagatggagccatacacctgcactttggtggtggaaatgtaaaaatgtggcgtttgtggctctgagaatctggatgtcaaaatccaaaacgtgttttattgtaaaatgaaacagtcctctctctgccccaacccattccttgcttgtaaattctttaaagatttggacttgagattctcttttctttcctttcctacttctctgaagtgatgatgtaaataggcctcgttacacacgggagagtaacctgttatttctcctagataggttcccaggatttgctcccattttactctaattttctcccagttcatgccagctccttggttcccatcctgttctcatatctggatacactcccactactgtgtagaccagctccctgcaaacgtcatcaaactcaaatgttaaatatgaaggtgaatgaaacactgcttctcaaaactcttctagtacccactaaaatcattttgaaaaacaatgtccttctttgcttattttaaagttggcatctaaaatttttcatgtgctgaatgctggcaaaagacgtaattgcctgcatactctctctctctctctatatatataattattaattgtataatattttattatttatattttattttattaattatataatataattatttaatatatacttattgtatgttaaaatattaatataatatattaatattttaaatatatttaaatgaaaatattggacctgcagattcagatcattctatttacgaaatcctgactaattgaactcatacatatcccttaggacatttgctcttaaggtttagtgcctattcctagctacatgagtctagaaatagttgctgaattattattattattaattttgtaagtgtagccggcaatgcattattttgaaaaattattgttcaaagtccacagttgacattaacgttcactcttagtggtgtacattctatgggttttgactaatgtataatgacatgtagccatcattatagtgtcagacagagtagtttgactgccctaaacatcctctgtgctccacctattcatccactcttctctttccccaaactcctagcaagcactgatctttttattgtccccatagttttgccttttccagaatgtggtctagctggaatcatagtctgtagcctattcagactggcttctttcacttagtaatatgtgcttaatgttcctccatgtcttttcatggcttgacaactcatttattttgagcactgaatgatattccattgtattcattcacctactggatgatatcttcattgttccttaagttttggtgattatgaataaagcggtagtaaacatctgtgttcaggtttttttgtttttttttttcaattgcaagatttaatagagtgaaaacagagctcccatacaaagggagggaacccaaagagggttgccgttgccagcttgaatgcctgggtttatatcccgatcattggccctcccgctgtgctctcaggcgatagatgattggctatttctttacctcctgtttttgcctaattagcattttagtgagctctctttactacctgactggtcgggtgtgagctaagttacaagccccatgtttaaatatgaatgcagtcaccttcccagctagacttagggattcttagtcggcctaggaaatccagctagtcctgtctctcagatccccctctcaacaggaaaacccaagtgctgttggggaggttggccaactaccgctctaactgcttcctgccgaattggggcatagtaggggttgtgcagttgagatttcctcgggagggatgctttcgatgtcattaacatcggagcatgggctagcagactggtccaggggtccgcggtagatcttagtcatggactgcatctggggctccatttgaagaaccatttgtagctttacagctttgattctgaaagagacaaacttaacaaggaggttaaagatacagggtccaaagaggagtaacaatattatagctggtagaggtcctaagaagggagaatccagggcatccattggctgaggaagccccagggtccggtgttttgaagctcctctgctctatgttgtattcgatctcgaatttctttaactttctcggtgacgatttcggattgattaacataataacagcattcttcccctaaaaataaacaggttccccctctttcggaggttagcaagtctaaagctcttcgattttgaaggaccactgctgctagggagttaaattgatcttgcaaggtgaccagggagtcagcgacctgttccatgtcaccatttagttcttgagatagtttgtagtagaactgagtagaggttgtgaggccatcaatgtcagtacctagtctgcctagcactcctgctccaacaacaaaaggaagaatgggtactcttttgttgccgggcttaggtgtgacataattgtgtaaatcttgttcagtgtaaatggtcatagggacagtaagaatgagaggacgcacatagattctgaatggccattcaaacaacgatagtctgaggtaccacagacaaaaaaatattcctgagggtaggcagactatttgtgtgggaggagttacccacctgatacattgggagttggttgtgtctatagtattgttaaattgtacacaggtaaggtttgaggtatgggttatctccagattggaaacaagaggtcctactaaaacggaagtggtgtttatttttgtgctggagttgttccattgttcaggtacagggattgaatgtatggcctgaagtgcagtgggaggcacatccaacagttagtagggttttgggccgaaaccttatggagcctagtgagggtagtattaaataagcttaccagccgattatgggtatggagggtttcatgtagttttgagagatctagtcctttgtaggggctgggggtactttgtacccaggtcagttgggagattatttcctttatgtgtttttctcttgcctgatcttgaactccacccccatcagacataccattatgggtgaagtaagtccaacagactggctccaagtcctccaggacaactaggattaatcattttccctgtccaataatgagtatttgcatgcatgcaaagagttgcagagttataaccactcttgtggggcatatgggtgtgggccatgaaggtgggatttcctttagatatactcctatacgatgggacatcaatatttccgggaagccgcattcttcaggaaactcttggtaaggggagctactggttgtacagcagcatggagggggtgcagtgagagtgaaaggggatactgcctttggtagggaaaggaggcagaatcctttagtttaacttgaacaggacgggcattctttgctcatccatatgtccttctgttgcctagacttcaggattaattccttcctcaagcaggggacaacaaacgggtgttccttctcctatgttcaggtgtataatgactcctgcttttactagaatgtctctccctaacaagggaatggggctttcaggcataattagaaaagcatgtgaaaagagtaaagttccccagtcacaacttagtggctgggagaagtatctagtgactggctgccctaggaccccttggatagtgacagatctggaggacagttgtccgggacaggagagtaagactgagaagtccgcgccagtgtccaggagacagttaacctcctggccctcaatggtcaagcatacctggggctctgtgagggtgacggcatgggctggcgcttgccctgggcaccctcagtcctgctgctggatcatctggttagtggcttctgactcagaggaccttcgtcccctgaggcagttggccttccagtgattcccttgacataaggggcatggacgagggggcagcttatttccacttggagaatcttttttaaagtgtccttttagactgcactggaagcaagccctattaggcaatcgatttgcccagctattcccttttccagagcctccaaagtccgcttgcctgaggtccatgactaaagtggtggcccttttttttaaacccgtttatcccattctgcctgctcctgctgatctctattataaaaaactgaggttgccaagttcaatagggtttctaagttttgctctgggcctaaggcagacttttgaagaatacccattgtgattttttcctcaatcacctgggaggaaacatctattgtcctgtcctgaagggagttcctcctaggtctggtcagacctttatatggtaattaagatttaaatcccctgtaaggaaatctgctgggttaagggaattatcagtggttagagttaaattacctttttctaaaagaatagccccatactttaagatttttgagttagtaagctaccttttttgacttagaataattctaaactggtgaggtgtgctcacaaagaggtttcctctaaaagttatttttctactttcttccattagcaaagcagttgccgctacagattgaatgcatctgttggttactgggttaaggatttttgataggaaagctacggattgtcagtggtctccgtgttttcaggctacgcccttgtttacgctgacaacaaggtagtattggagtgttacagggtcacagagaagaccctcaattatcaattataggtttaaatttaccctggcttttaaaggaatagggcacactgtttttttactatttctctgtctttctttctctctttgactccctctctctcctctctgtctccctgtctccctgtctctcctctctgtctccctgtctctcctctctgtctccctgtctctcctctctgtctctctctctcctctctgtctacctcctctctgtctctctatctcctctctgtctctcgctctctcctctttgtctctctctctctctcctctctgtctctctctcctctgtctctctctctctcctctctgtctctctcctctctgtctctctcccctcttctcttagccattactaacgtggggccctggcaaatgtggtggggaatgggtcccacataactgccaatgtcgagagctgtatgcctaaattgggagggacaccagggacaagactccctgggtttatagcctagatgcctaaggacgcggggtagagctttcttaaatccctttggagatacaacttgctagaggaaatgaaagtctgaaccattagtacctaggaggcagggatcagaggaagtagattcagaggtaaggagaattttggggtgacactttcaagaaagtcatggtcaggatccaagaggtatgagtcagaaggaaaggtaggggcgcacgcatgggcgactattgaatagagacttctggctgcgccatgaactcaaccggctaatgccgggagtttgggatgacagctttctgcctgtagtcggccctcggcttccccgagaaaattgaaagtggaagctggttctgggcaggccaacattcccaacccacaagggttgggggttgttagaaagcccttccccggacagcctcacatctaagtcttaagtccagtggccacgctaatcgtttttaactggccgacaggtgcctggtattttcctgcaattctaaggaaggataggacggaatagcaagcgaaagtggtccaatattactcaccgctttggaggtcccttcgtggtcaccaaaatgtcaccggggggtccttgctcccagagatcccaagatggtggcgggcagcatccaagatggcggaaggccgcttccaagatggtggcaagccttgtgttctctgacctggggttcttggcctcacagattccaaggaatggaatcttgggccatgtggtgagtgttatagctctattagaagccatgggtcacggaagacaactgtggaacccagtgactagtgttcacctcaattaggacgaacctgggcacttagccatgcaagaacaatggcaagcctttagaatgatcgggagcagcaatgggtgccttgctggatcagtagcacagcagacaccctgccggatccagagggatggaagtcagcagtgggtctgcgatggcagcaaacagcagtggtggacagcgagcgaaagctcagcttgagccatagcaaacacagaccagaagagagtacagttgcaagatttaatagagtgaaaacagagctcccacacaaagggaggggacctaaagagggtagcccacaggtttttatgtgggtgtaagttttctactcatttgggtaaataccaacaaatatgtttgctggattgtatggtttactttcataaggaaatgctaaacttccaaagtgactatgccattttgcattctgtttgatgtttcgtacacttttatcttcacaacctccaatggcatctggcacacagaggatactaatcaatatttgttcattactgaatgacaagaagcacctgggcagtgtatttaaaatgtgaattccccagctaaatccctagagattctgactcagtatgtctggagtgggtcctcgggatccgcctgttcagtcagcacccggggaatgctaatgtgcatggtctggaaaccacagtttgagaaacactggaagctcattctggcaaacttctctgtgtggccatgtcagacagggtggtcttggccacttctgaaaaatggcagttcttaattctcactatttctgtgtccctgtgctctatatggttactaggttgtctttaaaataaaaaaggcttccataatgggaggtgaaattgctttttattccaaaaaagatttagttgaatgaaagtcaatgaatgtaaatgtaaattcagaacagagaacattggataagtatgcaagacaatgaggttggaagggatatatttttcaagcataacatagacacttaaactctacagaaatattcaaataccttcccgcaacaaattcaaaacttgtacagataaaagccacaggaagaataccctaaaacaaggcagtctcttacataaccacagtgcaatgatcaaaatcaggaacttcattgatacaatgctaggatgtaatctagggaccgattcagatgctaccaattgtgagactgtccaaaagcatgcttcagttgtcctgtttattgaatctcttttaatccagggcagttcttgagtcttgttatggcatgagcactacccaactcttttgtaggacgtcattaattagggcttttctgatgtcactttatgaccagtttcaagttatgttattttaaaaaatgtttaagtttaaaagcaatgtatttatcatttagcttaaggtggatggctcaaggtggtggaaagtggatggctaaaaagtgttggaaaggtttcaagatgaaattctgattttctataagatgaaagattttggtgagaaataaaagaaatctgtaggtcacgggtctttcttcacattaccactctcctaagctgagagaatagagtctgacatagttgaatctttttgttttttaactttcatcctctcttttttgctttccttttccccatgttactaagatattggggaaaccaagtgatttctcctatagaatgtccacactgtagaatttatagaatgcttgttcctgctgtagtttttaaatggaattccctgcaatataaaaaatagtactctggtgatagagatgtcaaatcctgggcccaattctagcacagttacttaagcaaatgttttgtaagcctttagcaaaaattaagaggcacttgccaaaagtcagcatgggttttctaagtacacattttgcagggttcttcacacttccttttcttgatgcaaggctggtagtcttgactaaagtgtttagtcatgttaaatctgtatttcaaaaaaatgattggcaaaacctttttatttttaaggatagaatttgccgtctttcagacacctctcctatgtcaagaacttcatgaatgccaactggaattctctcatgatcctacaaatcagaatttagaagtcaggcagatttacattcaactcttaactttccctctttctagctatgagaactcagatgtgtgaactaacctctttaagtctcagtttccttattggtaagatagtgataattataagacctgttttatataatgtgtaaaaattaaatattgtgaaaattaaatgcaggtaaaaattttaatatagtgctttgcatatagtaagttctcaatagctgtttgctattagttatcagtgcttccatggcacagataagaagactgagggtccaagaggctaactctctggaataaagtctctcagctccaaatttgggaaccatcatcatttccataatatcttgctgcctccttgtggacaagccaaaagaaaatgtgagctgaaaagccatgtaattctacagatttgtttcaagttcaataaccttcaaaggttctaaaaaaaaattaatgccaaaggtagtgtatgatgtctgtaatagactgggtctttattgccatctcatctgtgtggaaatggggctaaaatgaagagatgtttttcagatggcaaatgaaaataaacaactgcagataatgctataagtgggttagcatttttttaatgaatagattaaaataaaaacaaatttaaatgatgagatttaattcacaataaatgcaaatttctgaacttggtctcagaaataacaactttacaaatcccagataagttatttttagatcttgagcttgctgtgaaatgtaaaaagggattttggtttaactgtttgaatccctccctgtcggcccttcagtgaattatttagtccatagtaagagagatgatggattctccaagtggcgggtcccaagctcagagattccagaacagtggatgacactgaggaactctgcctttgtcactatggcacagcattgaacaaaaaccatgccccctcaaagtttgtgctgtgttgcaaccagctgaagataaatcagaaaataggatctgatgttgttttgtagagatctccttgtcctggggcttattgaggcaattccatgatcatgaagtagaacaatgcatacagcccatccagaagagaaccagaggactccaacttctccatggaagccccagaaagctgcttctgagtgctcctctccttcctccccatccggacgtcaaaagaaccagtactagacccgataagcctaccttggttgtcacgggggtggtttgtgtggtgacaaatgagactgtccgagcaactgaaggtgactgtttatggaattacatggagatgttgttatgggaacacatattcagccccttctataatgggccgaattgtgtcctcccaaattcatacgctgagtcttaaccctcaggacctcagaatgtggctatatttggatatggaacctctaaagaggtaattaaggtacaatgaggtcatatgggtggaccctagtcctatccgactggggtgttctcagaagagatcaggacacagacacacacaaagggacaaccatgtgaggacacagagggaagacagcatctacaccaaggagggaagcttcaggaggaaccagcgctgagacaccttgacctcagacttgcaaccttcagaatgtgagagaattaaatctctgtcgttgaagccctgcagcctattgtactttgttacagcatccctggccgactaatacaacttcttacaaggcagctcattttaacataaaaaatttttgtgttgaaatcccaacatactgaggcacatcgacacatgagctgatctgctgatagttcactgtgccaaatagacaaaaccagggagctgttgttgaacctatggggctagcaggaaggtgaggattacaagagtctggattctggactctcacctcctccttcttttccccacacctacaatccctgaggattctttgcaagacaaagtgtggaaatcactgagctagcacaggtacctgcaaaccagaggccactggaagccacactggcccttcattttgaagaaggcccattgcaacccactctattgatttcagggtcctctctggtttatggttcacatttggaaaacttcttgtaaaattagcttattacaagagcatacatgcctcaaaaatttccagcattctccaagacagacagcactgtgtgttttcacataccagaattttcatcatggaaggtgctcagtgatgagtggaacctctctgagaaccagttttgaggttctgggagcccaaccacatggggtattctattcatgaagctgtggcattcctcatgcagatgagttcagatacctgatcaccttttcctatacatcattaaacttggatctgtgtggcaatggactagatgcagtggtatcttcagtcatgctaggatatccttaggatagctactgccctttgctgctgggttgagatgtgcttcataactgtaccctgcccagcccctgccaccctggcccactcataaatattctcacatggggtctgtgatattctgaatatacacatatatatgatacacacacatacagaaacacacatacacatatatgtgtgtgttttatgcaagcttcattacataggcctgattgagaacaagtagaaatgtgattggacaaaacacacacacacacacacagatgcacacacacacacatataggtttttggccacggtttccaactcatatctcccataacccttattgcagtcttttgttagaatgttggggcactttaggtctcagaaaacagaacctctctctctcactgaatttctcccttcttcttttcacctgcccatggcaagattgtaatctgattgtggatcaaaagaccctcattctagacagcgttctgccccatactttagagggaggaatgctacccggagaggccaagaaaagtctgaatagactccttgctgggtttagatcatggttttttttggtccagttgcatttgtacacagttgtcaatcatgtctataaaatgaagtcttcatagaacgccaggaggactgggttcagagaacttctgggtggctgaaaatgtggaggtccctggagggtgattcccagggagggcatggaagctccacactcctttgcccataccttgccttacatgcctcttcatttgtgtcctttgtaatagtctttataataaaccataaatatgttttcatgagttctgtgagccactctagcaaattaatggaaccgaaagaggggactgtgggaaccccaacttgaagctggtcattccaaagttcaggaggcctggacttgcaactggtgtctcagggtagatccctgtaggatctgacactatatccagaaagatagtgtccaaatttaattagaggatacccagctggtgttcactgcttggtatttgatatggtttggctgcatccccacccaaatctcatcttgaattatagctcccataattcccacatgccatgggagggacccagtgcgaggtaattgaatcatgggggcaggtctttcccatgctgttttcgtgatagtgaataagtctcactagatctgatggttttataatgggcagttcccctgcacactctctcttgcctgccatcatgtaagctgtgcctttctcctcttttgccttctaccatgattgtgaggcctccccaggcatgtggaactgtgagtccattaaacctttacaaattatccagtctcgggtatgtctttattagcagtgtgggaacagactaatacactatgcatggggaaaacccccacattttgtcccagaagtcttctttgttgattgttgcagtttgagagcagagggaaaacatggtttgagagtttttgctaaacagggtcccctcactccatgatgagcagttacccactaaatatttttccctcggtcacatgaaagtaagagtgtgctgtgagtggatccctggaaatcctcccaaaactcatcctgggatcacatcctaactctctgctgtcacactggatggacaatttttatgaaagtaatggcagccctgagttcatggcaaaataacacattactgtggaaggacagaggaagctgactccataatagctattcttaggtgtggccgcttggaaagagagacaggaaatcatacagagattacggagattgcttcctggcagtggccctataattagccttgcagaagaatcccttccagtcttttgggtataacagagacatccaagtacttgcactgcatgctcactgctgaacttcatcttctatcaaggctgttcgagaatgccattttcgttttccttgctgtcaaagagctcaaatgcctgtgcccttccctcgctaggaacacgcatcgctttaaatgaaagctgcaattaactccagaagagtgcaggatggggattagggtgaagagagagggagagaaatatcagctttcagattttgcctttgtgataactatcttgtttatcttttagatgattgtgaaaaactgaaattatggaaggagacaaattactatttatgctccagggaaattcaaaaaattctggaaatgcatacttaataagaaacaaatctatacatttataagttttatctctttgaattccaatgactaaaattgttacttttaaattttgttccatttatatctagacttgagtattttttccctaggcagatagctgctgaaaaaagaaagatggttatgagacagttatttgtttaatttgcaatgttttcttaggtactgctatgttacattttataaatgacttggggatacacacacacatatacacacatctctccatatttatttaaaaatctgtctagcattaatgcaaaagataaagtatataagggaaaacaagttataaacttgttttaaattacaggaaggctgtaattcaattcactctttgaagcattttgaaaggatatcataagacgtgtcaatacattgcaattaaattgtttcactgtataattcatttgcactatgaaatctctgctgtttccttaattgatgcatcttatatccatttaaaatatacattaattacttttatttatatttgaattgccactgactgtatttggatttttatttccctaagtggaaattgagctttccattaaaacaaccaaaatcattttttttgtgccgataatttcatgcagtgatgaatcacctagacttcactttatctgtagctgtggaagattaaggtggtcacaaattcttttcagttcctctctccaagaaaggaaatctattttcctaccctttaaattggagctggcctccacatttgatttcaccaataaaatacaacaaagtaatagtgttaaagtgccaaatctggacttcaagaagccctgtagcttccacttcctctgtttaaacagtggtatgtgaacatgcctgggctagcctcctggagaaagtgaaaccacatggaacagaggtacagccatcttagctgtcccagctttcctaggtgaggccccatccacatgactgaacccagagatagcacaagcaatagagatgagctatcctagctgagctctgctgaaattagcaaactgtagtatcatgcattaaataaacaactgttgtgtaagccactgtattagtctgttttcacactgctaataaaaatatacctaagacttggtaatttataaaagaggtttaattgactcacagttcagcatgactgcagaggcctcaggaaacttacaatcatggccgaagggaagcaaacatgtccttcttcacatggcagcaacaaggagaagaatgagagctgagccaacagtgaagccccttataaaaccatcagatctcatgagaacttactcactattacaagaatagcatgggggacaccaccccagtgattcaattacctcccacagggtccctcccatgacatgtggggattatgggaactacaattcaagatgggatttgggtggagacacaaccaaaccatatcagccactatattttgacttaattacaaaatatatcagtgcaaaggctgataaaagataatacaaacctaatacaaacctaagctaatgtagaaactgcaattatgtgccaatatataccttgttctttttagacaaaaaaaaaagccaaaattataattttttatatgtgataaaagcaaaaaagtttattggacaaacagattgtctcctagagccagtttttaagagggatttgtctcataaaaagttcatatagcagctgtattaaagaaaatgcaaaagttattttttatgtctgattttggctgggcatgatagctcaggtttataatctcggcactttgggagtcgggagtgggaggattgtttgagcgcaggagtttgaaaatgtagtgagctatgatagaaccactgcactccagcctgggcaacagagaaagaccctgaaaagaagtagtcagagaaagctggagttacagaaagccagtctaatgtgaaatgggtgagtatttctggggaaatattttgataagggaaccaagctcagaaaacgtaaacagtttgtatgattactatgccacttgcactattttttcctatatatccattattcccatggtgcttttgttggagtttgtggtaataaattcagtattgcacagtttgtccataaatacctttaatagagttattctaatggtgatggtgttggtgttctgcaattgaaagaagaatcctgatttacacgtgttaagatagaaagtcattcctgactttgtacacacacacatgcacagacatactttttatcaatatttatttcatgaaacgttaaatgttcaatgctgtaagcaattattcatttgagactttttatttctgtgacttagggcaagaagatactattttggctcagacaatattgtgtgtgggttacccgttgatcattttaaatatgaaagaataactgcatagtgtttgggcagttccagttttgaacatcatggcctccctaaggacctgccaagatgaattagatgtgaactgcacctcgagtagcatgcactcatgttgaattaaacagcaaaaagcatctactctaaacaaagcttgtagtgtgtaaatagctgtcacagacctgcttttgctaatgatgatttgacatgaaattcccgtgttcctggaggaagggagattgcattagtgccctgatttctcagcctttcctgaaaccaggcccttcacaatgtgaccacattacagcttctctcaacagaaggcaggggatagttcacccctaaattttgagttcacctcattacttggtttagccaatgggtgtcaacagtggcagagattttgaaagtgcttgtgctttctcttgtgctcctgctgttggcccccatctttagatcatgcctgagctagcttgctggaagctagagacctatggtgcaattatctcagctgatagccataggagtgaagtcaacagggaaccaaaataccatctagctgaacacaacctaaatatgcaacccataatccatctcacgagttagacaactgcattttatttcaagccatcaaggtaaggtaaagagtgtttgttatgctgcattattgtagctctagataaccaatcttttcttaagcatacccttgtttgattgagaatagttgtccctcagtatctagaggggattggtttcaggacccccatggattccaaaacttgagaatactcaaggcctttatataaaacatcatagtatttgcatttaacctaaatacatcctcatatatgcagtcagccacacgttctacatctgtggattcaaccaatattggatccaaatatttggaaaaatcaagtacatctgtagtgaacgataaacacctatttttcttgtaaatagtaacaactatttatgtagcatttacattagattaggtattatgtgtataattatgtaccacctaacaatgttttggtcaacaacagatcacatatatgctgctggtctcataagattataatgccatatttttactgtaccttttctatgtttagctatgttcagagacacaaacacttaccattgtgttataataccctacagtagtgagtgcagtaacatgctgtccaggtttgaagcccaggagcaagaggctatgatgtatagcctaggtgtgtagcaggctataccatctaggtttgtgtaagtacacttactgatattcacacagtaacaaaatcatttaatgacacatttctcatgaggattaagctctgatattttatcttgcccaaattcccatctaaggagtctgggtagtcatgctttacaaaatataaattctcatcagatgggttttattttaccctatatattgtgacctacgttccaataagactctgtcataacattatgtgacaaagaagaaagttaaaatattttacccccaagcatgtttctttgctatatcttgaaatggccctgcaaatttgtcctttgtgggggaaaatttgcatctgtaaagaatgtctattaacatagctagatcttttcttccaggcactcccaattctgaagagatttactaagagtctggcaccttttaaaggtctgaataggaaacatttgtcgtctattgtctctaaaggctgccactataagacttcaaaagaaccttggtctccacgatcttttatcttaacctgaacatttcctttctatcaatcccaggtctttagacaaactcaaccaattgtcaaccagaaaatgtttaaatttacttacagcctggaagctccctgcttttctggttgacaattacaataacacattgattaacaacagggctatgttctgagtgtcgacaaaaagagtcaaactctgtaaaatatttgaagagatttattctgagccaaatatgagtgaccatggcccatgacacagccctcggaaggtcctgaggacatgtgcccaaggcgatgggggcgcaacttggttttatacattttagggaggcatgagacatcaatcaagtacgtttaagaaatacataaaggcgagacaactcaaagtgggtggggacattgcctgtaaaattaaatggcaacatggcatgcctaacttgggagccaaggagccccccagtgaaatcctagcacaattacttatcagttttagatggttgtagaagatccttaaattctataagcatcagctttctcataaaaaatggagctattaatattacttccatgagagtgttgctcggagaattattaaattcaatggtatattcagaatgcttagcagagcacctggcagatatttaactgttcaataaattatagttattattattaagactgcttactcctcatagaaacctgaaaatttgggagaagcagtttattgagaagaaaattaacttagaattttgatgagcgatgcagaaaagtaatgaattgccatatttgtgacacagagagttacctctttttgaaaatggggcagattatttttattatttcatcctgagggacccatgcccagggaatcagacgaagcacagcaaggattgaggtctctcatttgaaacaggatgtaaacacatctgtggaacaaagatcacccagggcagtttttaactatgttgattaatcatacaaattataatggatggtacaaacaaaaattgctgatgcttccaaaatcattaatgatttctgtagtcacgtaaagactttgggaactattaaaccaccaacttttgtatccttttcattccaattccaatgataaaaataattgcacattagggaaaattcggacaatatagaaaagtaaaaacaagaaaaaaaatggaaatctctcttttcagagcataaatgtttcagtgtattttctcccaatctttcttcttcttgacatttaaaggagaaccataaactacgttgaaaattattttatagaaactcaagatttttacttttctttctgcaaagaaaacgtgttatttcattgtctgtgtcagaggatcttgaacaatgaactctcagattccaaacaaaacatttcaataaaataccaaacttactgtttgcacccttagaattgctataatagacctcgacatttttgaatccttgttctactgaaaggtgagaggaaaatgcgcacagttgtctgacataaacaagattgtattaaacagccctgtattagtaggttgaaagtatgctgatgaaatgaaactaacacaatgtgttgaaataagaaagaaaagtacactttctaaagcacaactctaaaatttgctttggtttttagtttatggacactccgacatcttttcttttttagggtgttcaaaaatgacctcagaatgcttcatgtgagctcaatcatgaataattgtggtaggagtttattggatggtctgatacccattctaattaagcacgtaaaagtacactgggttcctcaaaattatatccagagccatcacaggttatggatccaacaggaggtttgatgaaatacacactgctcctagctgagaaggctgttgaaaacccacatgaacaattgcacttataggatttaagattgactcagggcaccctggtttgaagaggatgacctgagttgaagtgaattcttaagaccccataaatacaatgttttgtcgggggctgatataacccaattcatgcctgatgctcctggatctctagtctgatttccaccctgccaacccttccagtagccagctctcagtgtgcacatgtgcttaagtggttcttagcctctcaataaacagcccaggacagtaagggccaaacaaaccttcaagtatgtaaaggaaattgcaagtgaaccattcctgcagcccaagatctaagccctattaagaaaatagatgcctatttatcatcttcattcatgtgccttgcaggggcaaagaaatgactaaagacaatcttgcaatgtatgtgccaaagacatgcatttccctttggattatctgtggagttaatttccaaagatgcaacagaacataacagagcaatggatcagtgcctggcagatccataagtcttacactaaatgcatgactggtagtctgccagatgacagaggaattcttcttcataccattgccctagctctgattttcaaacagatattaaaaatacagaggggagattctcaaatcacaagctttcaaagttaacatcgaaagaagccataatcatcacatttgttactagacgatacctcattttcaccatgtattagttaagcacttaattggctccccaatgctttgctagcaacatatcacaattgtgaaacttcataacgagtgtccactcaatatatttaaatttcgttttttatgacttcagctaggtggatgactgacttgctagacaaatatataaaagcatattaaaattatgcataggtagcagtggcttaataggatttctcctacatttcagtatttcactgaaacatgctttattttcacagtatgctggctgttaagtgcaggcacatgaatgaaaaaggaatttgaccatctccctatctacaaatgttattgtttctacagctgtctcctccatttctgtgtcaggctcaacctaaaagaaaaattttaatgtgaatgaaagtctgcacccgggctctgagaaagtgtgtggaagaagatggtaggtgtgctcatggtagcatgtacgtcgtaggtcataaacaatgaagcacctgtcctttacaaatatgaaagctcacagttattcatgttactcagactctttgtccaggtttcagttcttttctttgccctgcaatgtaaaagtaatcacaactaaataggaaatatggatctccaatccacaagatgaggtgattaggaactgttgtttgggaagcattggaacaggtggagatgattagtctagaaaagacacatcttgctgttgaaatatttgaaattcacgtaagacagtaaaagaactcctgttgcattccaggggacagagctagatctcatagataaaagccacaaggagacagaggtaagaaaaacataaatatatgctaaataggagaattctacatatggcactattttcagaaagagcattaatacaatctctatttatattcagacaattatcctagaatattatagtttttttcataattgtgtgtctactgtataccacctaggaaatattaaatactatgatcagtatttttgttattgctacttttatttttattattaattgggagcttttccagacattaataaacccttagcagacataggtcatacatcagttgctcaattcattgtcacctctatgagcatatttctgatagtgaagctcagtatgtgttgtgtaataaataaaaaggaaacaatgaaagcaaattactcattattgccttatggttaaataaagattaaaaaacattggaaaccatgtagagaaagcagggtataattatattagaaaccactgtgtaaccatcactaatattaaggaatacatctagtcctgacagctccttgtaaatggaaggagacatgttgccaacttatactatctactggaaaaggtagacattggcaaagctgtcaactgtctcacaagagaagccaaggggcttctacaggtatcctccagagatattgtgggttccgttccagaccaccacaataaagaaaatatcacaataaaagcaagtcacacaatttttttttatttcccagtgagtataacagttatgttcacattgtactgtagtccgttaagtacgtaataccattgtgtctaaaaaaatatacacatacctaaattgaaatactttattactaaaaaatgttaacaatcatctgagccatcaatgatttgtaatctttttgctggtgaagggtcttgccttagtgttgatggttgcagattgactaggatggtggttgctggaggtggggatagctgtggcaatttcctaaaataagacaacaatgaaatttgctgcattggttgacacttcctttcataaaagatttctctgtagcatgagaggctgtttgtagcattttacccacaagtagaacttcttttaaaattggagtcaatcctctaaaaccctgccacttctttatcaattaagtttatgcaatattctagatttttttgttatttcaacagtgttcaccagtatattatatattatattatgttataatcttcaccagtatattccttctcaagaaataattttctttgctcattcacaaaaagcaactcctcatccattcaagtttagtcatgaggttgtagccattcagccacatcttcaggctccgcctctccttctactactcttactatttctcccacatctgcagttacttcctccgctgaagtcttgaacccctcaaagtcatccatgaggcttggaatcaacatctcccaagctcctattaatgttgatattttaacctcctcccacaaatcataaatgttcttaatggcgtctggaatggtaaatcctttccaaaaggttttcaattaactttgcccagatccatcagaggaatcactatttatggcaactgtaaattatgaaatgtatctcttaaataataagacttgaacgtcaaaatgactccttgatccaggggctgcagaatgaatcttgcgctaagaagcacaaaaagaacactaatctctttatacatctccatgagagctcttgggtgaccagattaattgtcaatgaacagtaaatgttgaaaagaatccttttcctgagcagtaggtatcaatagtggcctcaaaatattcagtaaaccatgccttaaatagatgtgctgttatccaggctttgttgttccatttctagagcacaggcagagaagatttagtatcattcttaagggccctaggatttttggaatgctaaatgagcattggcttcaacttaaagtcaccagctgcattagcctctaacaaaagttatcttgttctttgaagctttgaagccagacattgacttctcctcttcagctacgcaagtcttagatggcaacttatttcaacattaggcagtttgatttacattgaaaatatgttgtatagtgtagccaccttcattaataaccttagctaggtcttctggataacttgctgcagcttctagatcagcacttgctgcttcactttgcactcttatgttatagaggtggcttcttttcttaatcttcatgaaccaacctacactggcttccaacttttcttctgcagctttctcacctctctcagccttcatagaattgaaaagagatagggccttgctctggattaggctttagcttaagagagtattgtggctggtttgatcctttattcagaccactggaactttctgcatattagcaataaagctgtttcactttcttagcattcatgtgttcactgaagtagcacttttaatttccttcaagaatttttcctttgcattcaccacttggctaactgttttgtgcaaaagcctagcttctgccctcttggcttttgacatgccttcttcatgatcatttcttgcttgtgatttaaagggagagactctgcctttcacttgagcacttggcctttgtaggggattaattggcctaatttcaatattgctgtgtctcagggaatagggaggctcaaagagagacagagatggggaatggccagttggtggagcagtcagaacacacacaacatttatcaattaagtttgccatcttataagggtgtgatatgtggcaccccaacacaattacaatagtaataacaaacataactgatcacagatcaccaagacaagtatagcaataataagaaatacaataataatgaaaaactttgtgagaaataccaaaatatgacatagggacacaaagtgagcacatgctgttggagaaattatgtatagctttgctcaatgcagggttgccataaaccttcaattcagtaaaaaaatgcaatttctgtgaggcacaacaaagcaagataggcctgtgtttagatgagcactggaaaccaagaagttcccaaataacatttaaaacacagaggcttagggttacagatgtgtgtcattttaatcttcctttagtaaaattatttattgtatagaatgattttctttaaataattacatgccctagagaaattacaatttgataaacaaatttttggattttttttttgttataggtaagctggtctacagaccacactgggtatgggtaagctagtctataggctacactatgtatgagtaagctacactatacaatacactggatatgtgtaatctagactataggttacactggtgatgggtaagctactctacagacagcactgggtgtgggtaagctagtctatagggtatactgggtatgagtaaactagtctatagactacactgagtatgggtaagctagtctatagactactttgggtatggaaaagctagcctattggctatgctgggtatgggtaagctagtctatagactacactgagtatgggtaagctggtctataaactacactgggtttgggtaagctagtctatagactaaactggatataggcagtctattatatacgttatactttatatgggtaaactagtctatagactacagtggatatgggtaatctagtctataggctatatttgttttgggtaagtcagtctatagactacagaggatatggataatctagtctacatactaaattgggtgctagtaagcaggtctatagactccactgtgtagagatagggtaagctagtctatagactacactaggtatgggtaggccagtctatagactgcactgggtactagtaagcttgtctatggactcctatcagggatgcctccagatatggaaacatgcataatgaacatgagcaagtgtcaggtcgagccaatattcttgcatataagttctcaaaggggagaatcagcaatgcctttttgttgtccaccaagtctactggaatgagcttgagtctcacaatttccacacacaactcaaagcaaagcagcataattttacagctgggcttgctcaaatttaaataatcagagccatggcatctttctatctcttattctagtgaacaaataatggtaatcataacaaaaaaatagtaagacaaagtcattattggaagtcctttggcagatagaatcctacataaacatttttaaataatctgtggtcaggttgagcctacttcccagaacttgggatgattaatagtattggcagtttaaaaaggactaaaaaattttggcaagtcaaatgaaatggttctaactaaacatactgctcattttgctcaatcaaaattactcagtgagtataaattcagtggttttaacagaggaaaaattttgtaaattttaaaaataggctacctctttagtgtaagcactatactaatgtagacataaaaatatatagtatgttttgattcatagatttataatattaataattacaactagataaaacaatgtgtttatgcagttaaaagtcatgcattaaaattttttcttatgtgggtcaatgatgaaaaatttttgttggttggaattagctgttcattataacatgtctgtgttgcatcgtgtgtgtgtgtgtgtgcgcgcgtgcgcacacgtgagtgtgtgtttacttatctatggctaatagttttctctgaaaaactaaaatgaagaatattagacacaataaatgtgcagaaactatatttacataattgtcagggtctcgagaaacatcaggtaagtgtgaccatttatttccatcttcacaattgcttctctgtaattaagctgtgcttcttggtgaagccttcttgaaatgccaagtatttacacctgttttggatggttgtcatcggtggtattttagatttcccagtttgtttgttaggagaagcactagtgatgtaagacaccagaactgtccaatttgtaaaaataagcagggataattcagatggcagagacttgatcctgggtttgggtgagtcctttgtttacccagtgcccatcagtcacagctatgctaccaagcagcatgtttaaactttcattaatatgtctatgaccttcatgcttaatgagccttcaggggtctcagcaggcaacattttgaaataaacttcataaggaataaacaaggacattggaaacaggcagaggaactagcaagagcatttggtggtgtaaaccaaagtctaaactatcagtagaagccaaagtgattcaaagtatctcatgtattttacaaaacaaatgctcttcgttttaaggagagaaatgaaaaatctcaaaacacagtccaggaaaaatgaaacctgaattctaactcagtaaaatattattcttgactttataaaagatttttctctacatactggactctttaataacagaacttattataccatttaactgctacagaaagatggaagttatttaaaatatagtatacctattatatgttgaaattaggagacttttagggcattaaaatatcccaggaaaggagagggtccaaattgctagactagtttcatggcttcactgagccctgacagatcaatttaatatttgaacatcattaatttgaacatttctcatgtaatttaaggctcacactgcataatacagggatgcattcaggatctggacttggagaggtcgttttaaaaagccattaaggtttagaaatagaagaaattacagtagttagtaaaatactatggaatattctgcaacatgcctcagttgtaaggctaccagatcctaaagatggagtgaaaattgacaccaactagtcagagaggtttctatacatgtttcagagcacacatttgtatattttattgaatgtgtatatgaaagctagagacatgggtcattacttttcccaatcgcctttctcccaactctttttcttggaagagtcaaggttgttacaggcacacagaaatacactggaggaactcagaactgaccctacctactagacacttagtcttacagtgatcttccccttttctctcttttccttttcatttataatagaaacaaaagttatagatatttaaaacacgtatgctttccccaaaacattaaggcacaaaaggcattcattttatgcaaattgatcataatcatagccatgaagcaaacatatctcatgatggttttgatctctaatgttttctcttgcaaataataggtctcttaatcacgttaaagacctttggtcctatagcacatgtcattttaaaaaaatgcatccacaagagatttgacacaaggcactcttgattgtatctgtttttttataagaaacaaaaataacaaggtctaaattgcaaatatacttgatttcatcttactggtacctttaagaagaatcagagttgtgtttagaaaaggtgttgaggtgtgaaagctgtagataattggactctcaaaatatgaaataaacgataaagtgtggataagttaaatttggaaaagtgatttttgttggacttcattttgtctagactttctcatttcccgttacgtaatttgtgatgtgacactaaacattcttgcacacataagaaactggccatcagagaaatgcaaatcaaaaccacaatgagataccatctcacaccagttagaatggcaatcattacaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccatcactgggtatatacccaaaggattataaatcatgctgctataaagacacatgcacacgtaggtttattgtggcactattcacaatagcaaagagttggaaccaacccaaatgtccaacaatgatagactggattaagaaaatgtggcacatatacaccatggaatactatgcagccataaaaaatgatgagttcatgtcctttgtagggacatggatgaagctggaaaccatcattctcagcaaactatcgcaaggacgaaaaaccaaacactgcatgttctcactcattggtgcgaattgaacaatgagaacacatggacacaggaaggggaacatcacactccggggactgttgtggggtggggggaggggggaggggggagggatagcattaggagatatatctaatgctaaatgacgagttaatgggtgcagcacaccaacatggcacatgtatacatatgtaactaacctgcacattgtgcacatgtaccctaaaacttaaagtataataataataaaattaaaaaaaaaagaatttaagatccctcttacacaataatattattctgtatttaaagaccgctatttaaagaacattttcattgtgaggctatttttagtccttcacacttaatagtggagataatgataatatttttttttggaatgatgaggcgaatgatgagatatttttaccccctgatgcatcatttacctagctcaacaaatgtgtggagttattggattttgttatttatatgggtgtgtagaagggaaatcttgctttctgccagtcttaggggagcattttaatctgataatgtctctgtgaagagccaaatagttatttatcagttctatctcatacttaagtcacttgacctcctagtcaatattatgagagttgtgtatgaacttcgttctccaaaaacttcagaagtcaatggaatttgatgaaaaataagggaatgaatgaggaggaaactacttcaagaacaagaatcaacaggattttttagggggcctgttcacctttataacaccccacatttccaaatgacagcactttctctagtgattaattaggattccagcagagttttcataaatttggaatctagttaaaagggaactcattaaattgttaaattcaaactagttttcctaggttatgttcctttgaaagtgctcagtgaatgaagcaatgctctatacacacagtagaactacggatatatatgtatctatggctatatagatatataagattctcatagatgacatcattgtcatatatattacatatacctacatatgcatatgtgggtggagagatagatcttgaaattgaattcaactactctaataattcagttttattgtcttttatttcttatttttcttgttttctcttgtcttctttaatctctttttaatgctagcaattaaagatttgagaggctcaaagtcctaaaatgacataatatttaaatgtaagcatattttggaaattctaagatagctgtagaacttattttttacataatcctgagaaacaactatggattttttttatcacaacagttgaattacaccaagtcattgtttcattgggaatggaaataatactgacagattcacttcactctttggccttataaataacaatctgagcttctcacctcaggttctacctggtttcataagtataaatgtagactgtaacgtaaacttatccctctattcttcagtcaaaactcgggagcatgaaaagctcacaagacatctttcttaaattcatatagccatatgtattcatagttgatatatatatatatatatcccctagatagagtgttattgattttttaacatattctgttcatctttaggtatggaggaaagttttcagtccacagcagctttgcatttgacagattttcaagtaaccattatcttagcgaaatgcatccaattcaattcagcctttttttgttgattttagaaaccaagggttttctttattttccatatttatgaggagggaaaggggtatgagaaagctactgaaattctgtctaaatgggaagggctaaagatatgctcaaggtttgctttgtttggctttgtttctttgaaatgtacacagggcaagttgagccatgaagtaaaaacttctgaaacctgaggttgataagcattcccaaattacttccctttgtgagatgctaagatgaaaggtgtttcaatgaatcacctgcttgtttaggtgtgacatagggccacatcacaggggcatcattttttgtttgtttatttgtttgagacaggttcccactgtgttgcccaggctggagtgcagtggcgccatcatagctcacagcaaccttgaactcctgggctcaagccatcctcccaaggatggcagcctaggactgagcagttgtgtttattgcttaaatcgtggagcaagacccttagaagacattgtattgtgaaaatgcatgaagatgctcagagtacatccatgaaatggtcttgtttgttttacatgtgattattagcattccaaactctgtatttgaggacaaagtattcttataaagcagcgtcgtttattaaaacatttaaaagacaggcaaacgatgggaaaatcctctaagtcatatatactatacttagcccctaggtgctgtgatggaagacatataggtactggttcaatgtttatattaagagctttataatataatgtgaaaaaatgagtgtagtcaaataaagaagataactgtgcattcaagaaatttgtatcatccttttttctatgttttcttcccccaggtattaataaaagcttaggtgaatttttagaatatagattttttcccattgttactgtcatctttatttagcagtgatatttcaaactattttaagatctttagtatacatatgggagatacgaaggaacaaataacaatggtattttgtctgtgtcttctctgagaaattcaacaggttgctagtgaaagggctgtttagttgcaataacattttactatggaacgttatcagtttataccatgtgaggtgttcatttctgtcacagtgagagaacatgcatccttgctgtgttctcaatttaacttaaatctcatgatttcctgttttgaacaaacatctacttaattcctggctcctactccccacccactggcagccgctgtgcagctgccgtgattactaatccacctggcgatggtcaggggaaggtattaagtgaaattttgacttatgaagggctaaactacttacagtgcaatagcatttccccataatgcataaaacacgtagagaaataaataaataaataaataaataataaataaataaataaataaagtcagagaacaagatcactctttatccaaataacacaggttggttttattgctttaaagcataggcacaaaaatcagcctttgggggaagacgtggatttcaactcactattgccaaacacgttgatataagagatcgtgtggtatgcagctatgtatagatgtgtgcctgagatgtgtaggaatctcgagaactttttggatgtttcttcctgtgatgttggaaagacttggtagaattacataacaattcagtatgagtccttagcacgatccttttgtcttttttcctttttttttttaatacatgaccaaactgatggaaacaaaggtagcaggctgatgctgtaaggacacggtgtaggaatgtcttatgctagttagtccatcacatgctagttctatttatttatttttcctgagatggagtctcactctgttacccaggctggagtgcagtggtgcaatctccgcacactgcagcctccacctcctaggttcaagtgattatcctgcctcagcctcctgagtagctggagctacaggcacccgtcaccatgcctggttaatttttgtatttttttaaagtagagatggagtttcaccatgtttgccagactggtcttgaactcctgacctcaagtgatctgcctgccttggcctcccaaggtgctgagattacaggtgtgagccaccacacatgctggttcttaagaacaagtgagaagattctgtattgtgaagtcagcctattgcattaaacttattgtttatatttgattcaaaatctgcttatgacaaattcgatgtcatttttgtgttgcaatctggtgtctgtaggcctttgccttgcagtttcatgtgaaataacatttttaaaaatggtttgtacctatgtagagcttattctaaactcagagtgtggattggtgtcttggatgggagctgctgtgtgttttccttcctgtgccacccttcctcctccagacacttccatgtggctggctgcggctaacatcagccatcacttatacatagggtgagaagactcgggatttggtatctttaccacttgatctcacttgctcccctttcttcttggtgcatggaatttacttcctctgtaggcaagtcaagcctcctccttttcagtcttcaggcagtctgagacctttcttgccttgcaatctcagaattgcagcattttattatctcagaattcctctgaaagtgctgctgaacttgaaaagcagtatctagaactttgtattttcaagacttcgtttgactgtttgcctagaattgagtccacctactaatgtttgctcaggtaactaagtcatccacacatcctgtgcttatctttaagctgacaatcctaaaatgagagccacatcctcactgtaatgcacgagatgagagccaagggtacatacagagcctgagaattcaaagtttaaaaggcttacttagggtgtctcagtaaaggacacctacttattcctgcacaaacaatcgtgggtaaagaaagagatggaacaccttttgaaatgcatatgggtagcaaaccatttttttattaaaaaaagttattttaagctaaatgtgaccctaacacacagtgccccccaaacacacacacacacacacacacacacacacactttattatgtgacataaaaagtgcattattaaattaagcaataattaagtaattatttgacaattataaacaacgaataacctctaaaatgtttgctaaagttgcaatgtttaaaatgtatgccaataactagcttttacatagttaacattagaaaagcttatgctgaaggaattgttctttctgaagtaatttgattaataaagattgctgctctcttgcacaagattcttgcacaagttgggagaaaattctgctgagaagggagaagtcacatggtggtctggtggggagggcaggactaacagcccagaagttccagagcttgtgcaaggctccagggccagtaaatgtgactgacaagatgaaggttgagctgtcttgtttccgtgcctgaacgctttcccctgaatttcccagtctcaagaggctatgattctgcttttggtcctgtgtgtaaatcactccagttctccacccatgtctgttcgagggtacggacatccctcttagcatggaaatgtgattgaagcccaattacagccatgaatcattcccaaatctgcaggacatctcagtttagctggggctttttagaaaaattgcaattccaaagctccacccttagggtaatgcagacctgtcactgagcagaatcacaaatcagaatgggaacagggaccagtgtctgtgtttggaagccaactgtggtttaactcatcctacttctcagtgacctcttccattcacataggttgctatctcttatctgatcaccctccataatcaatacattggctgaaatgatgggaaaaatattccagctctgcagtcattttgtttattagaatgttgtgcttgggcagcaattccatcccctgggaaagactgaggaaggtccccagtagcaggaggtagcatgatatgatacaagaccctgggctttgggttcagaggcaagttccatcctgactgtgtgttcctctgcaaggcaattaacttcctacatttaaaaaattctacaaactcatacaaatacacttacctagtgcattgctatgaagacaaaatattatttacagtacctgctcaataaatataagggtcttaggaaactccttcagagggggagaaggcagaggaaaccctctactcttgaactactcctctttttcttgagacaggatctcactatatttcccaggccagagtgcagtggtgccatcgtggctcactgcagcctcgacctcctgggctcaagcaatcttcccacctcagcctccctagcagctggaactaggagtgtgtgctgctatgccaggctattttttttgttttgtttttggttttggttttttttgtacagacaggatctcactatgttgcacaggccggtcttgacctcctggccttaagtaatcctcccacctcagcctcccgaagtgctgggattacaggtgtgagccactgtgcccagccttgaactactcttatgttcatgtcaaaaaccttacctgacctttacatccacaaatctgtcctgcaagatgtatgtgtatatgcacacacacacatcaagagttgaggatcatttatatattcacatatttttttactcatatagaactatggataaagagtttgaaccaacataaaaagctcttttattttaaaaatgagattaatgaaacatcctgataattattgttttctagtcttttgatggtagctcatataattttgaatgacaaatatgctctctctttatttgttttatatgtatacatggtttctgtgccttagtaaaaatgccaaccaagtttatttttttccttctttgaagaatttttgcagagctatgaaggaaatatagaaaataaaagataagctactacatggaataaaattcataaaaagcccttccctagtatttctccaagtagcatcagctgcatatttctgcagagtgctaagttgatatttttgataattcaaggattcgagccaccatccagtttcattctgcagatgtaggatagtttaactgctcaagtaggtcataaaatacaccatttataaagcacttaggtacactgtaccatgcaaaggataacatgctaaaacaaaagccttttttaaggagtttgatattaaaagcatcacaatgcaattattcatcctcaaaggtctgtgttgcagaattcatggcttagattagagaatatcaaggggcagcactccgaagtgtggcaaattgggggaacttctcctagcatattgcacctcatgataactgaaaccaagtgcagggctggctatttgctattctatgtagcagttagacaaagctaattagcaatattgtgcttagtaaatatgtttcaacatacattaaccgattatccatcggtgaaatattgcacaattaattttataatataactgtcaactgcagagatgatgggcatgattcggagcaagagcctaccagaggctgtttctcagccttggtactgttgacatttggggccagatgatgctccgtggggctgtcctatgcattgcaggctgttttgcaacgtccctagcctctatattctgaatgccagtaactcccccactctctgtcccacccacgttgcaacaactcagaatgtctccagacattgccacacgtccactgcggaacaaaattgccctggttagagttactgtaattctcaaattgccgatttttacgttagtattttaaagcaccccaggtcattggaatttgcagcctagcttgacaatcagtgggctattcttttgcaacttaaagtcagacctaccaacccggaacatcagcaccatctgagagcttgtcagaaatgcagattcccagacctacagacccagagtctgcattttaccaagacccccaggggatttctctgcacatggacttttagaagccattctctggcttgtacagcctcctcttctcagagaagtctccataattcccaggtcccgttgagcagacagtccaagcaagcagatacaatggttgcacctcgtcaccctcacaacctcacagcagactggattggggaagatgcctgacacggtggatgcagtgggtggatgcagcatctatcagttaccaggtaaagaactaattaaattctctctagagagtttttgttactgacaagggctctagagactgtgttggtttttgttgggagacaacgagattgtgttggttcttgctggaacacaacaagaagtaaatacttggggcaaagctgaatgacctgaatggcagatattgacggaggaacctctcctgctcaggtcttggctatctctgctctcatcttttttcctttggttgtttcctctccctggttcagagattttcctttgcctccaggttgcccttggtgcccagctgtgggcgtgcagtgcatcagctattcttgggttggcccaacccttgggttgggttggcatcagctattcttgagttggccttttcctggcaagaaattatacctgtgacaaaaatgaaaatgtgttttactttaataaagttggaggatggggatgtaaaataatggtaccatactgtatcattaagtttataatgcagattctataattgcacattgtctagtggttgaactcttatgaagagccatttgatgtttaaagaggcataaaaataaatacctactttgctgtctaatattgttgtaaaagatacatattgggaaataatccaaaataaagaaaaggagaattaaaaacaacttgagtgttagtaagtaaatgagtaaaaaacttatattttgtcaactgatagaaatatcatacagccattaaaatgataatccctaaatttgtataacaacattgaaactgtttgtgtcaattcagcgacaaaggcaaaaacaaaattttatccatggcaggcaagattggagctgtaaaacgtgtggatgcataaggagaagattggaatgaaacacaaagagtaaaatgtgttgatttaacatgagatggtgcacatttttagatttttgctttcataaagttagatgattggtaaagatgtgcatgtgtttctgtcacctctatcatgtctatcacctcttgtcatgtctcttgaagtgtagtgcttcttaaactttccctctatgtaggttgaaaaatccaggagaccatagatacactttaatgttaaatgagcacgagatggcacgatttttagttgctatcttcttagctagttatttttcattccactgtaacagaggtgttttcaggtatacctaagtgcaagaatgataactactttgtctataaaatttgaagtgtacttgtctataaaattttaagctttattttaattaagaaaagagcagctatgaggagcttggctggggctgcattcagaaccttgctgcagttattgtgaactgttgtggacgcttacatgaactctgtaagtcttgctttgttgtccataaaatggggatggccacagtagaactggcgccaaggtatttgttaaaattaaaggggccatttaaataaaaagcacagtgtaatgcctggcaaattattactatggaaagcatattaattgtctttgttgtttctatcttatgtcaaacagtagatctgtgtaaggcagataattatatggtcaatgacttacattttactatattttcaatcttaatattttattatgatctataatcattcctatttgactatcacttatttttattaagcatcaatgcattcctaataaacttcaatattatcaagatgatttaatggaaatcatggaagactgttcgtttatacttaaattagtgtctacaaggcacgcagacaaaactattagttaagaaggcctgattgaaaagtacaacccattttttattacttttgactataatacttttttcttaatttttctattatgacatttatatgacctaacctattgaaattacttcctgacaccagcaattcacatctttcataacttttggatgctattgtttctccccctgaagtgtgctactgtcaagatgaagccactacagtagtattcagtatgatggcacattcttatctctggtcaaatagaattttacaatctgtactctggcagtaactgcaccatctcaatctaaatctatttgggttattcttaatatattctcagtaaagagaataagatagttatgtattttccttcaaataattaactttaagcaaagctttcaccaaagaggatttcattagataacagtgttaactctgcttactattagaacgcatccctgagcttataattgaagtcatcaaggaaacaatgttcagctaactgaaattttatgtagtaacacccagtggaagtgccatcacattcattaatgaaaacatcttgtgctacttcttgggcaacagctcccattgagtctgtcttgcttcactgtgtcttgactgtgtcttgaagggaagtgttatctactgtttgcttcagaccatcttttcaaggatgtttgtgtagcaaacagttttggaaagataggctatactatcttcttccagagcaaagggccagaatgtccaccactgcattagtctgttcttgcactgctataaagaaatacctgagactgggtaatttataaagaaaagaggtttaattggctcacagttcttcaggctgtacaagaagcatggtgttgaccacctgctctgcttctggagaggcgtcaagaagcttacgatcatggcagaaggcagagggcattcaggcatgtcttacatggccagagcaggaggaagagagaggggggaagtgctacacacatttaaacgaccagatctcgtaagaactgtatcacaggaacagcactatagggatggtgctaaagcattagaaattgcccctgtgatccaatcactccctcgaggctcctcctctaacactggggattacatttcaacatgagatttgggcagggacacagatccaaaccctatccactaggatccttaagcatgggatgcctcttctgtaacatatccactgtatttgtaggagtccatttcagcctatctgcttcagactggtgggacctcgatgcaaacagagctaatgaaaatgtgatgcttctgcttctttttgtgccatgaataataatctgttctttatctctgacccaggagtctcatgtctttggctaacccctgtaaccttgtggcaggctaactagtaagcttgcatgtagagtaaaatctcaggcccttcacagttcttgatgtgtgtaggtgtgagcatccttaggcataagttgctaggatggctcttgtgaggaaaaaaaatccatagaatttaaatttagaatggtttcttgtcagaatagtgtttgtgctctttttgcaaagattttcaaatccactcaatccatgtagttttacactagctggaattttagttctaaccattgagaattattttttgggttctgtcttagtccgttttgtgttgctataactaagtactgagaatgggtaattaataaagagcagaaatgtattttctcacagttctggaagctgggaagtcccaggtcaaggcaccagcaggttcagttgtctggtgagggctgcatcttccagaagggaggatcactgtgttttcacatggcaaaaggcagaagggcaattgagctgaatgctacctgcagcttcttatatgagggccttaatcgcattcatgagggaggatccctcaaggcacagccaccttttaaaagccctactatctacattggtagtgtcgcattggttacacctgaattttggaggaaacacattccaaccatagcaaattccctgcaaaaagttacgtgtgtatgtgtgtgtaggggtgtgtgtgtatatgtgtatatgcatacatttgtgtatatatatatacacactcatatatataatttttatattttatatcttataaaatataaggatccattttattttcttctggatgctaacagaaacattcttaatcctggctgcacattagcctgggagaggaggacttctgaacaatcccgtggcaccaggcgtggtgactcatgcctgtaatcccagcactttgggaggccgaggcaggcagatcacaaggtcaagagatagagaccatcctgggcaacacggtgaaaccccgtctctactaaaaatagaaaaattagctgggcgtggtcacgtgtgcctgtagtcccagctgctcaggaggctgaggcaggaggatcacttgaacccgggagacggagattgcagtgagctgtgattgcaccactgcactccagcctgggcgacaagagcaaaactccatctcagaaaaaaaatcggtagaccaacccaccaaaatctcttattaaatcccataagaccattttaaatatgttgccaaatttaagaaccattggcagaaattcacaaaatgtgacagttttccttcttgtcatgtctcttgaagtgtagtgcttcttaaacttttcgatgtggccaaatcacttggggatcttgtaaaagttcaggttctcatctggtgggtctgcaatgggtacccaataatctgcatttgtaacaagctctcaggtgaggccacggcttctgattcaaggtctgaattttgaatagcaatgtcgtagttgttattttcataaagcaaaagcaaaacaatacagaacaaaagaaaatgtaacccaagcgtcaagtgtttcagctgttgagatgcagtacatgctctttgctttttcctttttttttttttttttttttttttttgtgacagagccttgttctgttgcccaggctggagtgcagaggtgcattcattgctcactgcagcctcgacctcatggactcaggagatcctcccacctcagcttcctgagtagctgggactatagggcacaccaccatgcctggctagtatttttggtatttgctgtagagatgcacaggttgatctcaaattcctagactcaagtgaccctcccaccttggtctctgaaaatgctgggattacaagtgtgagccactgcaccctgccatggtacatgctgttaaaacaatcatttttttgataatactagtgatctgaaaactaaggtatggaaaaataaagaaatactgctgtcaggaaatcagcaaactgtctctttataaaatacactgatttttgccactgaaatcagcatttgctacagaatgaagcccatacaattagaattttttaagcatctgaagcccccctgcctggccttggcatttatgtagctgaaagggagcattactctaaaaaatgctttctttctgtagcacatttttcattaagaccacgttgtcacttaactcatattgcttaagaataccatcctggagacaaaaacatttcaaaggaattgtaccatgacattcctaccatgtgggtcattacaaattgccttgctgtggtttaaaagcagaataatttaaacagaagcacaagtacaagctctagaactatcttcccagtagggttttaccctgcagggtacaagcaataaaaacattgagcacagagatggaaataggctgtggctcaaatcacacacacacacacacacacacacacacacacacacacacacacccctcacattcacacctgtttccctttcttgctggaggtgaaaattggaatgctattataagcttgtgcagatgactataactgagaaatcaggcacatcacagggaaatcattgcacctacagcctcattctttttttgaaagctggcagggcacatgcaatataaaatgaagggtgagacagcatgtctccagcaggacagaaaaggttatggggcactgaggaagtatgggaaatgctcagttgctctcagaaacaaacaatgaaataaataaaaatactggaaagagagacagaagcatagttgtagccttaggtatgggtatgccaaaacacagggagtaaataataaaataaacatgtgaacataaaggcatctatgtgtccccatgtgtgaggtgtgactcaagattggactatagcaatggcagaggatgttttgttcaaaagctagatagatatgctgtcagatggtagtgtcagactatacactcggccagcataaaaattgcataaatctatgaacctgtaatggaaaccacaacacaatcgatcagcattgaaatactttgagaggaggacagtttggcataataggaacctacactgcaggtcaacatccagggaggatatttggaaagtgttttccaaacaggtaattacaagacatcttcaccacaatcatgagcaatagaaagctatttcttgtgactaatgtagcataagacaaattctattttgatgaaaatttgacaaaagacaatgaaatgaagtaatattacctgagcatatacgtatatgtaccaggggtatttaaatgtgctgcttcctaatttttacaaagccttatggaaagtcttcattttatagttcgagcaacggagactctgagagcttaaataatttataaggtgcgtccagatggacaaagctgggaaacaacctcaaggttgattttttttttcttctttgaagtatcaagtgaatttacccgtacacacccactgcttgactagactaagatgttcaaaggagaactatcattggaaaaaggaaagaaaaagaatagcaaatgaaagttttatagcaaatgaaagcagccatcctcactgagaatctacctcttttccggagctatgttttatgatgagaatttgtcactaatcctccagaccatggtgagatttaggaatcactgttctgagtttgcacatgaggaaactgaggataggagtggaccaggtgccctggtcacacagctagaaaatggccaagccccctcctctgctgccacctagagaggttgtccactgccttccttctcactctactgtttgagctccatgaaaccatctctttcctcttcaccttgacccttttcctccagagaacacacctcactctaagtagtcaagcatccataggccatgcctctgtgttacttcatcatccatccccatcacccctcaccagctctgcagaggaattcaaatgtgtgtgtttcgccatgagcagctactgcttttcttttctctttaggtgccctctctcattttgcaagaaacaaaacaatttaacaaagcaattgttaattactttgggaccctgcactcatccatcctctggtcctctggcagatttggagactcagttgtaataagagtgagatggccaggctctgcttcttcttttttttttttttgtccaacatcatggtgccgctcacaggtgttatcaacaagaaggtagatgtgatgcctgtggcagattggagtctttaaatcctttagatgtcatcaagtggactgctcatctggctaggagtcacagaattcaatgcaccatcctctgcttgatggactcatagagggtccctgcctttctatcaggcagctttctgcttcatttttctttttatcacactgtaatatcgggctgactctgaaagtggtctataattctgttagcgatccttctgtgtttctatacaaaacattcatgtccagaagcccctgaattgagatattgtggctgatcagaatagaagaagccctagggccctgaacatggagcaaataatctgctcccaagcttggtcctgaatcaaatcctttgacttgaactaacctgcgatgcaagcttatttgactgttgtcatcagaagggtttcttcggcaggtgtgaggaacagcatggaatatcattctaccctaccaattggagcaaattgttatcacatgactcagttattaaatataaaagaaagaggggagagaagataaaattggttacaaggttgagagttgttatttcatgcagtgactctctttggactcttgctaagtaaaatatgagtaacaagtacaatatttttgttttcaataacctccagttctctgaaggctgagctggctttctggtgccatcttgaaggaggatggaatgtagctgaaatctatgccagagagtaaatgaagtggaaaacctgtgccttcagtcctggtgcaccttgaaacaaaaatggagagagagtgtggtgatcacagagcaggatcctcatttcccccacttattttgggatggagctacataaacattggaatggcataaagatgctgtggaaaattagcacctgtgtctctcatctctgctggggagatgatgaggctctcagagaaagccaagtcttgcaaaggctcatgatctctcatggtttgagaggagtggggagatgttatctgagggcttgatggtctgggggttgggaattgtagctcacctgagccattctgtgacatgtagtggattgggaactttatgtatatgtgaatgtggagacacaggagtgatgactaggaggtcaatacgggagggaaagttgctatatgcaaacttggaaactagtgaaacatgactggggctgtgagcttcagggtaggatgctggcacattcccccagcaggatagattggaaagatctaacccagtccaggaaccaaactctacaggttcctctatggcacagaagagtgaggattcatggcacccacaaggttttaagactcccttcttcccagcaccctaaggtcatggtagattgcctatatacatagatagtatcatggggagaagtatagggcaataacaaaattagcaactgggtattgacccaggagtcaagtcattcaagagactaaacagaagaaattgtcacactctgaattggtgggttgaaagtttgtgattatcccacactctcattgaggtgagaaagattagccaggtgtggtggctactcaggaggctgaggcaggagaatcacttgagcccaggaggtcaaggcttcagcgagccatgatcatgccactgcactccagcctgggcaagagagcaagaccccagcactaaaaaaaaaaaaaaaaaaaagattagatctacttttaaacgcataaaaagcacatgttttctttgtgcatctgagtgtagaatgagagcattttcaactgaagactactaaaacagaaggcaggaaggcaggttcctcatctcactttctgacattttatgcaaaatataaacccactaattgttttttcaataaagctttcaaaataacattgacatttggatcattttcagtgagaggttgaagagaatttaagttttattcatacactgcagtcccaggggaagaagggtgaccctcaagataaccacaggaatcatttttttctaggctgagaagagagtggtgaggcttcctgagctatttgtactagtttacccttaggtctttcagctagctctggacaatgaggttcccgcacggtctgatagaaacaccaccatgctaagtatcagagaacaaacttaagagttgcattattaaaaacatattttttctggagagttttaccaaaatgaaatgtcttgcttctattggtcttaggagagatctgactcatgtaaaaacatagggttacagaactttggaaatacagccatttatctatgcatatcatgcttgcacacagatttctttcctaggatgccattttaaaaatgcacattttgggtaaaaaaataagctgtcacatatatagacttctcctagtattcggcttaaacatgtgatgatttgggagggtcgttcatgtccctagtggtttaattgctaagagaatctttcccgtcctccacattaacagttagaaacaaaagccctttgtttcaccagatatgtgcttgggaaatggtccattttaaccacatcccatctgtagggccatgtgcaattttaagctttaataattttagatgaacacaggactgatgcaaatgccttattaatgttcactcatcagaactcaattctttgaaggaactcagggtcgagtttggaaactcaatttactaaattgcttagcaacacccagaaggcattttcaccaagttagaaacttataaacctgaaacttggaaatttcagaagaatgagtaaggcattcactcttaatagaacttgcttccacgggtcacccatctaccaaataaataccacagacaaaacaatctacctatataatatttggggagttttttgacatattgtgtccaaaaggcatgtgacaggtatttttgattgcaggagaataaagagaggctcactcacataaagttttgagtatcaaagttatatgttgtcagtccatagtgataaaaataaataattgaataaatagacaaatggagggagagagaagggcaaatcttctttgcagaagaattccaataattgatatagatactccatcctcagaaaggtgcaacatcattttccacaccttaagcgtgggctgtgcttagtaacttccagtgagtaaagtaggggaaggtgggaaaagtaacttcagagtggagaaacctgacaaacactacccgaggttgattaaggtcaacctccagagtgataagtcatgttgacagcatgtacctttaatgagatatgatgaaaatggcattttacttctatggtcttcatgcccaaaacctatagcctttgttgaatcataattaaaacatcagacaaactcaaattaacagacgttctacaaaatactcacccagtacttcttaaaactgtcaagatctgaaaaataaagagagggagaaaccgtcacagccaaggagacataaaaactaaatctaatatgaaattctgaatgtggcattagataaaaataaggaaatctggataaactatggacttttgttaataataatgtatctaccttggtttactaattttaacaaatgtgctacactaatataagatgttaataatagggggaattgaatgtgggaaacatggaaactctctgtactatttttgtaatttttttgtaaatctaaagctattggaaaattattttaaaatgtattaaaactatttggaaatttataaaaaagatttaagaagttgtatgctgtctaatatggtttggctgtgtccccacccaaatctgatcttgaattgtagctcccataattcccatgtgttgtaggggggacccggtgggagatacttgaatcatgggggcagtttcccccatacagttcttgtggtagtgaatacgtctcatgatatctgatggttttataaggggtttctccttttgcttgactctcattttctctcttgcctgcccacatgtaagacatgactttcaccttctgccatgattgtgaggcctccccagccatgtggaactgtgagtctctttttctttataaattaccctgtctcaggtatgtcttaattagcagcatgaaaatggactaatacactgccaatgtgatttttaaaataataagtgttttctgcaaacagcagctcccatctgatgtccttcatctcagaatgtcctcttgttccagagtggatctcatacatcccgcaccatctcttgtaggattgccaagagcttttgcttatttaactgtcgtattgttcactgggttggcacgcgtaattcctgtgtttgctactatatgggatactacgctagtacatctcgtataaacactacttcttcacttgacttttgttggcacttctgttttggtactctatgccttctgccttaaatgaccccttcttatgtacataaatctctctcccacctgttttataacgtccaagagagatatattaatagttacccatccttcctccttccatggtgtctagtgcaattcataactagcagcacagtgggcatggcacgtacttcaaaaatacttatgagtctgcacaattaatttgaggatcttaaaacatttccagaaaggaatggcagttctgaatccttggagatttcctatttcactttcattattccagctttttacttttagaactctttcagggagatagaaaattgtcagcttattcttaaagatattcagagaaggcagttctaccagcttcagcaggagtctgtttcagaatattaaaactaactgtatcaaaagaaacttttcttcctctttcacctagttggtgtcttaggccacttcccttccctcagcccacgcacattgttttcagctgagataaaaatatagctgagcacagtcctatgtggatttgaagatcattaagtttcttcacagctttctttttgccagaacatgatcatcttaatccattttctatgcaggtggggttttttggtgataatttgtttttggtgattaagaagttgtatgctgtttggtatggcctttttttggtcattaattttttgaattttaaaaatttatcaacatctccattgtctttgatgtctaaggtaaaaatctgagaatactactacttgattaaaaaaattaaaataatattaggaagaagaaggaggaggaggaagataaggggatggagaacgacaagaaggaggacaaggagaaagaagggaaggagaaggaggaggaggaggagagagaagagaggaagggagatggggaggagaatgaactactaaagctatgtggtaaaaaagacattacttacattaaacatttattatttgtaactgaaaatttactaagttacttaaaaaaattatgatctgcagtgatcttcttgatcttagccatgccacctaatcttccaaagccttgtttcactcatcactcaagtgaccttgcaccactcaagtgaccttgcgccaatatttgtcgagtttgaatgacaccactaaaggtctcggccctccaggagaaaggtattgtgggcaaggatggaatgctgcatgtggctttgagtatatttcttcatacaggggagtcagtcttaatatttcatggaagcgttgagtaagtagagaatagggatgaagctgtatgtcctctgagctatgccagctctaggagagatagcagcacatcaaggggtggaagtgagaaaaatacttacagattttcatcgtcagctttcaggcaacactagcggcaaaggtaaccaacaactctgcccaaagtcagttctcctaaaaccagattttctaaaatttaatccatttttaaaaagttaacctaaaatccaactcccttatgagttttttttgtctctgaagcaaggtggtcattataaaattgaacttcaatgtattttgatcttctggtgaggaagacattgggcttaacactgcccaacctacacttggttgatattttaggcagagcgtttcaaaagctttatggtccagatattgagaaatggctatcaagagagagaatgttgcaattggcttttgagcatgaccacatatttttacaaagatgtagagctaccctgaaggcaatagatatatccactctcaatcattctgagaagagattcctcctgaaccatgaattaagactcagggtaggccaggtgcaatggctcatgcctgtaatccaagcactctgggaggccgaggcaggtggatcactcgaggtcaggagttcgagacctgcctggccaaaatggtgatttcccatctctactaaaaatacaaaaattacccaggtgtggtggcacatgcctgtaatcccagctactcaggaggctgtggcaggagaattgcttgaccttgggcagtgaaaattgaagtgagctgagattgtgccactgcactccagcctgggcaacagagtgagactctgccaaaaacaaacaaacaaaaaaagactcaaggaaacggtctgagatgaggcaaaggaaaacatttttcttcgggacaagagttcagtctgactcagactctgagaaatgcacaatgcataaaatattttcagttgttggaagatgaggaacatcttgctactggggtgcaggcaaggttattggcagggcgttgagccagcaaggggcctttggctttggataggcgaggttaacacagtcagtagttataagatgttttctattatgtaaattccttccattatttctgaaaacttcattcacttcctgctaatgatttcagcctgatctcagtggctccgtgttgaacttagaaagggtccatcccctgccagagtgacacacaagacaatctttccccctacctgggacaaggtgacaggagcaggagggtataaggaacaaaccatattttagttagcaataccctattgtttcaaatattttattatccataatattgcaaaaaacatccttacaatcaagtctttcttcacgtcattgactatctcctgaagatgcacatgacttttcatgtcaaagggtatacacagttttgaggcttttggttcttgtcccgatagaggcagcagaaacaaaatggtaaataagaaaccaattgatctgttcttgagcacacctgagccagcacctgggcgcctcttagaaatagctgtgggacaccttgagagaggttaatcttgagtaactggactgatggaaaataatctatcacaatgatatcatgaaatagaattagctttgttgttgtagtctgtagcacttttattaagatgtagtcttagtcatgccatctttttagcatttcaataatatttgtttattttgtataatattcaatgtgtgtatatatttgtgtgggtgtatgtgtgtgtgtggttgaaacacaataataaaatgaatgtgtgtgaacctactactcagttcatcaatgaggacattaccacaactaagcaatctattgagtattttgctcttgagttttatgaaaatatcatataacatgtactcttctttaattttctttttgcatttggcagtcttaagatagtctgttttgttaatgtaaggatagttcacttattttcattgctgtaaaatattccaccccacgcatatatgttttatttatcttattcctgttgataaccatttggatttttccaaattttatctactataagcaatgctgatttgacattctttttcatatcccccactgcacctgtgcaagcattaacgtgaggtatattcctcttaggagtgaaatcgtggagtcatttgtttgtgactattcaactttacaagttagagacacattgttgttcaaatagctgtgtcagtatacaccctgattgccccaatggtatgtaagagttccagtggaaacacatcttccctactattcagcattttcagtcttaagttttacccatccagtgggcatgcatgagatctttttaaaaattaccctgaacgccttttcacatattaatgagcattttatttcctgatctgtgaaaagtctgttatgtgtttgtccatttttattctaaattgcttgtctttttatttttgatttaaaggaactctttatatgtctcggacacttacctattataaattattagatttgcaaatatctgtccttcctcctccccacacacactttatgatatctctgatgaagaggagttcttaagatcaatgtggttatatttatgaatcctcttattcatggtctgtgcttattgtgtctttaaaaagtattttccctacccagggaaagatcatagtatgttttttaataaaactttcttacagtcttgtctctcactttcatgtctttcatctatcaataatgaatatttgaaaagacataagaagggaagtcttgggccctttattttttctattgattaccaattgttacaacacattaattgatgagaccattctttagttgagaatctgcaatgctgcctttgtaatatatcaagtttctatacatgaaatggtgtgtgtctggatcaatatacttgtctgttacaacggtaaattcgcccttctgtgaatcaacactttttactggccataaaatgcatttaatgtttcattaatgtgtttcactgtatagttcttgcatgttttttaaaaattttatttactactggataccatgtatctcataacagtaattttaaaatatattttgtttgtttctaataagtttaagtgcaatataatttttatattgatcttgtgataggccaacttgttaaattctcatgtttgttcagtaattgggctgtggattatttggcgttttctatgtagcaatcattttatctataattcatgacatttggggttttgttcaatacttatcctccttttcatttatgcataaatttatttctttatggcatagattatggccttcagtgcagaatagaaatagaattgtcttacacttgctatgaactgtagatttgtagcagtttattaaggaaagatgtttactgggcaacatagcaagaccccatatcagaaaaaaagcaagcaagaaagaaagaaagaaaaagaaagaaggaagaaaaaagaaggaagaaaggaaggaggaaggaacgaaggaaggaaagaaggaaggaacgaaggaaggaaagaaggaaggaaagaaggaaggaaaagattagcttgatagacagaagatacttctgaaaatatagaaaagcaatttggcaataaatctttataaaatatggtgcattttatactttattagggcatattattaatgatttaatgctgaattatgaagcagactgtttccacattatagttcctaatattgaaatcaactggctgttagcagtaggattgagatacagcacacacaacaatttatttatctaataccttggatgccattggtaaatatcagttgctagaatcacaaaatttcaaaaaatgttttttaatataaatttgctaaaatgtaatgttagcttgaagttcatacaagcaacacagctttccagggagtaacttgctccataaggtgagtgagagcccaaggtgttgctccaggtagctgtcggtggagagctgtggggtaaaataggcttgaaattgaagacagcaaccagacacagcctggggttgagcctgctggatgttatctactttaccttggggctacgttgtgtgtgtttattgtctggctttcccagctctgctacaataagctttgttagcttctgtgacacttacacaataatctctatgtgtgaagcccccaaagtgactttctgaaaagagttcacacagattgagatcggatgcagagcatccctccccagcatggcctctgctgcaccctgatgtattcacactcaccatgaagggcacaagtgccttttgatcttcaggaggagaatatgatcgccgaacaggttttcagttgtcacaccctacaatactctaattaaatggtcagcatgtgcctcatcagggtatccactcaagtaatctatttattggattattttaatatgtcagagttttgttcaactcgaaaatggccaatggttctccagaaaggcataagagctttgaatgatgcccccctttgtgtaatacatctcttcatgtaatatataattagcaataagaactctgtttatttataacagtaaattatttatttccaagaatcgagttcatgtgatttctaattcacgtcatcttgctatgaggaatggaagtctaatatttagatgggggtaaggcacccagtattctcatgcctttttgcatcctgaaagatatcaccatagtgtgcatttcagggtgaaggtgaccaccacgaccattcccttggcaaagagaaatgtccatttattttgtacaaagagaggctgaaatgtagagtccatgaactttcttctctttgtcaatgcaaggctcttgtttcataataaaataacatattcaagaaaagaattgtattgaaatgtcactctcatgtggatttcatgaggttctgaacttaaagtcttcaaaggaacagtggtactgtcaggtactcaggctttgcctttagatcacatggtttaaaagagaaaaaaaataaactgccagtgaacataggctctgacctctcttcacttttcatttttaacgcctttaaaaatgaaattatttgggtttaatacatgcataatttggaaatcccataatttggaaataacagaagtcatgtgctatagacttaatgtttgtgtctcctcaaaactggtatgctgaaatcctcacccacaaagggatggtatttggaggtggggtctttgggaggcgatgaggtcgtgagggtggagcctcatgaatgggattagtgcccttataaaagaggccgcagagagtgccctcaccccttccaacatgtaagggcacaataagaaggaattgactttgaaccagaaagcaggttctcaccagccactgaatctaccatgccttgattttccagcttccagaaccgtgagccataaatgtctgtttataagccaccccatctgtggtgttctgttatagcagccttaatgggctaagacaccatggatggaaaactaatcctattgatcatgatacaattttttttagagtaaattagggttttgaggctaatactttttcaggacctattactgattatttaatattgatgattaaattaggaagtaggctgtttccacattgtagttcataatactgaattgatcatttctgccaagcattttcctaaggaaaaacagtaaaagacagaaaacattataggtttctgtcctaagagctttaaaccagagaaagtcttattcctattaattagcacccccccacgcacacatttttttgactatgatcccaagtttccgggctatttgaatgtatacaattttctattaaacaaaggtctaatttaacttctcactaggcacagagtttttcctcattcttataggttaataagaagtggtgatagaaactaacatgagaaattattatcagatgtgagacaaacagacagaatgatagagagagagagagagagagtgattctgtttttccttttcttctttttctattttttttttttttttggccaggaactcagagctcagtccttagcttaaaattttaaaatataaatattcttcccccttatttttacttcttacttaattcctagtggtatgggatttcctttattcgaatcatttgatagcgagcattttcaaatatttgtattataaaatattaaagaatacaatgatatcactttacctgatatatcttacttaaaaaaaaaaaaaagcgactgaatctaaccttcaaacactcaagaattccggaccaaacatcagcaatccttttctgtaaagggccagagagtaaacatattttggctttgcaggccatatcgtctctgctttgcctactcagccctgctactgaagcatgagaacagctgtaaacaacactgaaaccaatggatatggatgtgatccaatgaagcttgatgcatagacattaaaatttagaattttatatataaaaaagagcagtggtgagggagatgcaacttctgaccctcgttgtagaccacaaccagtgtctaagttgaacaggtgccctcagaaaactgcatccagccactctagtgttggagggctctggacaattagaagaactgtgtatcctgtgtatgtcctgtgtatttacctcctgtgttgttctgtgtatttagactgtaagaatacctttgtctgtgcttggggttgggagcataggggttatatgtactgagactcaggtttgggaaataaatctcatatggaataacacagataagctcattatatcaagttgggaatccctaaacttgtattcaagaatgctgaagggacagctcaatgattcattaaggtgatgatttttctcataaaaccaaaagattgtttaggtttacttaatgagatactcattctgccttatttattttttaacatatgttttatcaaaaatacattgtttttatgtattttttgagaaatgttttttaacagtctttggccagaagttgttgaattccaccagacccaaaatgctaaagctctccaattcatgtttactctgccaccctcagacatctgctttcttctcctagcccaagaaactcttcccaagtgtcaccagcaactgcctgatgactaaattcaatgatctcgcctcaattctcaacatgtataatggaataacagcgacaggtccatgtttggaatggagagaggagactataattattatcattttacatcttgattggaagggttggtataatgtttttcaaataattgcctctgatcatcaaatacattgtttaaagattacacataagccttttttctctacttcacaatcatgtatcgattattcactgtgtatgctacacattgtggctgggccctgcagaaacaaatatgtcttctgttctctcacacataagtaattaacattgaatatactcttttcatttatttgagctgcattaaaatgcatttgataagctactatatccagttttattattataccaagagttttaaaatcattaaccattcatgtctgccgtgttcagaagccacggtgaacactttgatttaaatgtcagagttttgaaaatctccaaattatatgttcaacattgctttagcaaaatgcattttagagttataaattaacatacgtatcaaattgtcaaatacgttaactgcacacactttcaattaactcaccacttaaagtgtggatatgatatgaaataaatgaaagttgataattttaggattcattttgcaatgtgattataactctggcatttagacccaggtaatagataattaaataccaaaacatgactaccacatacatttaatcttgcaaattaactcacagaagatagcttcaaacgatgattgcatcatctgtaaatgactgtaatccaatttcataaatattgatgatgtttcaaaatttgaaatcattactagtgttgaattttactacattcatttgcatttccaaaattaaaattcttctctggaatttgggaaagttccattattaaagtgccccaaaataggtcacatgcaataatctaggtgataagaaaaaacaggcttatgcacagaatattcttacatgcattcaacttgatttgtctctcaagtttgcctgaaaaatctgtcttttgacagcctgcagacatagcctgagacaattatttgctgcaagcacacattcagcaatccaaacaaacttttggttatattaaaatagcaatcctcttatcacaaacatcagaactgctccctcgaaaaagtttgtacagagagataatggggccacaaattctgggagcataaagaggatggactttaatcaacctggcacctaactcaaagctaatatgatgctgttttcataggctgtaaagctatttgaagaaggtaactttcctctcacttaactttaaaagcacatgatttttgtgctgtaaagggtttcatttggttggtgtgtgttgtaagaagtttacgtttttattcgttgcacatgggatgcgacatctgatggagactgcaatccttttacggctttattgcaaagctggagaactatcagtcaagcgttgcctaaagctttttggctctagagttaagaaagtgtcattggataatgtctttagttctgtcgatattagacaattaccatgtattgacatttttctagggagagtcaagggagaggggtagtgaactgaatacattttattttgcaaatttaatgaaaagacttagggatccttactgctgttctttggtagaactctcatatgcatccatttatgtatgtagatatgtcatgaatttatatagccctaaaagaaaagaatatcagacttagatcacttccatttgagctttaaagctatgatagattttgtacaaacttgagcaaagactaagcattcccatctaagttggaagaatccagctgtgtggatgtacacgcatcagttgctgccaatttgaggacctgctcccacccaatcattttacccagacttgcaccagaaagaacaatgagtgactgcaaggaattttatccaacgaaagatgtaacatatgaaactcaagctggtttgcagcaaacatttcatactaggagaaataatgtagtacttgacactctgggtccaattgtgcccagatttggaaggatatgacctgattgtgtaagctcccctaataatgttggaggtgggaggatcacctgagcccaggaggtggaggctgcagtgagctatgatcacaccactgcactccagcctcggtgacagactgagaccttgtctaaaaaaaaaaaaagagtgtagcagttattagtattgcctatttcataatgtcataattctttgtgggcattttcttttttattttattttattattatactttaagttttagggtacatgtgcacaatgtgcaggttagttacctatgtatacatgtgccatgctggtgtgctgcacccattaactcgtcatttagcattaggtatatctcctaatgctatccctcaccccttcccccaccccacaacagtccccagagtgtgatgttccccttcctgtgtccatgtgttctcattgttcaattcccatctatgagtgagaatatgcggtgtttggttttttgttcttgtgatagtttactgagaatgatgatttccaatttcatccatgtccctacaaaggacatgaactcatcattttttatggctgcgtagtattccatggtgtatatgtgccacattttattaatccagtctatcattgttggacatttgggttggttccaagtctttgctattgtgaatagtgccgcaataagcatacgtgtgcatgtgtctttatagcagcatgatttataatcctttgggtatatacccagtgatgggatggctgggtcaaatggtatttctagttctagatccctgaggaatcgccacactgacttccacaatggttgaactagtttacagtcccaccaacagtgtaaaagtgttcctatttctttgcatcctctccagcacctgttgtttcctgactttgtaatgattgccattctaactgttgtgagatggtatctcattgtggttttgatttgcatttctctgatggccagtgatggtgagcattttttcatgtgttttttggcagcataaatgtcttcttttgagaagtgtctgttaaatggtgctgggaaaaatggctagccatctgcagaaagctgaaactggatcccttcctttcaccttatacaaaacttaattcaagatggattaaagacttaaacgttagacctaaaaccataaaaaccctagaagaaaacctaggcattaccattcaggacataggcatgggcaaggacttcatgtctaaaacacctaaaagcaatggcaacaaaagccaaaattgacaaattggatctaattaaactaaagagcttctgcacagcaaaagaaactaccattagagtgaacaggcaacctacaaaatgggagaaaattttcacaacctactcatctgacaaagggctaatatccagaatctacaatgaactcaaacaaatttacaagaaaaaaacaaacaaccccatcaaaaagtgggcgaaggacatgaacagacacttctccttgtgggcattttctgactccaggaggcacagattggcaacaccaggcagtgagtttgccagtgaacctcaaccagtgactgctggagttggcataacatatcccagctccgtagtccctcagcttggtcaactttgaggcatgttccagtctcttgggacactggacccttgtcctctgcaagggtgcccgcttttgaacataccatttactgatttacaggcttttctcccttccctgtgtcatctctccaagttctccttgggaagaatcacctctcacataaatgatgtgcattctaagccttgcctcagagtcaggggtaagggcttcattcagggaagttaaaacaaacacattgtgccctcgatggaaaattaagaccttctggattcagtgaaccacgtgaagacatccagcaagtgctaaaactgccacctagcaactttcaaattaacacctggctaagaaatgcatttgattaattgagaccccgtgtactgtccacttaactacacaattctattaaatgaagtagaatgatgatatcactttgatcctgcattttgtatgaggaagtattgattcaagcctctgcattgttgcctaaaacacacatacaaatacatattatctatatatagatatacatagctactttgctccatggagcagcacctgtgttatctaacttcaggtgtcacatatttgttgagaaaatagtgggctgaaaacttaatctgggctgcagtattaattgttctgattctatgaaccaagcaaaggtgatccatgttctgagtttcaaagaaacttctttggaccacagctcctaaaagtagactgtgcttaggtacttcaccaagaaaactcacaaaacccactgggattctgctttcctatgtgcatctagctgtttccagacttggggaagatgttcacagcatctcttagcctccatgagtcagctagctggaccagtgcaaggataccactcattcttctaaccctgtactgtgagtgctacacagccaaagttcaggatctcccataggtcttcagctgaagttcttggtaagatgagatttacaaatagggaacacgtgaacatcagcaattatggcaccaaaaacaatggcttggaaattgaaagaataagaaaaaaatctgcctcccagactcaatttcctgcagagtccagcaggagatattcaatatatggcatgaccctgaacgtagattgggaaaagccattttgtgagtacagacatttagagaacatagtccatgccacagtgaagacttgtcaggaaacatgacacactcaaattgggccagtgtaccacaaagccaggctacatgtctggatttttaacatcaaactgaacttccgttatttatctattacttattgttttaaattgacaaataaaaattgaatatatttgtggtatccattatgatgtttcagtatatgtatagacattgtggaatggctaaatcaaggtaattaacacatccattacctcacatacacatcactttttaaaataatgagaacacttaaaatctactcttttaacagttttcaagcagacagtacattgttattaactagtcaacctgactacaatagatctcttgaacttattcctgttgtctaactgaaattttttattatttgaccagcatctcttcaacacctcctcatccccaggccctggtaactaccattctactctttgctttaacgagttcaacttttagattccacatatagatgagaacatgcagtatttgtcctctgtgtctggtttattccactcaacgaatatcctctaggattatacatattgctgcaagtgacagaatttccttcttttttaagattaaatagtattgcattgtgagtatatgccacattttaaaaagtctattcatccactgatagacacttgtgttttcacgtctaggctatggtgaataatgttgcaatgaacatgggagtgcagctatcttttaccccatttttctagcaacaattatagtagcaacaacaaaacttaaaacataatgaacatttgcttttgtactctatttaattggggagcattatttaaaaggcattgccatctaggaaatcacgaatctgatttcccttcctttggatatatatccagaagtgggattgctgatttaatttcagattagtatttctatttttaatatttttgagaaacctccatactgttttccataatggctgtgctaatttacattcccaccagcggcatgcaagggtttccttttcttcacatcctcaccaacaccagttattttaattgtgtgtttgtttgtagttgtgacttgcaaagccccttacacgcaggtggcagtcaatgaataatagatggttcccctgagtgagagaatggagtgtgtttgtgtgtgtgtgtgttgtattccatatggtacctttttactaatccccaattactccattgtacatacactttgttttacttggttctaatgatataacacaaaagaacttatcccattttcctagcaacaataatagcagcaacaacaggacacaaaaaataatgaacatgtactattgtactgtgcttaattggggagcattattttaaaacattgccatgtagagatctctatgtaaagaacacaatttggaaactgatgaatttattctgacaacaccaatgctgccttatcaccatgtttcactctattttaatttatactagtccaataaccaataaaagatggtattccatagagtgtcccctttgaaaatgaatttttactaaataaactaaaattaacaactgatgaccataaaggtttatgagtgatagggatttaaaaatggatacctattgctttcatgaaaacagtttgataatgataaactgaaaaatttgaatacttaagcacaagcattttatgttctgtcattactaatacatggccagtacatgataatacttcattcagttttactttttctttagtttccattaagaacttctcatatttcctgttctctaaagcttgcatgagtgctttaatttctacagctgattggtagaaatacaaatgcctttctagtaaatgttaatgagcactctgatgacaatgttgctgttggtatttgaaactggcagaatcaatattcagggccctctggtaaagaggcaagcatatcggacttgaaattcctccaagtgatttcaacaacccaggacattccattaagagggctttcttatctaggggcagtcccatgacatagactccaagacataaagtgataaactttagtgaagttcattatctttcaactctattaaaaagtagctgacttaaagctaatcttatcaattatttatcattctttgcacactgtgagattgcctaattcccaagctctcaaatatgattgtaaaaattgtttgttttccatccaaatgccttcttataacaatcaattttatataaaaagaaatggtgacttaagtgatttttaaaatgaagtattgaatctcttttcccaccatttatgaccaagaatcctcagttaatgcttaataacttttattgtcaagacatcctttttaatttctaacctaaccttcccttgttgacatttaaatccatttattcttgctctaggaagattaagaaaagttggccagagttctcttcataataacccttcacttacttgatgacaattactgaatcacccttcatggtaaatgtctccaaccttctttgtgttccctcatttcctctcttactattgctcatatatgttattttagatgcagtaatagtataaaaacggggtcgattgagtgcaaatatctctctcttatcaccctctttacattaagaagttctcacatttccaattctctaagcttacgtgaatgctttaatttctacagctgattggaagaaatacaaatgcctttcttgtaaatgttaatgagcactctgatgaccatgttgctgttggtatctgaaactggcagaaacaatattcagggtcactgggtttagtctcctcctttcctcttctctggacatggcttcttagaaaggttggccccagtggctacactcgaattgtatgagcacttggtctcttggctatagctgatagactcaaggctgcacaggtcattcaggtcggaccactgtcacatgtgttcaggaaattgacatttgggattgagattccaaggctgggatttttggaagctgagttgtgtttgtggctactttttaggaggtgcccaatctcttcaggtgaggtctctggagttgtccttgttcctgagactcctggttgctgatttttggttttcttttccttcaaatttttcagtttctagtgagaaatctaataatccttccaataagttcctacttggggcttcagagagcaaaaactgatgtctacttcttgaagccaaaagtattctaactcatgttttgatgacccacctgtcaaaaaagaaaaataaaagtgcttcctggggttcccatggagtgattacatgaccacacaaacacctcacattacgtgaccctgttattctgagttaaaaggtgggactatccacatcccttcatgttatacagacatcagaggtggtacagataacagtttagtgaagtaacttgtttgtacattggtctcccatttcttgtgaggtttctgagggaatggagaggggtttatgagcttttgatttgtggtatccttcactggggcgaggctatggtagatttccaacacatttattaaatgaaacttttaacaagtcaaattagccccttgctagatccatgtattagtccattctcacgctgctataaggacatacctgagactgggtaatttataaaggaaagacgtttaattgactcacagttcagcatggctggggaggcctcaggaaacttgcaatcatggcagaaggggaggcaaacatgtccttctcacatggcagtaggaatagaagtataagagctaaatgaaaggggaagcccattatgaaactgtcagatcacgtgagaacttaactcactagagttaagtcactagaatagcatgagggaaactatccccatggttcaattacctcccgtcaggtccctctcagaacatgtggggagtatgggaactacaactcaagatgagatttgggtagggacacagccaaaccatatcaatccatgtaggtgatctggtcctttacaaagaaaagagcatttcaggcactttgactgcaatgttataaccaaaagaagaaataacttagtgcatataccatgaaaaatatttagggtggaggtatgatactatattgcaaacctatcatgagaaatgaactatgatggatgcattttacgcattatcactacagtaaggaggtttgtttggggaggttgagatagaactttttaaaaagtaataacttaaaataataaaagccttcacgagatagcatttgcacacataagttgtaattaagttgtgatcagaccagtaataaataataaaaagatattggaacattcactgctttgaaggttagaaggaagtagaaatagaaagcaaaccagcttctgttcctgggggagaagaatgcaacagaagctttgggagccatggagtgcgtcttacagatgtcaaccacatggtgatgaatggaactgtgcaatgaatggagaattacaatgaggcactgctgttaggttaaggtgcatataggtatctctgtcccatataattgacaaagattttttttcagacaactgaatcttattcatacctttattcccaaaggaagattaattgaattctctttttactcaaaggggatgatgtttaggactttatcacacgtgggtcacaataagttttcactgatgaagatataattcagatgagagtgtgagcagagaatgaggggaaattgggtgtatactatcaaggggtactgatatttaaaaaatgacattgttcaacataatcctttccattcaggcaaaatgtgtttcttgtgcaaaatagggtacaggaatgaaaaatattttattttctgcatctttggagagctaaggatggaatagaaagaaaagatgtgaaaaacagagaaattgtgtgggagaagaaaatattgatggaatgagtacaggaatgaagatgagggaaaagaagacagacgcagaatggagaccattcagatacaacaattgcagacaggcagacggacgatgctcatgtccactaagagaagatggtcatagacacagcgacctccgagaaggaaactttaagaatatgcaggcacaaattagcttaattcacatagggttagggaatatttctgtagcctggtggttaagcatttcagctgtgaggtaaaatagaccttagttcaagtcctgggtgacatcctggctgggcattgagtgacactgagcaagtttcatcggactgcctcaaatctcagtcttctcacctataaaatatatatttaaaaagcatctactcataggatgttgtgaattaagtgaaataatgaatgtgaagcccttcatttaatggctgacacagcctaactcagcagacagtatttcaagtgcttacaagtcagactgcagagagcaaaactagatgaagttttgctgaagtataaagggaacatgcttttcaaaggggagattctctcacctccaaacactgatacaccgtgcaggagacctctaggtgttggcaaattgtcacgtttttaagagatgctgcatcacaatctgactgttacgttgatttttaaatgtttacaatttatttgatttttacaaacatgttgcaggacaaatgaatacatcgggggctgtgaatatctacctgagcacagctggtgacctctgtattaaaaattatttttctcttatagtcactgctataatgcagaccactatgattactaatataactgtgattattttacttttctttttggggcaagtcactatcttggtgctttggagctaccaagactataaaaaaggaaatataatataaaccatcagagaagctttaacctagaaaataagttaatatgcacaaatatgtacaattaaatgatccacaaggtatacatattttataaatttctatgacagagggagatttctttttcgtttcaaacaaccatgattgtgttttcaaaaaagcagcccctttgtggtggtcccattttaaatggattttacattaaattaagtagtgcctctagaaagcttgacatatgctagttatttatcaatgtcattattggcatcattattttacatacaaccagacagccagcatatttgtgtacctcaggacttaaaactagcttgaaatatgttacatttcatcaaggttaacgagcttgacaccaaatatgctaatttaaaggtggcaggcatgtgaacaaaggaacaaagatactgtgtccaagaagtttgttgcaatgagggaataaaggaaaggttctaaatgttagtcaagagggccgttgttaagtgacttctagacagtagagtgctgttgttaaaaagagtaagggaataatagttactagttatatagcatttgttatgtgggtaacattcttctacttccttaggtgctttgatgtaaataatccttatacttagcctaaaaggccagtgatatttcatgcccattttacacaagaggaaactcagacctaggaaagctatcagtaattcacccaaaatctcacaggttggaagtgggggaggcagaatctgaattcaagcagtcaaaatttggggtcaatgcttctaaatgctatcataaactaatttcctagagctttttatactggtatacctgactcctctaatagtagtgagagttgcaaaatgaagaatgatatgtatgatgcaattcaacttacttaaataaggtagtaatacctaatacatacttatctgcgggttctgtgcctagaaggatacccagtaaactcttcactgaaagcactgtattccgagtctcaacttttcacttttgatgttcatttccttttgtcctgttataagaatggatttctgcaaggttcttcaattctcaagaattaccatgctctttctgagtttacttgtttatttatttaggaactcattgttttacacccaggcagcctatgttgttctccaattataacttccttaaaattcttgtaactcttgtgaaatttttcttctgtccttcccgttatttcgacttaaacaggaactgttggctgtagacatgagcctcagccttagtcctgtggactacacagtctccttcagtgaaatgcgttttccttttgccagcttgtaagaggtcatgtctggacccctattgggggcagcctgttggtaacccaggtagcagttgatggccaggaaggctactcttcctatggtctggctctcagcaaagtgaaagctgtggccaaattccccttttcatgtcttgggagacctcttccatggttccttggacataaaatggtgcaggatctattcagactcacatccactggcttgagtggcttctcaggtctccagtctataacagagagggtgcagaaaatcctaccagagaagagacttggatgcttttgccccaagttttaaggatgtattatcattcttctaaatcctaggttactgtttttgtttgtttgtttgtttgtttgcctggcagcacagacaataaatgctagattttcccactctgtcccctgaaaatctcaggccaattcaagatctaggacatacttttatacttttccaacataccgtggatgtgatattaccaaagaggaatagataggaaaggcagtgtccaagctaccttccttccataaggctacacaaaatattatccatggctacactgtcttaaaaatattccagcaaataaatgtatcctagtttgtttagtgtttctactcttgctagatgtatgataagctggtaattttcaccatatgaacatccttacccaaacgtttttattctgctttaaatagtttttagcatgcattcatataaatttggattctgagtcaaaaagcataggagtttctttcatttggatacatagttcaaaactggtttcccagagagttgtacttatttataggattgcctgcaatgttcagttcctgtagccattaatctcacccatgacagcatgagattccttgtaagcctcaattaagaaaagaattacagctggtggggccttcctctttcattttgtaaaatcccaatttttcctcataaagttcaaaggatctttttaataacaaacaaacaaacaaaaagcttaaagcaggaggtgggaaatatatgaacaattctcttaaaccaaagccttcccttttgtcttctttcttttgcctcaagatctttaaacagtttgcctcccatgggcttctccaggttttcctcttccctggagatttctagataccttaggggagagttgtttttcgagtggtacaacccatcggcaactgatttgtacagggaactggctgattctctagtacatttcagaaatgtgaaattgcttagggtcttgaggctgcattttaacttttagcagagtttcataatgaactaaacagcgatgttttgttctaggcacttttcattcacagctgagtttacagctaaaagatatttgcctaggcattgtggtgcatgcctgtagtcccagctactcaggaagctgaggtgggaggatttctagatcccaggagtttgaggctaccgtgagcttcagttgcgccaccgcatgccacctgggatgacatagtgaaaccctgtctctaaaaattttaaaaatataaaaaataaaaaagtgattaaattcaacctgaagaaatcgaagaatcttcgtccctacatttgagggctctaatcatatttaggatcaccgtgctgttgaaaaggaaaacctacccaggtgactaataagtgaaaatgtgttctctttgaaaatatttaaccacctttgtgacttaaattctattcgtagcttattttagtttccaggaaactaaatttcattaataagaaagaatttgacactaatttgggccccatgtaaattttgtttctgagattccctagtggtatgaataaacacccctccccatataaaatggagatccactgtaagactataagattcctctagcagaaacccaaccttctgtataatcactttcctttctgtgatatttcttctattacttttcatgaaatattttatgccatgcatggctcacagtgacaaagcttatagcacaaaaacaaaatagagatccagacactaacagaattgttgcaaaatggtctttgtaatttaatccactccactgtattatgatctccaggttttgctttactactccaggagatcttagaccccttttttctatgcctttaagatttctctcggtcgggagtgcaaatatttgtgaacttgccctatcacatttccacagttagcctcatcagacgcctagctgaagaaagtagatttttcatgcatagcctcagaaagtttcttaccagttctcgtcttctgagcccattctccaaactggcataaaaataatattcatgatatttttaatctgaaaccaagctgaatagacttctgacactccttccagcttcaagagagctattgttgcaccttaatttgagaggcaagcattgaagattttcagaaacacacagtcattgtatcagctgtttttttcatactctaagggaaatggaaagtaaacattctatccaaagtattatttgtattcttgcttgacagaactccaaaaagtctcaagaggcagatttaatatacaccttggttgagcgttgcagctccaatatatttttaaagataatgacaagaggccaggttctcagccccgttgcttgccaaaatggaagggaatgtctggagaggcttaaattccaagctttgggttcagctagactatcttcaccactgcagagtttctcagtcttgaactgttgggactgcagctgaataattctgtgcaggaattattattgagatccctggcttttctactcactggatacggttggtacctgaagcacctcctcccactgcgacaagccaaaatgtcttcaggagttgccagatatccccagggtggagggagtggggaacaaagatggccttggttgaaaaccatgactgtagtctgtgcctttccaggaatcacactagctacccatagggattttacagaggactcttcttcatatacttatatttaatcattttcttccttaaccctctagaactgtgctgtccaatgtggtagcatctagccatatatgaatgtttaaatcaatcaaaattaaatacaatttaaaaacccattctctagccatatgtggctaatgggtattgcatattagagaatatttccacatcccagcaaattttattggacagtactgatctaaagaaagcattcttagagggagacaaatcatccccaagggacaaagaaagggttctttcttgagaagggcaaatctccctctatttataaagcacaaatatacataatatgtgttttacttacacagtgtaaaatgtgtatacaacatgtctgtggtgttaaagttatctgtaacaggaatgagtttagaaaacagaagactaaaacccaccttacctggggcttatgaagaaacactggttatggatttattttcctcttttgagatataatttggaacttgaagtgctagatttgcaaatgcatcattgcggctttaagatcctttaatgccataatgaaacctctattcttattttcccttttacttatagctttcaaacaatgtaactgaagatacacattttcatttaacaacaactaaagaagcttgtggaattttgcaattgaaattttaagttactggaagctcctctaactagcttaatgatttctaaacaaaaggatcctattcaaaaatattagattcattttatatgataacatgtgtattagtctgttctcacactgctatgaagaaatactcaagactgtgtaatttataaaggaaagaggtttaattgactcacagttccgcatggctgggaaggcctcaggaaacttataatcatggcagagggcaaaggagaagcaggcatcttcttcacggggcgtcaggacagagtgagtgcaagcaggggaaatgccagacgcttacaaaacaatgagatcttgtgagactcactcactatcaggagaacagcatgggggaaactgcccccatgattcagttacctccacctggtcccgcccttgacatgtggggattatggggattccaatttgaggtgagatttgggtgggcagacagaggaatccatatcaacaggaatacaatgttttgatatttttaatttaattagaaaagaaagttataaataatattttgatgatgaattaattcatatatttggtttaaacaagaaagtacccaactcattgctggagtgatgggttatttgtaatggacatctgtcattattttctggctggatatctgaggtcctttttgggtttggggagattgttagtgatgagtcttaagggaaggtaaagctctgctttttgttaccaaagcaacaaggttagattctggttgtccctgacctagataatcataggcccatgacctagtattggtcatttggatattctgatccaggactttatagtgggggcagatgacacagagtgtgtcagtagcagtttgaaattttggtcagctgcataatgaccttgagtaaatcttcttgcttcttatgttagcaagtattgacacctatattttgcatccaaggatattatccgtaaaagtattttccataaggtacagctctggtaggagttccagggatgattttatgcagattttggtcaggctaccatagaaactcctagccccctctccaaattagtgcaagcgcaaatcagcctgagataattacatgaaagcataccatggtgagtagggcagaggaggtaaaaacttacaaataagaagctatttttctgccaaatggtccttaatccaaggaataatttctccaagagaaatatccaaatctgtgttagacaatcaacattactgaagctagattccaagtaatttccaaaggaattatacagtttcactttcccaccacaaatgtatctgagttccagttccttcacactctcaccatcacttgatattatcagtctttctattttagctattctgatggatgtatagtgttatgtacttccaggttttagcccttaatgctaatcatgttgagtatttcttagtatgcttatttgccatttgtggatattgtgtggcgaaatgtctgctcacatacgttgatgattttaattggatttttgcattattataagttgtaagagttcttgatgcattttgaattaagattttgttgaatttctgtctcttacagtctttttttccattttcttaatgatgtctctagaagagcagaagatttaaaatttgaaattcactctatcatcttttttatgatttgtgcttttcaagtcacacttaaaaactcattatataacttgaggtcacagctttctccttataattttagctttggggtttaggactgtctatgacacatttagagtcaatttttgcataagttgttaagttgaaacttagatttattaccttgtttataccaatgaatatgtttcaaaatttacccatatacattgttatactatgactagcagtcctcattcccttatttgattccacatatccatcttccatctgatgccatttttttgatgcttggagaaattctttttatattctttgtaaaagatttctattggccataaattttctctggttttgtttgtctaaaaaattcttatatttacattcattttagaataatttttgtgctagataaaaaattccaagttaattttttttcttttaatgtttcaaacatgctaatctactgtcttctgacttggatgatttctgacaagatatcttaagtgatgattatctttattcctctgcataaaatgtgcttttttcctctaactcactttaagatttttcactatattgctaggtttagccaatttgctaaggatttgacttgatgtaatttcattatattttgttcaatttggagtttgttgaccttatctaatcttaaatttgtaatttttatcaaacgtaggaaaccgtcaatcattatttcccaaatatttttctgtcccatttcaccattttctacttctaggattacaattgaacttttatcaggccatgtgatattgttccacatttaattactcctttctttcatggttttgtctctatgactcagcttaataatttcaattactgtgtcttctaattcacatgccttttcttctgcatcttgcaattaatcctgtgcaatgaatttttatttcagatatgttatttttcatctcaagtatttatattcagttcttaggcttccaattttttccttatttataatgatgctttcttttaaatccttgaccattttgaatataacaactgttttaaaatctttttctgctaatcccgtcactttaatttctgaatctgattctattatttttatcatggaaaatattttacattgtcttgatgtttggcctttctatacaatttttaattggttgtgaaacataatgcatgttatttattttagagtctaaatgttatcttcctttaggagtaaattctcacctgaggtaaattgaagttacttctagataggatggatgctttaaagggttgtttttaagctttgtcagggcattgctagagtaaccattagcctaggtttagtttaaccttaatactaagacgtggtcctaccgcagccgataataaggccctagttcttaattctatactctgaacaatttaaacttccacaccttattaccctgtgtacgctctggaaattgttccgcttacagatccctggagatttctgcccagactgatagagtttcatcaactatatgtatgtccttatttgtagaaaacacttaaaagaacctctatacagatttttagaggtctttcttcatgaagttttatgctttctagaactctgtcctgcaactcttgccacctcagcttccctgaactttgatctctgttttatcaactcagtgattgccttcctctgtttttaaagcctcgaatgtttgtccaggtgcaaagggcaattgtcagactcatacacataagagatcccatttctgtcttgatcgttgtacaacatctgaaagcaattgtttcatatattttgtctagtggtctgtttattgcttatccctttttttttgtctaaagcataaatcccactaatcctcacatgtttcttatataaacatatcctcagtatcagcattgatgtctctgagaatcttctcatttttcctatcttatttaaagtagccaccatgcaaattactctctaactctttgtctcattcaaattttcttataaaatttcacaaaatataaaaaacatatttcttacttattggttcaactctttattacattccttccccttaaggcactttgctttgcacatagtaggtgctctaaaaatgtgggaattataataagtacttaatgcttgatttgtggaatgggcattctaccaattaaatttgtaaacctaatcttatatattctttagtataagatcacctctttaaggctttttcttatctctgattttggcaagaggataattccatatgttttaactaaaaattacaaagtacaaaaataaagttcactggatgacatttatgcctcaggaaatatgtagaagattatattgtagtcattgtattaatcccacaggtagccaactgactttaatcaacaaatattacatgtcttttcctgtgtgcacagtgctatatagctgtttagtggaagtggatttgaacatattagacctatttcctcacaatgagcaaatgattcagaagcatggaatattataggtaaagaatccatggagattgctttttttttttggtcaaaaaatgggaatggtggttgattcgactagatggataaagatatcgtaaagataggctgatcatagtgtcttttattgtcttactagggaattttagttattttaattacagagaatttcttggtattattaagtaggaaaagagttagataagacaaatttcttttggaactgaattaagaaaaaaacaggtaagaggaaataagttaggaggctataatggtagcatgcacgacaagtaacaatggcttggttttggttggtgttggtagaatggtaattaatagaggcaaagctgaaaaaataaaatgaaaaagaaaaataaattcacttggaatcctatcagatataagggcctagagaaaagatctttaagattcctgatccaagagtttggaaatcaatgatgtcattagaggaaataggaaagtcacacccagggagcgtttggggaaaagagagtttagcaatgggcacactgagatgtcaacagcagtaagacattcaggtgtaactccccagcagacaggtggggatacatttctgattcacatgggagtttggttagggctagaatactagatctgagagtgatctgtagaggccacacagatcacttttataagttcctcccctttcataacatagtaagccaatcctcagtagcatggaagagctaaaaagcagacattcatggcataatacttataaaagtgaattaaaatgtatatgtctgaaattgcagactccctaaactaccaccttttcaggctttataatcagggtgtgatcattaagttccatctccttgcttacttgttcattggcacatagccatgtttatcttgtccggaggcacatcaacatgctgcttgcccagcatcgtatcttataacaatgattgcacattttcacttctgaccatgatccttgatgtctgttcttactcttattcagtagccacagcccaacctcataaagtagtggattatcaagaggggatagacagagtaggctgtttatcaagatttgatcccaaatataaccgaagtatatccttaaatgacttttaaaacctacctgaagtttggggccataaaacatatttatattcaatgtagttcaaaacaagaaagcctgtagaaaatgaaaagattactgtagttatttttcaaatcctaaaactttagattatcccataaattttgggttcaagaaaaagctgggaaataggttacaaaaataagtctcatacccagaattgccttttgaaatactgtgctaagaaaatattatggatgtaattgtcatttctttttcatgggcatgctgctgttttagatatattctttttttgaaatgcatgaagtctttctgaaataggtacagcacatcagaaagaaagatctatctaaaacttgaggttttaccatttgggcacaggatgatgccgggcacaggatgatgccagccacatttctttttggaaaattagactgagaggaaggggaagctcttttcctgctccttatctgggtcacagtaagctttagcaaggagcgggcaacaggctgctctttcagaattcatggtgggaagacactgggaccaacatactagaagtgttgggaataggggtggacaatagaaaaggggaacaaaggctcagacactactgatggggaattcttgaggatatgatacctaaaacttaccttagctcccatgactagtgcttaaggtattgacaacactcactttgtatgaactcctttccctttcacaaactaagatccagcaacttcctgcattgctgagactggctcttcagcaacttaagcaccatcaccataggcaatatctcctcctggtaggtcttttcatcaccgctggcacagaacagtaagtttccatacccaatgagtcttgtcaataattctctaccagcacggaagattgagagaataatttgaataaaataatttcacaactccatagctgtaactaattggactgactaaacagaatgtacagacaatagaatttactgtattttaacgtagttaatttagtcatttgatgaattgctggtggcttgtaaatacagctcatggttagacaccagaatcagaaagaaagatccaaaaaggtgtagtctctgaacatattttttaagggttggcaagcatttgttttagactaccaagacagacattaatcagagcaactcttctcaactggaggcaagtcttcctccaggggacatttggcaacatagggagacatttttggttgtcacagctgggagaaggatgctactggcatctaatgggtaaaagccagggatgtggctaaacatcccaggtgcacaggactccctgtgcattagatgcctgccaattagataattcagttgattagataatttggtgggaggaaaacaaaactagaaaatggccctttcagtaggccagtacttcccactttgtacatttgcacaagtgtagaatttaccaatgtccctttctaaaatatcatggtttttaattctagttgccaattaaagcgtaactaagatagaaaagctgagtatattcaagtattcttcatatttagtcttgattctctctacatttacctctcacctcttataattaattagttaatttcattatcagtgtgttctgtgaaccacaacttcttgaaaagccttttattctaagggaatcatattttttttttaactcgacatcttgagctaaaaaaaatcccattaatttctagtagtaagataaatgtttatggtttccatttgttgtcatcgaacatagcatagctcccaacatctgcttctcagtggaaatgttgattccttcttcatctcttcttaagaattgcataaaaactcaaatctttttatttcttgaacttccaagtgtttttcactttgtgtgatcattaacatgtcttgttttgcaccttggaatgttcaacttgttacctcttacatacctccttaagtgttatatatcgtcaccacctttcattctgtggtggagttgctgccacccatgagtcatggagcgtggagaggaggcatcacaaatggtaatcatttgcatctccagtaggaactagcacactcacaggctcatagtagaagtcttagttaagacatgcttgccggcaagtaaaagatattcctctaagcattctttggccaaacttttcctctatgatatttagggatttgaggacaggaagaacaacagaacctcatgggaggatgaagtcttgaacccgtaaggtgtcaaggatagtggagcaggtagttatgttccatgaccccctcttgactctctttaagaggcccatgaagttttacctttttttctctcttcacttttgcttcccttttctctctctgtggatgttgtctgcttctgcattctcccagtctatacatggctgtcaagatcctatatatgtcctgggacttctgaccaactaagtatctctgctgagctaatgtacctggtgctgtcctttttgagtacttggcattcattcatacatacatgcatacatacatacataaaatgagaaggaactaatgtgggctgatggcatgttaaaggagtatattgaaaagatagtgagcatctcacatcatcaccaggaaaactggagaaacaagcttggagtgtgggtggaaataatgggaacatttggaagacaggtccagcaggcatgaccatgaagaaaattataaccatggtgttcagcacaggaggctgggtgaagctgctgtacttccatccaagcaacatggatacatggcccactggcccctggaaactgagcgttgcaatcatcacttccttagctagcaggaattctctgtctttcctgattctttggatcaccattgacaatctcaatgtcctcttgggagatgtctggccacagagtcccatgccatttggcatgtcaaacatggtgatttgttttctgtaataagaggttacttgttttctgttaccatgaaaacaagaatggctggtgtgtcccaaatatgggacagggttttcaatgccaagtgataacagtgggcccatgcatacaattcgaggtaatcttatctcaaagtcattcttaattccagacttaatacaaaccttaatcccaagtgcaattttaatttccctttgtcatttcatagaatacatttgcaggttctgttgattaggatatcaacatctttgcggaccatgattctgcctacaacagtgatttatctagacagtgtggacataaaattatattttgtttaagagctctagatttggagtcagaagaataatcttgcatactgactccaatatctactagtgataaccctggacaatgattaaccttctccattaatttctttaattataaaatgagaattgcagcactaatccaatctgtttgctaatgtgaagctaggtagtttctataaaaggaatgaaaagcttccatggatattatacatgatgccattggaaccagctatatcttgctgtgaatggtgggtgtcttgttttttttagctaatgtgaataggtcactgaacttactgttcttcaatttctcatctcaaaaatgggcacaacttcacaagaaagttgtgaaaatcaaatgagacaatttaaataaagattcaaagcatcatgccagataaatacagtgaatacctaacatcagaactgaaaatacctattttcagtttatttacaccagaaattctcaacctttgcactactgatatttgaggctgtgcgtttttgggttgtgggggagctatgctatgcacagaagagtgtttcgcagcatccctgctctcttcccactagacattagctgcttccctcttcccctccccacccagttgtggaaaccaaaatatctctagatgttgtcaaatgtctcctgttgaggaccaaatcactccctctgttgagaatcacttacctaggcaaatacttatttaagtactgtctgttctttataacatttaatcggaagttatatatttagctaatatataaaatataagcatttatatacttacatcctgtcatatatttgtaataggtagcaatttcttttttctccctaccgtagggaaaaagagtaagtgtgacttctctaactttgttgttggcagcagataaatatctgatttgttcacgaccaaagagcccatgtttaacatcctgtttactttgggatattctttcttttttaacttatctacattcattttgaggcaattaccacaacatacttatcagtttaacttaatcaaatgtgtgtgtattcccattttgttagaacacaaatccaaaataacaagtgaatggagaaagcttatctttttctctaaaacctattacttctgctatcataaagatgcttcatgctgtgtctatctaaatgcaaaatgcacaggaaaactaaagcaagctcgatattttaattagagttaggcttggggagtgggatgataatgaccctagttttcacttttgacctgagagaacatgcgaattatatattctagtaggtgaaaaagggtcagcatgggaagtttctcaattaaatttcacaagattgtatagattgttgattagatttgcagcatgaaacactccagaaaatttacccaccagtgggcttaacacatggggaaatattttcagcagtgaggtagccattgcagtgatcacttggaccaagaaattgtttccacataaaccagagtccaagggattaaactgtagaggtgagaatggcactaaaccctgtggcacaaccatcaaaattaaagaaatggttagctgtctatgtggtgtccaagtattggcatcctatccaagcaaaattaactaggccaattaactgtaggacgggaagctcccagctaatgccatactctccagagtttctccagaagtttgtgtgatggctagaccatggtcagagagcaacacaaaatggaccaagctgagcagggagcttcaaggacatataatctggagtctaagaggttagatccaacgggtcggtaaatggtgtgcccagtaactgagggataggtgataattgatagagcaaatttagagccttcacaattggtaaagagtcttaacaaccatgtcgtcatccaagaaaattacatcagtcctggaaactgtgatcagaagcctcggagaggaaggctgtattcatcagggttctccagagaaacaaaaccaatagaaaatctatagctatatcgaaatctgtattgacgtctatctctatatctatacctatattgatacatatatatactgatctgtatctatacctatatctatatatccatattcacatctatacctatatttatatatctatatccatatctatacctatatctatatccatatctatatatctatatccatatctatacctatatctatatatctatatccatgtctatatatctatatccatatctatagctatatctatattcatatctaaacctatatatctatataactatatccatatttatatctagctatctactgtgggaattggctcatgaagttttggaggccaaaaagcccgactatctgctgtctgcaagctgcagacttgctccagctgaagcaagtcagctgaagtccaaaggtctgagaacaagagtcactgttgtccaactgcaagagaatatggatgtcccagctcaaacagagagtgaattctccctccctcgaccttttgttccattcagaccctcaactgattagatgatgcctgcctgcactgatgaaggtgatctttactcagtctatgaattcaaatgctaattccttctggaaataccctcaaagatacacccagagataatattttaccagttctctgagcatctcttcagcccgtcaagttgacgtgtgaaagtaaccgtcacaaagaccatgtcttcaatataaaaggactaaaccttggaaaagttaccaaagagggacacaagtcaagaggaagagtaagaaccacaaagagggaagctagtatcaggaagaaggtgaaatctagttttcagatttgaatcacaagatcagagatggaccagtgtccagtattcaggaaagtgctcaggtgatcttcaagatggcctgtcagacttgcagaatgtgaacttgggagctgctctagggtcagaatcccactgtggacaatatggactggttgtgcgttttgatcacaacctagagacttaaaagtgagtttgctaaaaatactagcctgccattggtcccatgcttaacactagcctgctaatggtcccatccaatgagaatacttcggagacaggtctagcaagcatgaccatgaaaaaaatcataaccactgtgttcagcacaggaggctagatgaggtcactgtacttccatccaagcagcatggacacatggtccacggtctcctggaaactgaacattgtgatcattacttccatagctagcaggaattctctgtcattcctgattctttggatcacgattgacaaactcaatgttcctcttgggagatgtctggccactattattgaatagttctatatttgacaaacatatttcaggagaagaaatcattacttttctacttaattttaatgtatatttgttttccaaagcatgaatagacttgggtaatattttacttgcagtaccatgtagacccgagataaaacatctctctccatataaatataaaaatagagaaagctgtatcaatgcaggactttttgtcagtgaaattattagtatcattctcatctcttgaataggaaattcagagactgtaagtaggccagagtcactgaaccacaaaatgcactctgaacgaaaataaccttgattatctttccaaaggaaagtaatgatgattagtatatgggtatgtgtcaggtatcgtctataagggtctccagaccagcctaataataataatatagaaaattagaaatgaagaggttaaaatgataatcaacagaggaggagaagagtgaaaatccattagctttgaacaaaggaagataactatatgtagtcccaaatgtatttacttggggggataaccctgcattatatccactgaagattattttgtgactcagcatctccaagcttcacaccagcagctgtggccttcgaagaggaaagaacaatggctctaaatcatcagcttttcctagtggctaaataaaagtgaagactgtgcagctaatgggacgggttgaaagaaaatatacagatgcaacatttgcaagagaaaatgagatcagattccatatctgacagacccttgacaaagtcttggtgggtaaattactggacgatgaagctagagacttgtggaagatataattcccccaaatcatcctttctcactgccatggtgccaggaattgtattcattagagtattttctttattttttgtttctttttatttttttagagacagggtcttgctctgttgcccaggctggagtgcagtggtgtgataatagctcactgcagcctggaactcctgggatcaagacatcctcctgcctcagcctaccctcacatggctgggactacagatgtgcaccaccatgccctgccaatttttaaatttttttgtagagatggggtctcactatgttgcccagtctggtcttgaactcctgggttcaagtgatccaccgacctcagcctcccaaagcactggcattacaggcacaagccaccttccccaaccactggagtattttcttaaggtcagtgtagcatttccagaaaggcaattttttttcgtaaacctatgtacatagcaccatcaagtcaacagtcttcttggtcaattgaaaaccaaccgggttttatattgacactcagaaaagtaccttgaatgcagatggctcagtgagagagggcagccaaggttagcttgcctgcttctgtgcaactgtgtaccaactatggcagaacttcccagactttgtgagctcatagtttctttagtgtctgagtaatttttttcctacttcccctaggccaaaagaaagacctaaaatttctgtttattagcccaaataagttacaagaaatttatgtgctaatattttagtagaacaattttaaaatcatgtctattaatttgaaagcaaagaagtatatttatatttcattcttgaatagccataactattgacaaatgaatgggatgtgcatgcctgttggtaccatacaatttcacaaaacttgaaattagattagactcacctgctgtattagtttgttctcatgctgctaataaagtcatacctgagactgggtaatttatgaaggaaagaggtttagttgactcacagtttcgcagagctggggaggcctcaggaaacttacaatcctcgcagaaggggaaggaaacatgcccttcttcacatggcagcagcaagaagtgcagagcaaagtaagggaaaagccccttttaaaactgtcagatctcatgagaacttactcactatcatgagaacagaatggaggtaattgtccccatgattcaattacctcccctccaccacacgtccctcccatgacacatggggattgtgggaactacaattcaagatgagatttgggtggggacacagccaaatcatatcacccatcctcattccctattacccactgatttgttaaaacagtatgtgattttttttatcccaccaagaggccaaaactcagttttgcaaagatgtggcactactgaaaaggatggagcatgatttaatgttgcatctcagaacaatctctatcatggtgtttgctgatatctgacagacatcaagtatttcagtgttttccccccaatttaaaataccttctgatgcctctttgggccatacattttctgtactattatggcaggaagacactataaatggtacaaaagccaaatgggtgtagttgtgtcccccacataattgttatttgtaaatatgcccacattttgttaaaacaggtattatgagtgatttggctcacaagtcttagtctgtacacccttgggcaaaagctttccatccagtatcgtatttgaatatctcaatggtggacagagcaattaatcttcattatttcatttaatttccataaaagcccaggtgctataatacagatatatgtgtgttctagatgaaggacccaagtcagtccttcatgtagaccctaagaaatgtaatttgctgaaggtcacatgtgattattcatgtggtgaggatggatattgtcttcaaatcaattcctgccaacctaccaagcccctgtgcttccactccaccatattgaaataagggctgtatccagttcccaataatttgatcttaaatttttgtcaagaacattagcttcctcagaataagttgaattaataatttaaggagagtgagccatttccccctatccctcccaggcactgtcaaatctacaaaaacatcctggaaatgaatgattctaggaaaacatgggatatcgaatttgcaggtttcattttcttaagaattgtgccttcattcgggaattacataatggtaaagggaacaatgcaacaagaagagctaactattctaaatatatatgcatccaatacaggagcacccagattcataaaatgagttcttagagacctacaaagagacttagactcccacgcaataatagtgggtgattttaacaccccactttcagtattagacaggtcaatgagacagaaaattaacaaggatattcaggacctgaacttagctctgcatcaagtggacctagtagatgtttacagaactatccaccccaaatcaacagaatatacatcttctcagtgccacatggcacttattctaaaatcgaccacgtaattggaagtaaaacactccttagcaaatgcaaaagatctgaagtcataacaaatagtctctcagactacagtacaatcaaattagaactcaggattaagaaactcactcaaaaccacacaatttcatggaaattgaacaacctgctcctgaatgactcctacgtaataatgaaaataatgaaattaaggcaaaaatcaagaagttatttgaaagcaatgagaacaaggagacaacataccagaatctctgggacgtagctgaagtagtattaagcagaaaatttatagcactaaatgcccacattagaaagtgggaaagatctgaaattgacaccctaacctaacaccacaattaaaagggcttgagaggcaagagcaaattaatccaaaagctagcagaagacaagaagtaattaagaaaattattttcttttcttaaagaaatgaattttcaacccagaatttcatatccagccaaactaagcttcatacatgaaggagaaataaaatcctttacagacaagcaaatgctgaggtactttgtaaccagcagttacaaagtaactgcatctttgtatgatttcacttatatgaggcacctagagtagtcaaatccatagagacagaaagtggatggccattgccagggacttgggggagagaggaatgaagagttattgtttaacagatacagagtttcagttttgcaagatgagaaaagttctggaaaaggatggtggtgatgcttgcacaataatgcgaatatccttagtgccactgaactcacttaaaaatgcttaagatggttatgttatgtgcattttactacaataaaaaaataaggtagaggatatgaagtcaaaaagcatgaaagagttttctaccaaagcagttttggatatgattggagttctcaaccaagctactccaaagaagggaaggttatttgctgatgaagttaacatatggctttttgtattagtctgttctcatgctactaataaagacataacagagactgggtaatttataaagaaaaagaggtttcgtggactcagttccatatggttggggaggcctcaaaattatgtcagaaggcaaagcaggagaaaggcacgtcttacatggtggcaggcaagagcttctgcaggagaactcccatttataaaaccaccagatattgtgagactaccccaagaacagtatgggagaaactactctcataattcaattatctccactttgccccacccttgacacatagggattattacaattcaaggtgagatttgagtggggacacagccaaaccatatcacttttaaacataatcttaattaaataatcaattacaaattcattcaaaacataaggcagtgatcccataataacactgctgaaggagacccataaagttttaattacactcaattatcatttctattgagccaacagattcaaataaaagggtatgggcgtgcaagagacacttgatctgaggaaccatgcattattttatacatattgcgcaaaataggttaaaatcaggatgatgaggtaatttgcaaactttttgaaatcaatctgtgtatgattgtctttttaaatgtctccttggatcattatactctttgagatattttcctctctgagaagagaaaggtatttccaacactgtaaatgctgtatttcactgatgaactgtcccttccaatactttgaatcttcaattgccctgaaatccatatttggtagataactgggcaacatgagttttcccattgctgtctttacatgactcccaggcatgccacgaatggcttccatgttagtaccagcatctagatgaggcaaacacagtggcacctgaaaactcagagatgccagcaatcacggagcccctagaggtgttatagctcttgctcagggagccccgaggtccaagccctgaagaaatgtggcagctcttcacccctgtagcctggcaagcaagagcatgctacagctctctttctcctgtcgtctggcaagcaggagcgtgttacagctcttttattcccattgctcgcagctcggtgagctggccaggagcatcacagctctttcattcccaccacctgcttctcagtgagtttcaggttcttgtcccgtgactgagaggaataaggtacatggacactagcgagtgaataaggcagagaagaattttatcaagtgacagaaggaaagctttcacctgtgagaggagaacctgaaagcaggttgccatctgtgaggctcagtctggggtttttatggacctagaatgggggagagtgtgctgattgatccatcggtgggcttggcaaaagcaccattcaattggtaaaaaggcattatccagaaggaaacaattgagagagagagggtaacatggggatagaagttctcgctccagtcgtggactctatccggaaccagataagctcagttttcaggtttaaaccatctttggcttgaaggtcgggtctcacctctccttgtctgcctaggaatttgtctgtctcctgtcactatcatcatcacactatccccactccatatgtacacttttacccttcagtgtgactaaacaaaaggattcaaagaaaatataaatacatttctccaaaagtctcttccttttacctatacatacaatgttatctgtagcagataaaatacaccatctgataagaacatagaatggtggcagaattgattttagatttcttctgcacaccctttgttttctcactggggaagacgaggccatagagctgaatcaactggccaagttagtcaagattctgtgaatccccacattaaattctgtgcacattgctataatggtttccattgtggatttcatgcatgcatgtcctataatataacaagttcattgagtatgtgacttacttggtttgtgccatagtagtgtcttatttaaagaagtacaatccaatcacaaaaacttactaaaaacgacttctattctttaactgtgtctctctaagaatatttaaaataattcaatttgtggtgtttcggaacacttttatttctttgtctcatcccatattctgagacctttctttcaccatgcctcccaatcatcccttctgtctcccatagcatttaaatgctattctctcttcccagctcacacatctactgaagcagaacacacatttttattgaagtcatactggaacatttttggcttagttttactcttattgggtcgctgttttcccgtctaaagcttaaaataggtttccctggctttactgatcttctcctgctttgaaattatgaattatacaaggtaaggtgagaaaagatgggctaaattaagcaaactaacagctctctaaacgattggtctaaaggatgtccagaatggaccaacacactagtgctggaagttttagatttcaggctcttttgccctgacatgattatcaatgagttgcgtgcaaggacatgagatatcaggagctttcatgtcatctgagacttagatcacaagcatctcagcagaatgaggtaggttttaaatagcttcctgacagctagaataacgacaaagtcataaggtccactaggaaaggattgaagacatatccaaaaccaaatacaagatagcctgaaaccaggaaagaaaactttgcagtgcaatgagaagtatcttttgacctctgggaccttagggactgaataccagaagccaagcaggaaatgctgtgcagggattgtcctccagttgccgggaggacagcaagccaggctggaaggggtaaagcttgaacaaacataagcagtggcaatctgagttcatctcagaaaagaagggttatgtctttgtttagaggcaaagcaaaagcacccggggcctagatgctcacaaatatcaccgaccaaagtatattttagctcaatgtcagttgaagttaggatcagaaacaaccactgctactctgtaaatttttttttctttctcgctctttggggagaatttcatgtttacccttagttgtctgataaaaactctgtttgaacatttacaatcttgtctcatatcaactcgtcaggatccaaaagatatcgacagatgggaattatgaatccactctcccaagaagaatgatgattgtatgaaagttgcaggctttgctcaggtggcttgaaaataactttgaaaaaaacagattgtgaatctttagcacagaataaggaaaaataaaaaacagctcaagtatgttattatttaataaatggaaaattaaaagtatctaaaaaaatagctgagataagatttcaggcttcattcctagaggttggtgttgaccaagttccattctgtgcaggttggaacgcatctgggagtattggaattaatcacttggacaagagcccaggcatacttgaacacatttaagagaggatgaccatagtgtgttgaagtagctgaatatgatgatatcaaagcatctgagaattttgatcttggagaaaaaagactggggaaaatatagagaagcctgtaggagatgtgattttgtatctgaagatcaaccatgtagaaaaaaagttagatggtgctatgatttggatatttgactcctccaatcctcatgttaaaatttgatccccagtgttggaggtggggcctcatgggaggtatttagaacatgggaacagatccttcatgaatagattaataccctagttgagggaagagataagtgaggtctcactctctttgtttccagaagagctggttgttaaaaaagcctggcacctcttgcctctcttgctctcttgcttcctctcccaccatgtgatgcctgcacacaccagctcccttttaccttctaccatgagtataagcagtccatggcccttgccagatgcagatgccaaaactcgaactattccagacatcagaattgtgagccaaataaacatttttctttatatattacccagcctcagatacttcatagcaacacaaaatggactaagacagatggcttgatgaggtggaaaagatcttccccactaggctttgagataacagggcagcctcttagaaggaagacggatgtgtcagtggtccccaagaccatgcccacattcaatgatttggtaagactcacaggactcagaagttgttatactactcatacttacggtttgtgatagtgaaaggacacaaacaaaatcagcacagggaaaaagatggatgggcaaagtgcaaaggtgcaagggaaagtagacacaagcttccaatgtgcaagggaaaccaggcacacttccaagtgtgtcctcccagtgggtgcacttaatacctctggcaatgagttgtaataatatatccaaagtattgtcaattgggaaagttcactcaaaccttggagtacagagtttttattggagggcagacacaaaggcacataatcaaacatgatttttgaatctctagactcttagaaggaaacaaaaagtgtttaccacaatgcacaccgcttgcatgcactatatacacaatcttgtttgtatggttcaagacactcctcccactcaaagcatgaaaagccctctaatcaatgggaacattctaagcgcttaaatcacaggaaactaaccaaggcccatcactaaagtgggactttcttgggaatgtgcagggtttgagcaacccaggcctgctgtgttaagtctttcctgtataggggacaagggtggtgagtccatggtgggggtgttgtgaaaactggctcctcttgcctgcagccacttttttttgtttgttttgttttttgtttctgtttgagatggagtctcgctctgtctcccaggctggagttcagtggcacagtctcgactcactgcaacctcagcctcccaggttcaagcgattctcctacctcagcctcccaagtagctgggattacaggtgtgcaccaccacacccagctaatttttgtatttttagtagagatggttttcgccatgttggtgaggctggtctccaactcctgacctcaggctatctgctcacctcagcctcccaaagtgctgggattaccagcttgagccactgcgcctggactgcctgtagccttcttttgtctggttctttgtgcaaaagccaggggaactggagagagattcattttgatttaaaaatccttgctctgtccttgctctatgaatttgaaataagatactttactttggtgaatctttatttttaattagagagagagaggagaaaaaaaaccacgcacgggggccagatgcctccagccaaagaaggtgaggcatagagatctcttaccactaaggaaggtatctgaatcatgtggcaccaaatatgtcactggtggaagttatccaagttactggcggcaaatccatatggatctgcagcaacctcaattcttgccttctcggaagaaagaattcaacggggggcataaggcaggaaaaagatggaggaatgtttcagagcaggagtggaaggttattaaaaagctttagaacagtaaggaaaggaaggaaagaaaagaaaggaagggaagtacacttggaagagggccaagcagctgactcgagaaaccaagtgcactacactttagtgaatcatgaaagaaataattaacattgtttataaagtgtgcctggcagatgttatgtgaatatttgttttcttttcccctgagttggggaaggtgagattcctggtaaatcatcatatttattccctcacccgttctaaaactccaatgtgtacatgaaatatctggggatcgcattaaaatacagattatgatttggttgatttggagatgggccccaaactctgtgattttaacaagctcctgggtgatgttggtgctattggttcatggaccacatgatgcccagggtgggcagcactatgtcatgggggaaaccagggagcaggtttagtacagactccttatatttctaccccctgacatcttctcttgttccattcccctcacctcaacctagtacaacttagagtgttccagggcagtagttttcaagcattgctgtttgaaactatcaagaattacctggctttccagttaaaagtgcagattctgggtccccactgcactgtggtccaattctgagatgaagcttgggaacatactttttttgttgtgtttctaaagtggaaccctctgtgatctgatttaggtagtggagaccccagaatctctatatgaaggaggttgggatcatcaatgtgatggaagggagggcaaggatgctgcttagaagctgtgtttacacagcaagcacctggtttctgatggctcagtgtatttgtctgttctcacactgctaataaagacatacctgagactgggtaatttataaagaaaaagaggctaaatggactcacagttccacatgactggggagaactcacaggcctggcagaaggcaaaggagaagaaaggcacatcttacatggtggcaggcaagagagcatgtgcaggggaactcccatttataaacccatcagaacttgtgagacttattcactaccatgagaacagtatgaggggaaccacccccatgattcaattatctccacatggccccacccttgacacctggggattattataattcaaggtgagatttgggtggggacacagccaaaccatatcactgagattgtgtatttgtttgggtgactcagagggatgtgatggagatttttgtgtggtctaaatccttttcaagccacccctcagtgcagccactggaggcaggccatctgggaaccacacttctcctcactccagggaggagcaggggaccaagggaccctagacaagctattttactcttttaagcctagtttgttttatcagttgtaagagagtaataatgcttacctggaattggattttatttcattttacttttatttatttattttttagagacagggtcttgctctgtcacccagagtggggttcagtagtgcaatcacagctcactacagcattaaactcctgggctgaagtgatcctcccatctcagcctcccaaggagctgggactacagacatgtaccaccacacctggctgcttttaatttttttttctttttttttttttttgtagagacaggggtcttgctatattgctcagtctagtctcaaattcctgggctaacacagtccttctgcctcagcctccaaacgtgctgggattgaagacttgagccatagtgtccagcaaaaatggaatgggattttataatcaaagagctcagaggagacacccaggaaattatatttgctctttttattggttctcttatacctgactggagtagggacttcacattgaaactaatgtaagtgtgtttgacatattactctgtctgttctctttctctccttcaagaatgatgccaggaggattaataggtggaagtaatcagagctctggtttcatggtcatgtcattcgttcttccagcagcttgtatagtgcagccatcaaaagtggtgaggaggctgctctggagctgtgcacacctagggtggaaaagctctgtctagatttctcattccaaggttacctgcccctccaacattaaagggagaattggcacggaatcctgagatggaaagggccttggaagttccaaccccagatcttcctttgcttgtacagagaaagagactgagatcaggaaaggtttgatgatgacgtctggcagtattaggaatacaaacttatcccctttgctctcacacaattgttttatgcactgcaccattctgcttccctacaaataggagcaaattagctcccaccaaaagagtacaccctgtggggaaatgactggaaggtcaataatacgtatttgtattgacttaaggaatagtcaagctgctaaaagggttgatgctagttttcttcccttgacgtatttattaataatttaggatatggggaaaataagatgccttctggaattgatattagttgtaaagcatcatatatcagaggaaaagcgaagtaaggccaggagaccaaaatgttagattgtgagattaaaataatgctagatcttcaaatgggcaaatgatgcacagtgtgagaataaataaatacctgtatgttgttttgctttttattgtggtttatgtttatggttggattgcagtggttatgttttaattatctaaaaaaaatgataccagttgtcctctatccaaatgaacattgtctatcaaagtggtcaacttctaaggctacgtgcttaatccaatgatgttggcactacttaaaacatttttaaatgcctaaggcattttctttaaatattcctattaatggcagatttttgtagagaatcaactatgtttggtatgatgcaaaaaaatctttaggagaaaatgtgtgtccctataaaggttgtggaaggttgggaaaatcatttggagtaaaacaaaagaggagtagattactgaaaacatgacgatgttttcgaaagcgatccatatgttctaaaggaacagtgggatgatgtgatgtgagagaagtgctcatcttccaaatctctcccagtgactctaccttagtttgaatgtgaaacagttttaaaggcagatgtgctctggactgcattcatcaaacatttagccagcactcttggtgcaatgatgcctccattgtctccactggtgaaagacgtgtgtgggcagaagctgagctattgcaaagttcagtgattgctacctgtggaaggtggtgatagaagtgtcaggctgatgtgaagacaggcatggcatggcctaagatctgcccatttaatctggtgctcccctctcttcttgatgcaaagaggaaaaggagatactttagtctcaaagtcaaatcagagtgatgcatggagacagttaaatgctgtttgcctctgtgatgccaatgagctgcaaccctggttttctattctttgctcaacaccagaagttaaggctatgggaagggatgcatcacggcagctgtacactgagaatgagcccagaggagagctttttagaagcatctgctcgtctttatttgagaaactcagccctttcgagtcgcttggatcaagtatagctttctaaggtgagaagaaacttgaaaggcagttctgatatctaatatggaattcttattattgcataggttcatttcacgtcattctagaaagttataggtgcatttcacggttcaaaagtagaaatgtcaggagaaaacatcaaaaagagaaatcccattttacactgatcggagatcacagggtgtaagatgaaggaactgagaagtagaaaaacataacctcactcacctgcccagagttgctgcttcctgctggctggggtgccttggtttgcattgtatatgacctctctccaagagtctacacttgtcttcctcagtgtatggtggcctcagagttcctttaccaggggacaagagtgaaagctgcaaggtctcttaagattgaattcccagacttcgcacagcatttactctgccacattctgtgtgtcaaagtacataacaagcctattctcagatcaagggcatggaaatagactctgtgtctttatggtggacacaggaaggtgtcattcatcaggcattattaggaaggcaatctgcaacatttctttctgaattgcctcaaagagaacatgactggcatcttgatttctgaagtccatgtcttaaatcctcacatggttccttttgtgacacagtttctatttattgaaaagctaaatctggaagaaggaaatcataaaggaagatctatagaaacatttattcttgaatatatatgtatgtatatatcacaaaaactacgggttttgatattctgcagttaaatttgttcatatggttgttcatttaatttacttatttaacatatttcaataagtaatacatgcacatggcagaaaattcaaaggtacgaaagggcatacatggattgaaaagtaagccttttttccatatcatttctctctaccactcagtttcaccataagaaaccatattgctctatttgtagaaaatttggatttatatcattttattctattcaaatcaaatactcaagattaaataagaaggagacccatagagatggggaaaggggtatatttatttgattacaacaaactatgaagtcatcaactgactgtaccactttctgctgcctcacagattaaaaacataaataacagaaggagaaagaaaaaattgtggagatgtatacaggtaagaatctaggaagccccaccacaacccatcctcctgacttgcaaaatgcccggcaaggtgacagtgtggaggatgattaattatcactctggtatccccagccatcagaaagtgccctttttaaaggacctataaaatattaataaggtccacaagtttatttagctaatgtgtgacaccaatacattgtatcaccattagtttttgtctgcgatgctacaatgtgacttataaggcaaacatgactactgttaagatttaggaaataggtatgagcttggtggcaggcaggagaaattactgagaagatgacagtattttcaattcatttcagtagcatacttggtgcagaagccaggttgtggagaattgagcagtaatagctcaaggacaagtaatagacaaccctgttaataagtttatctgtgaaggaaagaataatagctacagcaagtcattcaatcacataagtgatgttttcatgggaaagacttgaacatcagccttacctattgctacaggccaacttactcttggagtaaagcaagctttatggagagtcacatatatatgccaccccatctttagtagacaccgcaggctcccatgatctgagtcagagatgacaggggagaagctaagaattgtagctcgcatttactgaatgtttgctacacgctagaccctgtcttgtttaatttacacaaattatgccattacaacttcacagcaatccagttgggtaccattgttgtacctgtcctacaagcgaagaaactgaggtctacagaggttaaaaaatttcctgaaagccactcaactaatctgtgacaaggctaatatcagaccctgagtagcctgatgacagaagtcaccatgctatacaccacccctgactgagcctcacacaaaagaatgtcaaaacgtgcagggatatttgaacatatcaaccaatcttgttgtagccataaagtccatgaatgtagaggttgggcccaagtgttctcctttgtctctccggttccctctcacttacatatttcattgtagatacaattaaccttcttatgatcagacaaagctcttaaagattccagagattactcaatggtgcaacttactctgaacacaacacaaacttatccactccatgatgactgaaaagactaaacaagagaactctgttctcttcaatgtgagagggatgtctggagcagagagaagtcaggttggtgtgatgattaaattttacaagtcaatcatggccaaacaccaatttagatattgctgcaaaagtatgttgtagatgggattaacattccctatcacttgacatcaaggagttgaccctcaatacatggtggcctacatccaatcccttgaagaccttaagagctgaaacagatttcctagagtaaagaaattcagcctcaggaaattcaagacagtaacatagaaatcctgagtttccggcatactgcttcctctacttattttagacttgccagtcctcatcatcaggtgaaccaattccttacaagtaaatgtcatcgatggatacatatagaaagacaaaaacgtacatctgcatgtgtatttgtctatctatctatctatctatctatcatctacctgtcaatcatttctcatctatctcttgctatttatatctacttatccatgtctatctatctatctatctatctatcatctacttatctgtcaatcatttctcatctatctcttgctatttatatctacttatccatgtctatctatctatctatctatcatctatctattgatctatctataatctacctatcatttacgtgtcaattgtttgtcatctatcacttgctatttatcatctacctatccatgtctatctatctatctatctatcatctacttatcatctacctgtcaatcatttgttatctatctcttgctatttatcatctacctatccatgtctgtctatctattgatctctctataatatacctatcatctgcctatctgtcaatcatttgtcatctctctttagctatttatcatctacttagccctatctatctatctatctatctgtcatctatctttcaatcatctatatatctatctgtctacctcattatctatctatcctattggttttgtttctctggaaaactctgaccaatgcagtcagtgtgaagggacagatcaatatgactgataactcacaggtaaaacttatatttatgaaaccagctttctttcacattgactgttacttgattactcacacccagggcttctatctggatttgttcacagtgtttcctttatcttcagtcgctcttctcttttttcagtgtttttcatcttcatcaacgtagatttctttttgtctcctggtgggttttctttctccctgatatggtttggctgtgtccccacccaattcttatcttgaattgtaactcccataattcccacatgttgttggagagacccagtggggggtaattgaatcgtgggggcaggtctttcccatgctgttctggtgatagtgaataagtcttacgagatctgatggttttataaaggggagttcccctccacatgctctcttgcctgctgccatgtaagatgtgactttgctcctcattcaccttccgccatgattgtgaggccgccccagccatgtggaactgtggaactttataaattatgtagtctctagtatgtctttattagcagcatgaggacagaataatacactttcctaatgtttcattggcactttcatgttcttttaagtattttatcaggcttatccaaatttatatagttcctagaattttaacttttgattaaggaaatacatggtcagaaatataacattcttataaaaatcactacttaccagtcactttaatatatcaatcaagaagcattatttcctgtgattcaggaggtgaacacttgttttggctacaatgaattcatgtgaaaacatgtacaatccagtgaaacgaattattacgcaattaatatctgaatgcatttgtatgttttttggcttaccacctgtctctcaaccatctagccatgcatgaatactatcaggcttgtcttatttataataggaacacctaatcattgtgttattctaaatttttatttgtatttccagattatcaacccacctgctaatttagattattgtttagaaaagcagcatagctcttttattttatcaaaggtcattcagtaaatttaatatatttgatgccagaaaaagaaatctctttacacaaacataccctctacaagttacaagttaaaagcaatatttatttaaaatagcaaacaataaacttttaatcgctaccactgtcttacattattttatgcaatatgccatagctaagaaaatcttctctacttttttcctatccagttagtgaatacattttaagtattaaatggaagaattagattcttaggcgagacagaatacatataaaaagatgttaatatttaataataaaagttgaaaatatattacaaaataaagtaagaaattttattatctccaagagtatcctttttataaattatttttcttggtttcttgtgctgtttaaattttcttgatttctttgcaatgatattgctttgcagatacctgaattatgtcgtgtctacagatcccatgagtatgtagccatagcaatgaacaacacaggtaatggttctgattttatatggattcatgaaccctcgaaattagacctttcccattttaagaaaaaagaaagaaacatctctacctataagaattaggtatatatagccgggcgcggtggcgggcgcctgtagtcccagctactcgggaggctgaggcaggagaatggcgtgaacccgggaagcagagcttgcagtgagccgagattgcgccactgcagtccgcagtccggcctgggcgacagagcgagactccgtctcaaaaaaaaaaaaaaaaaaaaaaaaaaaaaaaaagaattaggtatatagaatattttacatactatgctcatatgtacaaaatgagtagttggaagtaaatgtgagaataaacagtatgcagtggatgaaacatatattctagtttgaaaactcagaagtgcacatttaaagagaaaatctataaacctgactgctttacattagtggaaaaagtagtctgaattatgttacaatttgcaggtatatacatatttattactttaagaacttgcacaatatgtaaagaagagctttgctttacatgagtaacattttactaagtgatgtctaaatcatcatgaattctcagttagctagagcagcaataatgacattttattgtaggagaggaatatcctaatgaatgtagcttaatctggtattttcagaagtggcttttcatcaggtgtagaacctggattaacagctgattttgcctacatcatatttgattctcagaaaactttccagtatgatagataaaaattataaggatctgatgtaaactcctgaggccataacttatgcccattttctaaggcaatacttaaaacaaaaatttttaacagcaataaactctgttcttgtgaccacctcattttcctcctcaaaattcacaacctatctccattactgcgtgactttttgttttgttttgttttttagcgacagggtcttcctctatcacccaggctggagtgcagtggagcgatcatagctcactgaaggctcaaactactgggctcaagtgatccccctacctcagcctcccgagtaactgaaactaccggtgcgtggcaccctgcctggctaattttttcttttttttcttttttttttcttttgtacaaacaggttctcactacgttgctcaagttgatctcaaactcattgcctcaagcgatccactcacctcagcctccatgctaggattacaggcatgagccaccacacccagccctaaatgacatttaattttggaaatctcccaccaattcaatccagcctaaattatttgtaccactctttccttttgatcatccattatttttaagtatcaacattcaactctctatgtttcctcatagttttgtatattacatcccacttcgtttatccctaggtcttctcaaacaaattaccagggaatctcctcaaacctttttgcagatgtctcctcttgctcctttccttcctgtttctatatttgtcatttagaatttgagacctgctaaagacaaaccacacatttcttccagttcctgtgtgggaaggtcaaaggtctatgtgtgtgtcttactgacatgtcctttcctgtaaacgctgtacctggtgttcccataaaatctggcttcttgaaaatggcaataatgactgcattcatgtgttgagtgtgttctctggatcagtcatttcattgggttcttggaaagtgcgttttatctaattgtcacagatacatgacaaggacagtgtttttttcatcatccccattttatagatgattgagctgaggtttctttgagttaggtactggacccacagtggaaaaattagttcttcattccagataatgtcttagaatttttccagctctgatgttcaaaatttaaattttgtcatggaaataaagtaacatgaatctccactacagaagtggcgaatagcttagcttggttgaagaaaagtttgcattctaagctgacttcacagattgtagaatccactgaccttctatagaagaagtgaagaaagtctgagaaaattccccacaatctctccttgatttcttccccatgagtttgcactgaggaccaagttccacctctaaagacaaatcttatggtgttgaaacagccttttcccaagggaaaattgagtctcattttcatgggatgctaattttgatgctctgaaaaaaaaaaaaatcctatttggtggtcaaataaatttgagagtcctggactaaataaaactgaaatgagttttattttttgttatttggggttttttgtttgttttttttaaagccatgtgttcatagagtatctggtgtattcactcctgtctctgagagggtgacatgatatacatgcattgacaaatttatcagactgtagaactccaaattttttttgatgcacccaatacctattaataaatctcaaaagtgtttatctaagggactgttatgttaagatttttttttagtatgccctgattaatgtacaaataccccaaaatgactcatagaataagccaatggcctcccctcagcccaggattcattggctgcacactagaatcacaggaggcctcataggagctttagaaaacattgttgccagaatctgttgaaatttttggaagctgcccaggttattctaatgtgcagccaaggttgagaagcactggcttaggctgagcacaaaattgggttatcggagtgctgtgcaggtgtgcttgggacttgtgggtggactctccggaggcaagaattgggaggaagaaattaatagagatgaggtaatgggtgaaggagatccagagtctgaggaagcatctatgagggaaaagttaaaaccctgcatggactttagagaacaaaaagggttttgagattggcataggaagtattgaaaaagagaaactttaaaaaaatgaagggaatacactttcttcctacatattatacttttgctgtctgcctgccagtcccagctacttggagacaggtagtgaggtggatatttaactcgaagtatacacagttagcaagcattacaatggttctatctttgtgtgacttacactgtgcctatcacatgtcggtatcaataaacattcatggaagtaaacagggagccctgatttttaaactctaaattaacacttgacgttaacacacattcattaagaatcagcagcatgctagtcatgataactgttaaaccaattccaaattatagattttactcctatgaaattgcatatctctagcagtgtgtgcaagccacaaataatatgctttctctctgcctgggcactgttatattcattaaaatgcattcgatttctctttaatttgtaaactgaagcaagcattcaataagattctctgcaacctatttattcacctgcctttgcagttgctgtgcaatgtcattcctctacaagaaatggatatttcttttccaatctttaataattaagcaagtgtgattttcccctcttttagttgccttagcaccctctaattgggagggtctattttgtattctattatttcacttccatcccctatttcctcatgaaataaaaatcatgtgttcaagtaccttgcaaaaagtacatggtaagctttcttttaaaaccatgtctactttcagagaagaagctttggactataaatatatttgagtgagggtgaaaatgcaaaaccgatttggtttttgcttccatgcttcagatctacaggtcattaattatttattttcatcctgaaagcattttttttctatctatacaatgcccaagcctctcaaggaattttaagcaataaaggtaaaaaggttttctgtttttgataaataatattgagtttaaaataactggttgaagaaaggcattgggaatgcttccgtgatgtactgtgagcatggatctgctggtcatgcattatttagtatattctatatggggaaatacactttgcatttgggttttgaaagaggagttttgaaaatggtgttttgcatctgaattctgctttttcactagactgcatttgcaacgatgcatgtctgcaagaccccatggacaactttcatctgatgcacgcactcattcttgctttgacactccaagccaagtcacatttgtttccaccaagtcagacaacttcgatggctctctgcatctcactatatctctgtcctgctgatgccaccaaatgaccagagatggtccagacaatttacaagaaaggacgtgggcaagcctcatgcaaagtaagaaatagctagcttgtctttggtatttagcaatgtttaaattgatttgctctttcctcacttcactcctggctagctcctcgggatttagagtgctgatgcccaagtattgaattgtaattgttccggatctgagctgccatccctgagctccctacctccagtgtacattttttttttccagaattacatctccctccttttcctcttttattttttgcattgtaatgcttctatcaggcaaacccgtaacaaattaagatgcctgaaacagttaacgtaaaaaaagattgtttatttttcaaattgaaataaaagcatgtagcataaacattgatttaatttttagtgtaatttcaggctgttttctttacaacttgaatatgtcttcctcttccaaggtttggtttcaaggccatctccctcataccacctgctgccatgcaccccgtcctcatgccccactctttcggaaaggattctttcttatttagaggtatcacaactttttttcttagcttctattatgcattttattctgccttggagagtgagttgctgacatgcccttattgatataagctacatgatggcagcagtgaggtgtcacattaccttatcattttcagtagaaacaatgattcttccatggccaggttttaaaacctcttgccatagaagtcattgtttttactgaaacattctgttttaaaaccagctggatgtagtggctcacgcctataatcccaacatttttggaggcggaggcgggaggatcgcttgagtccaggagtttgacgccaccctgggcaacatagggtgacccaattgctacaaaaaaaaaaaaaaaaaaaaaaaaaattaacaattagccaggcttggtggcgcatgtctgtggtcccagctacttgagaggctgatgtgagaggattgcttgagaccaggagatagaggctacagtgggctgtgatcgtgccactctgcactctggcctgggtgacagagcaagaccctgtctcaatcaatcaatacagtttcctctctccccaaccacagtgctaacgtttgctccctctaccccaaggtgaaaggctggaaggctggtttaagattttcatccccagatacatagatctgaatttaaaaatacattggtgttttgaattatttgtgtggacattgacttttttaaaatgcggtttttaaatttgcagtttaataaaactgttaagttttatccatctggtggaatataatacttaaagcagaaaaaaatgtgtgctcataacttatgtttatctaaaatttgtatttgaggccactatgtaaaataaatagactgaaaaataagagcgtctctgcaaaaacaagtatttgtggtcttttcagcagcttgaatagttagatttctcttagtaagttgaatgatttaccctgttttctttttttggctaaataaatcatatttgtctatttttaacttcttttaagtttatgcagaaactctaaagttgcggaggaaaagcactgtattaacaaggcctattttcccagaatgaagggaaacttttgcttgtacaaggttaatttgcaaagcacaatttataacactatagagacgtctctcttgaaaccaagggccctatcatttctttttcatttgacatctgcagagtaagagtaaatatttcttaatttagaggaaggtaaggctatttttcaagtgaatccactaaattaatccactggagtaggcgttatttccttcatcacccgtctgccttaaatatagtacctgcacattcaaggcaaatgcaaaaatagcttcagatttaaataggtgatattgtctcacatataaaagatgagtcttgtctgtgatataaaagtagctgtttaatacttttagcaattttcagtggctttattttttcatatagttcctgtatttggaatgtaattaatggaaaggtttagctttgtccttgaaaaggtttccatttttctagcaggcttgagtcactcactaataataaacatgctgtatttttagctacatatccatctattttccatctaattcatttatttatttacagcttgtcctgtccctaagcttctaatgtggtagcacattagaaaatgttatccttattgcgtattcatctcaatttgaagatatcagaactccgtcaagacaaggctgggtacggtggctcatgcttattatcctagcacattgggaggccaaggcaggtggatcacttgaggtcaggagtttgggaccagcctggccaacatggcgaaaccccatctctattaaaaatacaaaaattagcctggtgtggtggcacatgcctgtaatcccagctacttgggaggctgaggctcgagaatcacttgaacccgggaggcagaggttgcggtgagccgagatagcaccactgcactccagcctaagtgacagagtgagattctgactcaaaataaataaataaataaataaataaatagtcaagaaatggttcaggttagaaatctgattctggtaatgtatttaagaaaatatccagtatccaaaatatttcaactgcatttacatattattattatatataccaacatgtccacacacaacatacatttacactggtctccagcttaaattgactcactcaggtacactcccctggcctgtttaatagagggggtcatgtctcttgttgtaccttattgtagacaaaattataagctcatacttgaggtctcttctttgtttctaacatataggaccgagagttgaaacataatacataaaaatggaacagtgatagtcagatttccaaatgaggaaattgtcttcttaggaatagaaaccagatgggaactcaacacagtagtggccaggaactgctggactctaggcccaagagccaggagacacccggagtgtaattcctgggaaattatgaaaggtgccccaggagtctgggagacagagccctttctttccagaaataagagagtttgaagacagctactgaccattactcagagctggcatttctatgaaattgatatcctagggaggagaaagggagctgacaaaacgtcaccaccaagaaccaactgagcaggctacagattcagtgaatggactcatgactatgccactcacgtctctgggtgggagctccaaccactgaggataagaccatagagaagggtaaggggataaggaaatagacacatgaagacagatgtgtgtgcaaagaagaaagagagacagagacagagtgagagagacgcatcttactcacctgaagatccaaatcccaaaacacatgcaaaaagaatcaagaagtggaaaatgcagtcttccaaattaaccacaagtttagattttaaaatagacattaagtgaaattctttagaatggggcaagcattctctagaggagcagttgccttcagcacaggacctataatgcctccagggaacggtacctctaatgcctctggagaccacaagggagaaacaaaggaaggcacatgcaagaaaaaacagcaatcatgaaaagagcaaaaaaatcatgaaacagagacaggcaggcaccagataaaagcaagtgggtatagaaattgcaaaatcacaactacagaaacaaaaaagatacagtaaataatatggtttggctgtgtgtccgcacccaaatctcaccttgaattgtaataatcccaacgtgttgtgggaggaacctggtgggaggtaattgaatcatgcgggatgggtttttcccatgctgttctcatggtagtgaataagtctcatgagatctgatggctttgtaaatggcagttcccctgcgcacactctcttgcctgccaccatgtaagacatccctttgctcttcatcttctgccatgattgtgaggccttcccagccatgtggaactgtgagtccattaaacctctttcttttataaattactcagtctcggctatgtctttattagcagcatgagaacagactaatatagtaatggaaataaaatataatactgtaaagtgtagactctacaatcaaagaggacactgaaacatagtacagaggatgcacaaagaaataaaaaataatatgaatacgtaaagagctgttaggagatatgtttatggacatgggttagtaaaaggagatgagagtaaaccacggcaacaatgattgggtagataaaggatggaaatattcctaaattaaagaaacatatgagctctcacattgaaatacatcacttgagtaccaaataaaatgatcagtaaatccacaggttgatgtaaaactaaagaatattgagaatgaagataaagttaagtaccttcccaagatattaataaaaagcagattgcatagaaaaactgttagtctgttaggagattcacataaacctcaggagaagtgaaagcgtcttggagaagtagcctaagtattgaaaaataatcgtcaattgaaaatccaatatccaggtagcctcagatcaagatgaagctatggaaaccactttcagatatacaaagactaggaatttaccacccatatatccttaatgaacaaattaacaaggacagttcttcagcaagaataaaggggaaacaggacagttcttcagaggaataaagggaaacaattgggcagaaaataatggggatttcagatactgttaaacattgataaatttcgtgagccatccactaagaccaaatgataaagattgcaattattatttcaggtaaacccaattctagaaggaggatggttatgggatgtggttttcaaatatcataaacatgctaaattttaaataactaaaacttatactttattgaaaacgtaagtgtattgaaattgtaaacatacaatattctgaatttatagttccctctgcctaaaatgcttttaacagcagatttgtatgtcaactctgtagtccatagctgtgaaaatttggcaaaagcacccagattctgttgtgtctgtaaaaactgacttcctctaacgtctagggctgtgctacttaaagtaaatgtggatataaatcccccaggaatccagttaaaagcaaaagcacccagattctgttgtgtctgtaaaaactgacttcctctaacgtctagagctgtgctagttaaactaaatgtgggtataaatcccccaggaagccagttaaatgcagattctggttcagtagggctgtagcagggcctgagagtatgcatttctaacaagcccccaggtggtgcaggtctaaagggtgcatattgactggggagatgcatgaataacaccacttctctccagctatttctaaaataaggaaactttccttcagcatttaccttaagtgtttagacaatgcattaagtacaacaaaaactatcatgaggaaccagatgtcacctacgacctataccacacttttccattttcatctctaataaggcggccttataacctcctctaggtcaaaagcaggagatggcaatctttttttctgcaaaggacaagatagtaaatattttcagctttgaggccagatggtctctatcaccactattccactctgccttcattacattgtagcaggaaggcagctatagacattatgtaaatagagggatgtgtgtggctttgttccaataaaacttcttctgcaaaaacaggtggcagagaagatgtatttcatgggccctagcttgcagacccctggacgataggttaacccaagtcactagtcccactagtccttctgagtaattttgagcagaaaaatcctcaaatattccttgatacttgacattttctatgcatctcagtaattaatcaagtgctatttaacattattctgttgttttgttttgttttgttttgttttgagatggagtctcgctctgtcacccaggctggagtgcagtggtgctatctcggctcactgcaacctccacctcctgggttcagtcaattctcctgcctcagcctcctgagtagctggaactacaggaacgtgccaccatgcccggctagtttttgtatttttagtagagatggagtttcaccatgttgcccaggctggtctagaactcctgacttcaggtgatccacccgcctcggcctcccagagtgctgggattccaggcatgagccactgtgcctggcctaacattattcttaaaagaacctaccactgaagtcctcagatcttgtgtatgaacacactcatggtgatctgttgcagctgggtaactggaagactttaaacaggggatcttggtttttccacgttcctccttgattgattgatatctgtctctgggcagcctaagtcacctgacctttcatgtaagacacaaccaaattcaatcccaggaaggttaagcctgttacccaaggacataaatcttgttcacaacagggttgaggctggattccagctttctgatttccttgtccaattattttcttaccatgcaaacagtagtctctgtttcctgttgaatatgtctacttccagcccttttggaagttcaccctctcccttaatgttttatggtacttgtctgtgtaccaatgtgtttttgcctttttctacatggcttttgctcaacataagaagttgcaggaaaaatgtaaatggcattaaatattcaatactctttttcccttaaagagaagttgtctacataaacagaattagagtgtgatttcctacaataatagtcttcctttactaggaaggaaatctaatgggccttttctccagctcttactgctgttttcagacaagtatacagctagcagctatccttgataatgcaggcatgacaaagggaaggacaaagaaagcccttctttttgtattggatttaaaaggtcttcactgatatagatatttttgttttataacccattctgtgatgtctgacagcaatttctttctgtgacctccccttccagtggcaggcatggttatctgtttcccagtggcagtgcatggagtgtctgtccgcagagcatctgtgtggcgatcaggagcggcggttcaggccacttcatcttttgcaccatgcctctcacccggatgcatcttattcttttatgtttccctgtacacttgctcttgaactgaatattacttcttataaccaagtactctattgttgaggttaaaatgcttagagatatctgattctaatttttcacagaaaatgccacctcacacattcagttaataaataaaacaactgggccatagagaggctattgaggaagagtggaaagggatgaagtgggtttgagtctccgatcccgaagctcaaaaacagtgatcgcttttttattatttttccagcataccctcttttcagacatacaaatatgttcactgaatgtgcgtagtcacaagagacaaggatgatatgcattttaaaatatgtatattacaagggtctttcttagcaaaattcatgcataccctgcattttgagagctgcttctagctgttagcctggctgaataatacacaaatttataattcatgatacgcaagagggaaaatgagcaaaataatatcataggatatgaaccttgccttccaaagatgcaaatccacccatgctctttttatgacttggaaggagtcacttagtcaaaataacttagagtggagaatgcccaaatgctttggcaccagcaaagctgtgcgaggttgccagaatatgttccaaatgcatagagatgggagttagcattaaaagccattagctcatgcccaaaatctggcacgtccattcactgacagtcctctgatattacctttcagtctggattcccttaaacttggagttgaagagatgctactgaatcttgggtactcttatagaatgacatgtataattattaatccagtgacctcccttagtccttcaaataaatgttattgtcacatgctactttatttgaagcaccatacgtattaggtggtgcaacagtaattgcagtttttgccattgaaagtaatggcaaaacccataattacctttgcaccaacctagtagttaaaagaattcatcataaaacagaaaacatactaaccagtgttttacttattcacagttatataaagaatggcactgcctaaaaatgtttctattttgctttgaaattcatagcaatgcccatttctagaagaaacaaagggtgcctattctagcagctcatggtcctaacatgagattagaagtttattcttactcctactagcccagtggtatacaccactctatacagcaatgcacacctgtagcacagcatgttacgatcctaaaagagcaaagaaaatgggagctagaccatacctcagaccctctcatccctttcctttcccgcttactgaggccagtgacatttggaagaccagtgtgtaattttccacattggacagacctgattttattcttggtcaacattgacaattttctcctttctaaaatggatgtattggtatctagctcacagggaaggtgtggagattcacctgaggatacacataaacagcaaagcagaatgtctagcctttaaaaggtctttatgtaaccagaacttttttttctccttgtatctcccatgaaggcctggacattatcaagccttccctgacacacatgaacaaggtaggtcaatcccaccccaaactcaacataatctggaatcagtactttgttgcaaagcatatagctatggcactgactctgcattttatgcgcagaggagatcagagacataacatggttttgaaccataggatgtactttcttttcatggtacttcaaagtctcccactgctactagcaccaaagtctcaatttcatgaattgcccatatagatagacagtgatcagcctctcgcccccttcatcccaaaagcttttcttcagtggaaaatcttcctgcaagggaattgtacctgtagaatggggaagaaaaagcagaaagcatgaatctgtatagatatgagaagcaagggtggctccctgcttggatgaactaggtctctgtgcatgagggtcttcagtgttttcctgcactagaccgacaattgtctatctatatgggcaattcttgacattcagactttggtgctagtgtcagtgggagactttgaagtaccatgaaaagaaagtacatctggtttaaaacaatgttatgtctccaagctcctctgcgcataaaatgtagagtcagtgccatagctatatgctttgcaacacagtactgattccagattatcttgagtctgggaggggggcattgacttatcttgttcatgtgtgtcagggaaggcttgataatgtccatgccttcatgggagatacaaggagaacaaacagttctgattatataagatcttttaaaggctggtgcattagctgcttattttggttcaaaatcttacaaaaatatgagaggaatcaggtattactttgagcatttgaaacacctgtggcagaggaacttgaaaagaatgtgtcacttttcattgtctggttttctagccctttgtcacaaggtgattttattcttgtgcatctaatgaccaggagacatcatgatggtttcattagcacctgtggccccatatggtgtcttaagtgtgaccagtataagcgtgctaattttcttaaaggaagcaaaattaaactgtgtttcttgttagagatggaaaacaggtggtcagccttatcattctcgctaaaccttatggtttccagatttaaacaaccttgtgaggtctgttaaaggtggtgtaatgtggactctgtttagtcaacatgtaattcactatcctatttcctcttcagtgattaaagtgaaagtcaggctcttccaggagttttccagtggagcataaaagaaagagacagtggaagagaaattgtacttattgaaaggaatattagccagatgactctttgagtgactgcagatgactgttccctaagtctagctatttcttttcttgtaaactttttttttcccatttccattccctaagtcaggatccagaacgttttgtggttcttctatgtgtttgattttcaaactttgactccatcaggatgaaatttcctaatctatgcaggaggaatagctttattcaacaaacatccatggtcctttctgactgtcaggtgttatacaacaacaaggtttgattgcctgttgcatgataacaggcaccaatgcaccaatgcatcaaaacagcaggagttgcagtagagaaagagtttaatcatcatagggcaactaaatgaggagatgggagagaacctcaaacccacctttctgaggagttttggactggagtttttaagggaattttggtgggtagggggctgaggagctgggggttgtttatagggtgtgattagggatgaaaccataaagatatagaaactgcattttttcattgagtcagttccttggaggggatcttaagacagactggcatcactggacccattggaatgcagaatctggaaaatatctccaatggagaacttgaagtttcttaatgttaagatgttatctatagaaacaattagggaaagttaggaccttgtgacaggagccacgtgactttttgacagtaagcagctataaggaagtgggctgttgggcaagctggttaatgcttagctttgcttctgctcaaagcttaggcttttacttaaaaactaccaattcagttgcattaatttaatggtgatggcttcacaggcactgtattaagtgctcaccctgcattaattctttccatctgtatgacaaccatgtgatgtaggtgctcataatgtctccatctacagatgaagaagtggaggtacagggaaggtaagtaatttttcagatatacagttgggatggtcaaagccaagtctggactagactctacatgctttctccatccctatatctgcataaacatgttcagacaatgaaacaaaacaatgcttgtaaagtatcccacccaatgacaggtgcaagaaggcaaccacaaaatggaaattatctttttccctgaaatagtcttattcctgggactcagggttcttgcctttagtctgtgtcccctgtgattcattcctttcactatataagttttgtgctctttatactcacttagataatcacattactattacctggagtgaagtgcaaagccgtgttcttcagccaggaggctccatctttcctcaggcaagccttattcttaatcattttctacctcaaaacctgtaagctgcttgcagaggttgctcaatgcctcccagagcctgtattttccttacatatggcaagcattcaatcaataattgctgtttgatcaatatgccaaatgtaactcttcatgtggataagtttacagagtcttttccattgagtcttttccattctttcctgttataaaatcaactatgaacagttgatgaacagacttggctttgaccatcccatctgtatatctgaaaaatacttaacttccctgtacttctattccttcatctatagatggagatattatgagtacctacatcacatggttgtcatacagatggaaagaattcatgcagtgtgagcacttaaaacagtgcctgtgaagccatcatcatgaaattaatgcaactgaattggttagtttttaagcaaaagcctaagctttgagcagaagcaaagctaagcattaaccagcttgtccaacagcccacttccttatagctacttcctgtctaaaagtcatgtggcccctgtcacgaggtcctaactttcgttggaaaatagtttattttataacaggaaagaatgccatagagacagatcacaggaaggaaaagagacaaaatcttcacaaatgggagtggagacttgcacttgaagaaaaatgttgcctttctcagaatttgttaggtgagatttcagtctctaacttagtgcctcactgtctgtgttcctcacagcatgggttaatctggtatgagatacaaacctatttcaaggcagggacaaatataggccttcaatttttttttttctaatttggtatgggttatctatagaagtgtaaatggttcacagcaagagattgcttttcagagaagtacatgtaagatacagaaatctctagatgtgtctgtaccttaactttgaaaaagagaaacttttaaaaggtaagagctgtttttcctaaagagtcattttagaaaatgttctagatcttcctgtacataataaggcttctaagcatttggggttattttaaaaattggattttaaatattttaaacatttggatttcagaatattcagatttattttattctcccagtattgcaaatacaaaggcaaccatgcagtataagaagagaacaggataaaatgaacatggacatgactttaaaaagaattcaaagttcaatgaccaaatttaaattcgcattggaatttgtaaagaatgtaactgacactaaaaattttctggcatgtaaaacatggggcacattcccagaatgcagacaaataggacaaatagaataaatttaaaaagaaattaaaaatacaaatgacaaacaaaagaatcaacttataattagtgttcttgaagatgattcacaagcaaatggagcagaaataatattcaaggttgtaacaaaagaaaacttttctacagaaaaaaaaagcagagttgcagattaattgggttcactttggtttgaggaaaacttaataaaaatagaaccaaaccaaaatgtgttgtatcatcatagtttaaataaaagtgaaatatcaactataatcaccctggcaaacaaagtatgtggcatgggatggaagtattcctgggctgggtccaacttctctgtaataccaaacaatgaaagatcaagtaatatctacagagtgttgacgggttaggattcagggcccaagaattcaaccccaaaaaagattttcctcaagtgtaatggcaagagaaagagacactaaggtatgctatggtttacgatatataccacacaaatagcttttctgaaaaaaattacttggatatatattccagtttaccaacatgtagattaaaataatgaccctgcttaaaatcccctgattgaattatttatttaatcaacttactagacaattattgaaaacttgattgtaatggaaagaatgagctcaacataattattgaaaaggaataatactaaaaattatagctattttagtaaccaccattttgttatagatgccattcactgtattttgaaattcacatcatctatttaagtctcatgagttaagccttatagcccgaactcatagagaaaaacagagttggatgaagtcatatacccaagatgatgtgaaaattttctgagggatgcaacagaggcatcctatttccaatatcatggctcatccgcagatttggccaaaatccagaccagcagtttgcaaatgtttctatgctttagaatcagctgaggaactgcaaagacagtcatgcctgtgtggccccccacctctgagattctgaattgattttctggggtgccacctggtgtttggagttttaaacaaaaccttggatgattctaaggtgcatacaaagttaagaaccatgaatttaaacaataatatccgatctcttctacaaagacttggaaatggtgtgagaggagcagaaagaagtttaaatctgtcactactcatagggaataatcaacggtaattgctgggtttttcgttttgacaattagatcaagattgttgcacagctcttaatacactggtaggaaatatggaagagtttcgaggggacattgcaatgaaatgggattgagctagggcagtggtgcacacctggggcaattgtatccccagtagacatttggtaatatttggagacatttttggctgtcatcactgggaagcatggagattgactattggcatctcctgagatactgataaaaatttgggaaaaaggcatggattcctccaggtagagagtgtatgataagattaatgacatatttcctaaacatttatttttccctaaatcaaaatgactgtctatccatgtgtgcgtgcatgtatgtgtacatgtatgcatgcatacatattcattttcactatatttctattcttcatttaattttattcctttcaagtttgaccaaaagaccttacaaccagtctgttggtattttgaaagaaaatttatatttgtccccattttctttataatctttcaactttgaccacaaacctatattgttttcttcaactgatacattttgggtagcatcaaaattatattcagtatcgtgctttggagaggaaaaacgtgctgttcccattttcaagcatgccgcaatcctgaatctactccttacaaaatttctgtgtcagcttggatacatgatgtttttttctctatgtgtttgggttataatacataactaattctgtttaattctgtttttttctctacgtgtttgggttataatacataactcatgtcaccattatgagacttaaaaaagataacttatgcaaatttcaaaatatagtgtaaaatagagacagtggcatataacaaaatcgtaagtacataacaaaacagtggtattgcactatgatatcttcagtaaatacatataagtgttgtacccagtgtcacgtctcagttgctgtcatatcaccaacattatttttgctttctcctcttagttgtatcttacgagagccacatacgatcatttaagtcagagatgaaaattcaaatgcctgcaggagacaggcagctatcacatgggcatgattcaggctgagtgtgaacagcggggaactagggatgtctgcaattggagagtgcttgcccactgcaagaaggaggagaaggagggcggggagggggaagaggaggaaaaggaggagaagaagaagaaggaggaggagaaaaggaagggagggagggaagaggagggggagggagggaagaggaggaggggagggaagaggagagaaggagtaggagggagggaagaggaggaaggggagggaggaaagaggaagagtgaggaggagagggagaagggaaaagagaaggaaaaggagaaggagaaaaagaaggaaaaggagaaggggaaagaaggaaaggagaaggggaaggagtagggggagaaggaagaggaagaggatgaggaggaggagaagaaaaccaaagaggaggaggaagaagagaaggtggaggagacagtaaacatgaggtctaggctgaccaaacaaagcgcttctgcaggttagcatagccccttgtgcctctcctgcccttggtcctagccatgcattgaagagaaaggggtagaatccgaatctgtgagtctctaaaagaaatttagacacatcagattattttgagtaaaatatatagaaaataaatattgctgtattgagtgcttttcagagcatatatgtgacgcatcttattttcctctattaaagaccatgtgcaataaagggtaatgggtggaagtgaggaaagacaaacccatcctgccccacctagaggacaagttactggtaacttgctgttttaaggaaacgacacagggagatcacaacgacctcaaaaggacttttctgcaaacaaatgtaagttatgttgcattcataagtaactgaagccaaaaccctactcaaaagggttatacaaaaaaggataattattggctcataccaactcagtggtcgaccattagccttgtgtaggaactgtattctttaccaagaattgtaagtattcaagaattgttggtgacaaccgtgcaagttttccctgttgtaaaattgtaacataatttattccaatgaaagaaacccatagacattatccttaacattgacagaccaactgcctagagaaattcttttctgaaactgtttcctaaaacaattagttattttacacacaccagcaataggactaagagaaaatagtatcagagatctttcagagaccgtatcaacagaaaaaaatgtaagttgaaagtacaaattagttttcagaataaatgttcagaataaatcattagccacctgctacttttaattagcaaagctttaaaagctcactcattgacttagcataatgtcctccaggttcatccatattgtcacaagtggcaggattttcgtagcagaataatattccattgggtgtatagattacattttttaaatccctttatccattgttggacacttgggctgtttttacattgtggctattatgaataatactgctatgaagatgggactgcagatagctcttcaagatcctggtttcagttattttagatatatactcagaagtgggattcctagatcatatgttagttccatttttgattttttgaggaacctccatatggttttccataatggccataccatcttacattcccaccaacagtgcacaagggtttcagttttttcatatcctcaccaacacttgctatcattttttttataatagccaacctaacaagtgtgaggtgatatctctttatagtttgatttgcatttgtctaaggattagtgatgtggagcatattttaatgtgcctgttggccatttgtatatctgctttggaagtgaaataagcctgtcacagaaggacaaataattcatgattccacttagatgaggcatctaaaatagtgacactgatggaagctactcaggggttgctaggagctggagtgggaaacatgttcaatgggtataaagtttcagttatgctagataataaggtctagagatctgcacatcaatgatgcctatagttaacaatgtggtattctacacttcaaaattcgtttagaggggagatctcatgttaagtgctcttaccacaaaattaatcaatctgtcaatcaacagaaggaaactttggaacatgttcaatttgtctatgtattagtccgttttcatgctgctgaaaaagacatacctgagactgggtaatttataaagaaaaagaggtttaatggactcagttccacatggctggagaggcctcataatcacgttggaaggtgaaaggcatgtcttacatggtggcatgcaagtgagaatgagaaccaagggaaaggggtttccctttataaaaccatcagactcatgagacttattcactaccacgagaacagtatggggaaacctcccccatgattcaattatctctcaccaggtccctcccacaacacgtgggaattatgggagctacaattcaagatgagatttgggtggggacacagccaaaccatatcagtttattaccttgattgtggtgactgtatcacagttatttgcaaatgtccaaactcatcagattatacagattaaatacgtgaaattatgtgtatatcaattatacttcaataaagctgttaaaaaataaaaactaaaataaaatagaaaataagttaaagtccacccactgaaaaaattatagtataaaacatagaattatgccaggcatggtggctcatgcctgtaatcccagcacttagggaggccaaggtgggaggatcacttgaggccaggagtccgggggcagcctgaccaacgtggcgaaaccacatctctactaaaaatacaaaaattagccaggtgtggtgccatgtgcctgtagttctagctactcaggaggctgaggcataagaatcccttgaacccaggaggcggaggtcgcagtgagccgagatcatgccattgcactcgtgcctgagcaacagagtgagactctgtctccaaaaaaaaaaaaaaaaagtgaaatcaggaaaaatttatataaaatctaaggcaaaaaaagatgcaaataatttatttaaaaattgatagtttgatttagcttttatttctgaaaattataatacgatatatccagagcaaatcgagaaaagcactttacacagtaaagcttggatatgttcaaagtcacaactagatagcaaaaaaatattccatttaaaaactgttaatctgtattaaaggaatcctgccaaaaaagaactgggaatctttcatgaatttataggcactgtttgccatcctgatccaatttttctcttgttgaaactgcttcattaatttaatgtgcaagaaataaatatttgatgtgcaattagttggagattattatggccataatggaacctttccaaataaacagctgctccagcactttaaatgcatgaaaagcaagacagaaaatggaaaatataatgaaacactagctctacaggaaaaaaagttaaaatattcaattagtgagtaaggtggctgctcatttagaagtttggtggtggtttatcaaagcataacagcataagagctcctaaactttagccaaatatccatccacctaaattttcatggaaacattcacctgcagatgtaatacattcttctctgacaagaagagagtgttaggagaatagacattggccaattctaccaatttcttcacgtgttttattatatatacataaatgtatatcaatgtatatttgttgagttttgattattctacattggcatttatatatgcactataaatacctatttgtatatccacatatgaattgtaatgattccactttgagagggaataatctgccttaaaagtttcacactgactgggctattttaagtctgagtgagcttctgaggtttcatagcatgtatgcagaccccgtgaaggaactgacactattaagttagttaaactccttgggagttttacaaaatgttatcttcctttcaaaatggactataagatttggagtcagttgtctctcttatctactgcactggaaagcacttgagggtagataccatggctaatatctcagtatctccaaaccctgatatagttcctgacacagagtagctcaaaagtattcattgaaagaatgcctaaggcaatttgcaatacagatggggaagagatagacatcaaagggtgagtattatgagctacacacacacacacacacacacacacacacaaaaagtttactaaaatagatcaatgtctcctattgagatgggagcaaaaggatgcaatcccattggcattctgttccactgcagacataatagcaaaagggcaaggttgttgctggaactggcagtatttggcttgtaattacagatttgaatatcaaaaataatcactgggaactgcttacaatgaccaatgttttggtatacttttctagaaaactgacttggggaaaatttattacttattggggctctattctattttgagattcgattctgcaattaattacattttactcctccgctttgctctaaaaaactcattggtccaagggaattcaatttttaaaaaaaaattattttctctgctccctgctgcttccatgagtgaaacacacgcacatatgcacacacatacatgcatacacatgctcacatgcgtactatggaggagcaaatgaaagaataaaggcattcatgtaacaccattttgccccagattcgatccattcgaatgtgatagatggacacgaactgtcttgctatacatggaggtgtaatgtctttgatggccctcccatgagtaggtagggttaatgcttccttccctggattctgggtgtacctacaatgtgtctaagaaggaggtgatgctgaaagtctcccaacacgaggtactcaaagatcatacggcttcttcccagtgtttgtggcattctcccctagggatgcaggcaccatgctttggagaagccaagcagccatatagataggtcccacatcaagtcccctgccagcagcctcagctgaagtctcagggacaggcaacaaaatccccagacatgtgagtcgtcagactcgcgatgatggagcccccagctatccttccagcaagccagctgtcgcatggaacagagacaagctgtgcccacagagacctgcccaaattgcagatttgtagggaaaaaaaaaagactgctgttgatttcagccactaagtatcatttgttatgaagcaaaacacaactaaaacacttgtgtgccagaatctgaaaccatttatttgataaacttatttttagcttataacataccaaagctattcaaatgtgtggcttcattgctacccatatcctgccgtccccacattacacagtaaggaggggatatttattaagaaatatcttcttgtgaagccagagcctaagtcactgctgctattcaggagcttacattataatgggagaaaatggggacaaatacataaattagtaccataaaaatagtacacaggagtactctgcaagttattcattcaatgcatgtgtaaggcatgctactgagtcccaggaacattgctcttcatgctataaatgcagcagggatgaaagtagacaaggatcctgctgtcagaaattctatatccctgtgcacatcaataaccagtagacaagcaaacacacaagaccctttcagatcaagaaaagtgcagaacacagccagggcacagagttgagaggaattgtgaccatagacagtgagggaaaccaggatctgtcccacaaaagatgcctctttaacatagaaattatttatgagccaaaagtaattagaaagcataaaatgaaggaaatgctggccctgtcctcctgcttttctgcctaaaggcaaaatatagattctcctttactggagatgactctaaactcttatcagcccagagatggcatcagagagatctgcaaacaaaacttactccattaagtttcttacaatatatttaccttcccaccattgctgtcccttggtagctgaaaccactttcctttgtcttaccatttctctacacatgcattgttcttggtggaatatatcctgtaagccagatttctaatccactgccttgagctacctttcactgagatttctcctgtatgatgtgaacagcacaggcgaatcagcttcctttttccttctgttgacttgccttttgttacaggagttcatcccaactgagcttatggaggatgagaaaaagtatatttcttccctgataatagactatggccgaatttttctttaataagatggcatttaagctgagatcttatggagaaaggtggttggccatggcaatacatgaggagagaatggggaaagagcaaatgcaaagacatttgagggacttggagaaacagaaagtcagaacgtgaccaacaagggggaagtaatgagagggagatcttttggagaaatatcccaggtgagtctttgtgggacacatgtgtgccagagtctgaaaccatttattcagatgtagtaaaagggccttcaattttattaccctgattgctacgggaagctactggcaggtgtcaagcagaagagtctagtaatcattcatgtggattgagtataaatcactttgactgctgagtggtgcttgggtgagaatcggaacagggagacccagttagaacactgcagttgatcttcattatctgcagattctgtatttgtaaatccatctagttgctacgtttatttgtaacccccaagtgaatactccctgtgcttttgtggacatgtgcagagtggtgaaatattctagtacattcccagctgaggttgagtaaggagacactctgccttcttgtttcagttctcatactgtaaataactattcttttcgtggtctatctagggctatattgtttgtatttttgtgctttttgttggtgcttttgctgtttacaatggcccaaaaatgcagtgctgaagtgctgcctagtgttcccaaacacaaggcagttgtgatgtgcctgccttacagagaaaatacatgtcttagatatgcttcatttatgcatgcatgacagtgcagttgggtgtcagttcaatgttagtgaatcaacaatatatatccagtaaagtatgtttgtacgaaaacacacccaaaacaaagttatatattggttggttgatgaaaatgaaactggagctcacgggaacctaaccctgaattttccaagaagaaatggttccatattcagtgtttgtgatgacctcttagagcacaactacctccaataagcagaattaaccgtatcccagtagtccaggtggaagacaaaggttgtagaattggtgagaagtggttgagcttggtcaactggcagggtttgggagtgatctggatgttggacaggagaaatggagaggcactgccatgtgtggatgctacgtggacaggcagggaagggttgcatcaataaaaaaggaacccacatgaagagggcagcatttgaactgttccttgaaaggatgaactcgtgcatttcaaatttatttatcacatatacacatgtatttaagtggaagttatatactcacacagcacgggaacataaagcttagaaaatttatgagcaaagtagagttatttcttgtagtatttttaaaggacatgtttgttttgtgtgtgtgtattgggaactcaatccttatctcactacaaatacattaacacaaaataaattcattggcctatacacaaaagctaacacagtaacatttctggaataaatcataagagaaaaatcagcaaccatagggataagacataaaactataaactataaaagtaaagaattgataaactagacttcatccatgttaaaacttttctctggaatacacaaatacacaaaaaaatgtcagacacaggatggaagaaaacattagcaatctaatctaataatgtaatggaattcaatatatataaagaactctgataactcaacaatacagatcaaaaaagccaattaaagatagcaaaagacacattacgtaagaagaaatgtaaatggccaataatgacacggaatgttgctcaacatcattagttatcagggaaatgtcaattatatcacaatgcaactccactctgtacccactagtctggtttaagtggaaaattctgacaatttcaagtgttgtcaaaaatatgaatgcttactcaccacttgtgggagtctaacttgggaaaagtcctggaaatttgtcataaagttaagcatagtgaccatataactcagctatttctcctttctttctttcttctttctttctttctttctttctttctttctttctttctttctttctttctttctcttcttttctttctctctctcttctttccttctttctttccctccctccttccttcctcaaatttattcaatattcattgaacctttctgatttttaaaagactgctctaaagtcgataaatactatataacttacattcgattgcagtgaggggcagagaattatcaagcaaaattatatttcaaaagattatttctttaaatggggttaaactctatgaagaaaaagttatgtatttcagattgaaagagagtaaaaggagaatgtgggcaactttgtataaggtgattagggaagcaaacctggaataatgttatttacagaaattaatgcaattaatggacatattctatactgatggcatatttctatataatctctgcctctaaatatgtaggcataaatcatttttctttaaccaatatataggtctcttttttaaccaaaagaattgtttaatagagaaagaagacttcgttgaatccaaacggtgagagacatcaattttaaaccaaaagtacttctgggtgttggcagatatcctccatagacagctacctctctgtggttttcaagatggtgcccttaggatataggcatcagcatcacctggcaaccttatttaaagggaagcttccagtgactacttctggcaatcttattattaacaagcacttgggctgattatttggtatcttaaagtttgaataccattggctgtcagttgcaactttaaaagtgctgacataagattgaggagggtatatttgattctgagtacaccaggcaggatcttatctttgtgatactgagccatgggggacttcttaactttatgcaggaacttcttaggctgcctggactaccaagctctagtctttcctggagaacactgagatgtgagtattagatcttggggccaggagttctggccaagttggagcactgaggatgcaagaaaaatctcttaaaatctcacagactcagtttgcaccttggagaagaagatcaaagtggtagtatatatatgcacaaccctattgcccctctccaatgaggctttgaagatcatatgcatactaaacctaatgttgatattcacagttttcatgcaagaaaagaatagaaagtgattgagtttctactgtgtattaacacctttaaaaatattatctcaattaaaattgctgaaatcttctccatgacagtttagggacagtattgctttctacatcctataggaagaaataattggttgaagcaggagaatagaaatgcaaatccaaaccttgcttttgccacaagttcaggttaactctagaagcattatttgattattttattctaaattcctttctttttaaattaagagtatttcatgcgctccttgtatgcgtcaatcaagaaagactttaatttggctttttttaatgatccaccacccttccacgtgctgtctaataacatgttctaatattatgatagcattgctgagttccaaaaatgcatttcataattgagatggtggcttatcaatggcagcaggcttaaaatgaacaagaatccaaatacttgtttcaagagtttattttttattcctgattatctaaaaactgctaggcaattttttacctaatcatatctcaagtagtgttcgatgaaaacattttttttaacccatggaaacataagcaatggaaaaaaagtgcatgtgaataaacagctttattttggaaatctagggaagaaaatatagcacaccatttcccaatttgttttcctactcaagacttgtgttgaaaacaccaagccaaagataatccatggttcttaatcgtatactgttagatgtgcatgaccaagcgttgtcagatgtgcatgaccaggcattgttacagctccccctattgacctatctcctgtcttcttctcattagaacatttgttctttgccccagagtaaggcatctggccatattttcattaattcattctaatacctattttgaggattaacatatttaatatgcttatattgaatatttgtcaatttgtataaaattatatttaaatatatgtgacatagggccaggcatggtggctcacacctgtaatcccagcattctgggaggccaaggtgggcagatcgcttgagtcgaggagttcgagaccagcctgggcaacatggcaaaatcctcatctctagcaaatatgcaaaatttagcctggcgtggtagcatgtgcctgtaatcccagcgactcgggaggctgaggcaggagaatcgcttgagcctgggaggcagaagttgcactgagccaagatcacaccaatgcgctccagactgggtgacagagccagcctctgtctcaaaaataaataaataatgtgacatagcattctgtatatagtacaaggttcagtggttcaaatgcttccatatgtaggtgtgggcgtatctgtgtttacatatgtacatgtatttatgtgtgcatgcaaacgtgtgtgtacatatataactaaaaatcatatctatagtacaaatatatatacatacatatgattttttcagtagtatgtgtatacacatatatgcggtacatacaatcatacatatagtacaaatatatatctgtgtgtgtgtgatttttttaaaagatttgtgttccaccaggaggctatttccaatatttgtatggactctaaaggattaaattaatttatactacagtccaccttctcttttaacatttaaaactagaatttttatggctagatggtgatatttcaatgagcaataccttctacataataagtcatttaaaaacttgccatttaaatcaataaaattttgcactcaatacttttgcactcaaaagtattttaaagttatctaatattttgaactttaattcacttatcaaacagaaaacatccacttgggaaagtctaatacacctttggttaactgcacaatgtttaaaatccaataaaacttaataaaataatattttaccaacaagagaattaattcctatgaactatttatctatttgtatagtctgaggctcatcataaatcaaataaaagcatagtacctcagagcagagaagtacacataatatgcttgtcctaacatgatttttattacttgcatttccctctggaggaatacagtgaatgaattaatgaagttggcttttattactgattcattgcatataaaatgaaaaagccgctttggatgttcaagaatttacatgcaaagtagactaggaattccaatgtcagtttatgggctatatatatgtactgcagaaggaacagggaaaacacaaaactgagggtgttttctggtggatgggactgccaggaggtcagtgtgccttggctgaaggaacacggggtggtttgtaaataaagcatacaaaccatcagcctaatatttttggtatggacatcaggatgtctgtgggcaaaccaagtcaattgctaaatgcaaagttgcagattgaaggctgctgtggacatgaggcttgagtccccaagggtgtcctagacattgggatattagtttggaccctgccagagttggttcaggggtcagggtaggactgcagctttttacatggttttaggtgaaaatgggggtcgatgttgcctttaaagcctgttcagcaaggagaccactttgccaggctctatttatgattgacaataaatgaattatctgtttcctttcccgtgcccacgacttcactttactattgtgacaactttcttagtgagagagagagcaatgctggatgaaagggcaatggattgttactgagaactttgttttgtgtgcagaggtgaagtgaacaggggagtagaggttataaagtgttattcgggttctatgtgaatacctctgggtttattggaacgtctgaatgcgatgcctttctctcctgctaaacagtaagtaaggactgggtctgctcctgcaacatggcacagtatctggcctgaaaaagtactcgattaatatttattaaacaaatgaatgaggttaagtgaatatatagaatgatggatggatggatggatggatggatggatagatggatggattaataaatggttcatagtgtgcaaaagagggaagaaggctgggcatggtggctcatgactgtaatcccagcactttgggaggctgaggtgggcaaattgcttgagcccaggagtttgagatgagcctgggccacatagggagaacccatctctccaaaaaaacttaaaaagttaatcaggcatggtgatgcacacctgtggtcccacatactcaggaggctgaggtggaaggatcacttgagcccaggagtccaaggctgcagtgagctatgatcgtgccactgaactctagccttggcaacagagcaatactctgtctcaaaaaaaaaaaaaaaatgaaagaaagaaagaaaaaagtaggggcgaggcataaaatgaaaaagaaatgctcattacatttttttgaagttattaaaacatacaaataaatcagagtagtcctttcaaagaaagattagattagacaaaacctctggtaccaggtcttatgcctggtgagactttggatctcctcctggacaagaactttctaccctgttataaacattcaaggcaatctcttaagtgctctaagtgattgagcatctatccctgtgatgcaacccgaagctaccaaaaccctcccagatttctacttagttctgcctcttccttctccttctccttctctttattctccttccgctccttcttctcactctctttcttctcttgttcagaatttatctacttctttaaaagtaggcaggagcaagcttggtcaaaataaaaatgttgtaaaaccttgatttcgttagttttgttgttaccccctgacaatgcagtaagctcagaactgctaagatttgatgatggaatttgaccaaaaattaccagaaaatcctgcatgttgtacaggaagggggccctgagacacttggaactttacaagagcatcagagaaacaggcaattgggcaacactgaggaaaggcagagaggtgagggagaagatgtaaaatgtcactgatgtaattttgcctagaaccacccacagcacatcgtaaaaactaattagatctctgaaaagagacatgcaagagtggataagtgagctccttaggtcaaagtgttaaggaggtccatagttactgaggtaagagaaagaagaaccatcagaatggaaggagtattcagaaacatgaaagatgattatgtgaaggcagtgtctaggcgaagaaaattaaaaattataaaggaggaacaatgcatcaaatgaaatacaagaagccaagaagtctcggaggcttaggatgcttgaaaggatcctaagaggagtttctccaaggggctgaaatggatattagaaaatatattagctaatatatgcaggagaagtttacagaggacattatcataattgaagggacaggagtggaagtaaacgtttccattacgtgtagttgcatgagtgtatctttagagatgacgatcagagaattctggaacaccctgtgatacaatatagtgtagtttttatgacctaaaatagcacattaggtagcttcttgattaatgtcattacagtggcctggagttaaggtgctcttcaattgtcatattcctctacaaacctacactggtgaattacatggaaatagctaaaggacccaggcaattgttggttgacggtgtgccttaaatatatcatgttaatatagtgcttgcagtttaaaatgtcttcccacatacatttgcccatttaatttcctcaatgtgaggcaggtgctaatctcattttatagtgagaaaattgagcgttagagaggctgaaagtgataccctaataaggggcaagagttgttcttttttgtcagctaggtcaacggccatttatgccattgaactcatatcaagtgctcttcttctttctctataactgtgggaagacaaaggtttatcccaaagtgtgtgctataaaatcagtcctgcaagtcatatttccacgcatatcaattttgccaatgtacacattgcaaaattacttttgttcttccattgttccatcgacaaaacactaacgatgagaaaaatatctaatccatgggtgctacgagaattaagtaaattaacatgtgtaaccttcctagaaaagtgcttggcaaaagtaagcagaaaatagatatttatcattataattgttggtgttgtattgttatgaatgaaacgaaaaacaaaagtatagtcatgcacagcataatggcattttgatcaatgatggaccacatataaaatggtagtcctataagattataagggagctgaaaatattctatcatctacaaatattgtagcacaacacattactttttctatgtttagatatgaaaataccattgtgtgataattgccttcagtattcagtacagtaccatgctgttcaggtttgtagcctaggagcaatagcctataccatatagcctaggtgagtgatcgactgtaccatctaggtttgtgcaagcacactctgtaatgtttgtacaatgacaaaattgcccagtctcacatttctcagaatgtatcctcatcattaatcagtgcatgactataaacattttttgggcggaaaccaatttttcacttgtgaaccatctccgatcagtaacaaagtgtcctgttagctcccatatgaaggagagcaatgcttgagtggcaagcaggaatgaaagcgcagttcacctacctgtcccgtgtgctctcaggctctcttccatcagcagcaaagccctcctcccacccacacacacagagtcatgcacgtactcacacaaattcactcacatgcatacacagacagggtcatacacacactcacacacaccttcactcacacataccaccatgtaccaagagtcatacctaccaccaccaaggacgccatcctcctggcaacatcgaaaagaaagaagagaggccttgcagctcgccagaactatttcttgatagccacacttgggcaatgcggtatttgatgtgtcttcatggaggcatcacctttgctgttgttatctcatccacatggccatagtcattgcttcacagaggactgggtaaaaaaaaaaaaaaaaacaacgcaaataaatgaccactcacaggttctgagtggtgagtgagtaaatgttggtgctggctcaggatggctaatgggaactgctagcaagttagctggggccagcctgaagggcctggggagtgtgctgctggccgcagtagccacttcagagaagcctctaatagcaatgccaggaagggacagataacactggagcaacttcagggcatcaactcccagatcctagcttggctgcctgtctattgtcctgtttcctgaaaacaccaaggaatggagtcattcattaactcagcaaacacttaaagattgcattctgggttctgagtggttttaggtgctaaaaagagaataataaacaaaaccacaaggctttttgtcttctggagctgatacttaaattgatgtgagacagatggtacataacacaaaaaaacagctgttatcggttaaaattaggaacaatgaagaaaatgaaagaagataatggaacagaagatgacattggatgagatgagcctctatgaagaaaaggagagagtaacaggccaacgggtaagttgggggcaggtacggcggcataagttggtggatgcaacaagtgagctgaaaattgagtggcgagaaggaacctaccatgaaaaataaatgtgaggagtatgtatttctggcagtgcaactaagaactggcaaggtgctgagataaaggctctagaaaggtgtggtgtgttcacggcataatgaacaggaggagagagagttgtaagaggaaaactcaaagagataaaagtgatgtgccatggggaaaagatgggtttaattatatttggatggagagcgatggacaggttagtagcctctcagtaagaaggcctgatttacaattttataggaccattctggttaccaagtggaaggtggtgtgaaggggtaacgtgagaaaagcagaacgacctgggagctcagacaagaggtgaaagcagacatgggccaaagccatcagattcatagcacatttgtaagacacagaagaaaacttgctgctggatgagatgcagggtgtgagtcgattatcgaggaaaatgctcttccaaaagaagtaaacgatataaatgatggaacgtattacaaaacccaacccgaaattattgccagtatcagagctaacaattctaacctgaatgatcatccatctccctaccccctacaaagagtcattcatgagagaccatgagtctaaaacatcattattgaataggacaaagcgtgaggtctttctcaaaaagggtccttatcctaggcatgtttcatatcctgctttgctaaaattgcctctttgtttaaaattatgaaatcatgttttgaacaaatgaatgaaattgaaaattcatatgcaatagctctattgacatgggaaaataacgtgtttgtgtgaacatgattcactcacactgcctcttcagatacgaacaaatcattttgtaacatcggtttaattccatctttctctccatattgtaaagattatctttccaacttcacttcagaataatggttattattattgtaaattgtagttcttctccccttttttcttagtcattatatagtagttgattatctctctttctgcaggggttgaggtccccatttttatttccaatttgtgatttccagctccgtattttacagtattatattttgtgcactcggctattgtaaaatgatttcctattgcctcttttgggggcatagatttgtagcaatttagccttttttatccattcttcccagaaggcagtttgctgacatttatggagtttgaactgttacagagagtgagatgtgctttgcataaggacatttctgtcattgttcttgaggttaatgctatgtgggctccagtggccatgctgaaatggagtgtgaggtatgaatcatttcattttgattttttcagtgtatcagaaaaggacaaggatgtattgctatgctgctgatggtaccagaaactcttatctgatgatggtgatgaagatgatgatgatgatgatgatgatgataatgtactaattatgttctgcgttcagagacaggggaagcttttgggtgactgtcattaatcttctagcactgacagagactatcaaatggaataaggtagggtagcctcagaggaaggaaggaaggtcctcctgcaatcatatgcagttgtcaggaataagtcacccctctaactctttatattgagcctctcgataggggatatgaaaacagagagaggtactcaatgtctactccgtcattctccttcctccctggcaaactgctttcccaaataccagatagggaaaggtcccaaacagcagcaagattcaggactattgttgcaaagtaaatgtggttcttggatcgatataaatatctggagactctgaaaaaggccaagtgctttacttcagatagttgatgcttgagagcaaactgcacacagtccttttgaagtcaacagtttatcagggcattacagatacacacttcttgggccttcgcgaatacactcattgagaggcaatttgatgttatatctttgtcttctctagagaacgttatcacacagatgtcgatttgggtagtgtttttataattttgcaaatgaattattgcacattgcatctactgtcactcataaaagcccacacaatattccttgaattttaattcgagaagtagcaggggatcaggggaaggaagagattcacccctaggaataaatgtgtatgttttctcttatcagcaaaaagtatatctatgtaggtaaataatgaagacagaattatacaccttttaagagttatgtttttgttgttgttgttgttgttgttggctttgaacagagtctcactccgttacccaggctgaagtgcagtggcacaatctcggcacactgcaacctccgctcctggattcaagctattctcctgcctcagtcttccgagtacctgggattacaggcacgtgccaacacacctggctaatattttgtattttagtagagacaaggtttcaccatgttgcccaggctggtctcaaactcctgagctcaggcaatccgcccgcctctgcttcccaaactgctaggattacaggcgtgagccaccactcctagccgagtcatgttttcaacccataagagttcataggtaaaggatatatacatatatatatatatatatagccatcaacaaatgttgacctaaatttacaactcaagcttcccaaactactcaatatgagcgctcaggagtaccaaattcttcagggttttctgatggactttgtcttcatttattctttatgttttatgttgtgccttgtcttcatttgagcgttgcctcacagtcttttggttttcagctgacacaaacatcaaattagtgagaaggaaagtcttttgttggggctgtttatgcctggtctctttgagagtctcaagtgtcctggggtgtccagaagccattttctcagttatgtttctcaggacacaattctgagacataaggaggcctaactgccaaactcctctttgggcttcctgccatggattgtatttcatttctagataatacagcgaaaatagagccatccatacattgcagtatcatagggctcaatgactcattagacctatgaagaaaaaggacacaaaaggaaaaacataaataaatgcaaaaactatattctgaatgatttggttcagtggataacaataattaaaaggtgagctcacttgatgaatttgggggaacaaccaaaagatcatcaaaattgtagatgactcagaaatagattaaaaacagacctaacaggtcacagaatctgaatttctcctctccaccttctaaacatgcctcgcgattttcttaaccaccaaatctttctcctgatcatagacaactctcacccaggttgtcaacatatataaaactggttaaaatgatgagaggtcttcaaatttattcagagtaaatgctgctttaaaaatggtcatgcagcattgaaaaacgatcatgtggaaaaaacatacttggactgaagtgagactatataacctgtctgatttgggtacaaaacagtcttatttcttccaccttggtcacagtgacaatgataatattattattttatggattttctggacatcttccatatgcacagttggatggttatttgatgcatttatttttctgagtagctgatattaagtcaattcttgctcttgctacatgaaactaagagcttttctttcacagtcacataccacgggctctggctaaccagcatgcagggtcacagtcaggtcaaagaagcatcctaaacccaattgtgtcttaattttagaaaatggaaaagatcaatatactccatgtagaagaatagtgtattagtctgttttcatgctgctgataaagacatactcgagactgggaagtaaaagaggtttaattggacttacagttccaaatggctggggaggcctcagaatcatagtgggaggcaaaaggcagttcttacatggcagtagcaggagaaaatgaggaagatgtaaaagcagaaacccctgataaaaccatcagatcttatgagacttattcactaccacaagaacaatatgggggaaaccgcccccgtgattcaaattatctcccaccgggtccctcccacaacatgtgggaattatgggagtacaattcaagatgaaatttgggtggggacacagagccaaaccatatcaaataggtaggtacatcatggaccctgcatgaaagagagtattctacagattttaagagtcatgtttttaacccatttcagttcatgagtaaatgatcaaaaatacaatattgacacataaaggctattggtaccatctatatattaattaagtttttagagatatatatatctttaaggatagattgatagatagacagacagatagatagatagatagatctatatatgcccctcattatactctctcttgtttatctgccaccatacatagaaagagagacacagagagaaggtgaagaagaaggtgagggaagaggaggtacgggagaggaagagaaggagaagggggaaagaggtgataatttttaaaaagctgcagtgcaatgcaaaaaaaaaagcaccagcacctacagaaaacaaacacccactttaatttttcccagtggtggaattgattgttctgggacctgagtaaaagagcagggatgtctctgtctattctctctctcgagtcagtcagtgtgatgctgctggcctgtgtttgtgtttgaatgaggaaagaccttcactctagtaatgacctagcagttagcttggaggaccctggacatatttgtccagttccattcaatactcccataaagtgcctgtggtattatattagtttgctttcatgctgctgataaagatatgcctgagactaggaagaaaaagaggtttaattggacttatagttccacaaggctggggaagcctcagaatcttggtgagaagtgaaaggcacttcttacatggcaatggcaagagaaaaatgaggagaagcaaaagcagaaaccctggatctcacgtcagatctcatgagacttattcactatcataagaatagcaagggaaagaccggcccccatgattctattacctccccctgggttcctcccacaacatgtgagaattctgggagatgcaattcaagttgaggtttaggtggggacacagccaaaccatatcattccacccctagcccctccaaaacctcacatttcaaaacaaatcatgccttcccaacagccccacaaagtcttaactcatttcagcattaaccaaaaagtccacagtccaaagtctcatctgagacaaggcaagtcccttctgcctataagcgtgtaaaatcaaaagtgagctagttacttcctagatacaatgggggtacaggtattgggtaaatacagccattccaaatgggagcaattggccaaaacaaaggggttacagtgcccatgcaagtccaaaatccagtggggcagtcaaattttaaagctccaaaatgatctcctttgactccaggtctcacatccaggtcacgctgatgcaagaggtgggttcccatggtcttgggtggctccgtccctgtgactttgcagggtacagcctccctcctggctttcatgggctggcgttgagtgtctgcagcttttccaggcccacggtgcaaactgtcagtggatctaccatgatggggtctggaggatgatggccctcttcttacagctccactaggcagtgccctagtaggaactctgtgtgggggctccaacctgacatttcccttccacactaccctagcagaggttctccatgagggtcccacccctgcagcaaacatttacctgggcatccaggcatttccatacatcttttgaaatctagtgaagctttcaaaacctcaattcttgacttccgtgcacctgcaggcacaacaccacgtggaagctgccaaggcttggagcttccgccctctgaagccacagcccaagctgtacgttggctcctttcagccagagctggagtggctgggacacagggcaccaactccctaggctgcacacaacacagggaccctgggcctggcccataaaatacacgttttcctcctgggctagagataactagatgaagccagtacctggaataaacatattctttgtcatattttttcttatgtcttagtgacataaaactagacatttagtggtacttaggcaaacagttgaataaacaactagcaattagcaggaaaactggttgaacatagaaagtttagtaaccattctagtcaactctgtgttcttattttttttggattgttgactaggtactatggatacagtaactagagttacctgggtaagagttaaatacagaatcctccataaaactagaataactggttaaagacaagtataaaatttcattcttctcaacatttctcatttcttgttggaataatgagttagttctgttaatgtgtagtagtacctaggttactacaaatcaagaactaggaagagatgactagactaggataagtatttgacaccagatggtgaaaaaaaaaaaaccagtgttttcaaatagaaactcttatttcctgtgtgattaatgagttagaattagtactggagctatctctatgagatgtggatttcattttggggggtggtacatactcaacagatgaaattttgggtcatatggtagttctattttgattttccaaggaaccattatactgtttttcataatgtaccaataacatttctgccctgtaagggtccccttttctgcacaacctaaaagggtttcactctctccacacctttgccatcattactttttatctcttgactttttgctaatacccgtcctaacaggtgtgaggtgatagttcattgtggttcatttgcattctctgattattaatgatgttgagcacattttcataaacctgtcagccagttgtgggttttctttcgagaaatgtctattaaagtcctttacctattcgtaaaccagactatttttttttttttttttgctattgagctgtatgagttctttatatactttggatattaactcgttattagatatatggttcacaaatagtttctcccaaaccataccctgccttttcattttgttgattgttgactgtgcagaagcttttagtttccaggctgctcacttgccctacatatttcagcttcctagacccccacaatgtgtgaatgtgtgagccaattgcttagagtaaagcatatcgtatataatattattcataaataaataccatacaatagtaaatagatgtttatgacatatattacacacacacacacacacacacacacacacacactcacacaaatatcctgttggcttagtttctccttctctgaggaacccagcctgatacaaatacccagctgagcgagtgtctttgctgatcttcaccgcctgaagccagtgctttaaaccatgagaatgaaacattgaggggcactatgtggacactgggagaaggaagtgagatggaaaagttctttgattgcatccaagaagtgaatggtcctcaaggtgcagcagaggaatttgtaggagagagggatgattgattgacggctttttttttttttttttttttttgaggcagagttttgctcttgttgcccaggcttgagtgcaatggcgctatattggctcactgcaacctctgcctcccgggttccagcgattctcctgcctcagcctcctgagtagctgggattatgggcatgcgccaccatgcctgactaattttgtatttttcgtagagatgggttttctccatgtaggtcaggctggtctcaaactgccgacctcaggtgatccagccaccttggtctcccaaagtgctgggattacaagcgtgagccactgtgcctggtcaactgacgtcttcatatagccctccgtctatcccagttagcatggagggattttaggtaggtcatacagaaaccgggtaatgatggcaggtgtggaggaacagaatgtaccactgaatgggaggtccgggggaaacatgtggcggaaatatcctcccgtgccacgtgatctgccaaaattgaacacggggagtttaggaggggtgacatgtcagtttgggaactatctttaggggtgctaacccaaatctccctttctccaattagagcaccctgccttcctcattagatgtcacccccccccccgcccccgacttcatccgccatgtcctgatggtgctttgtgacgtataaggccttccttcccgcccagggcgaccattggctgggtagtggagtgttgaccaatcacagctcaggggcgtgattgtctcgtcctgggatcgcgagaggggtatatacagggaggccaggcagcctggagttagccgaccgttgcgagacgttgagctgcggaagatgagtccaaagccgagagcctcgggacctccggccaaggccacggaggcaggaaagaggaagtcctcctctcagccgagccccagtgacccgaagaagaaggtgagtgaccctcccaagctcctcctcgtcttcccctcgcctccttcctcacaagaagcctctcctgtcctcacttggcacaaccccccaacccggcccccaccgcttctgaggacacgtccctgttcccagcctcctccatcctcgtccctaaaccggagcccttctgtgatctccctgttgtccttccagactaccaaggtggccaagaagggaaaagcagttcgtagagggagacgcgggaagaaaggggctgcgacaaagatggcggccgtgacggcacctgaggcggagagcgcgccagcggcacccggccccagcgaccagcccagccaggagctccctcagcacgagctgccgccggaggagccagtgagcgaggggacccagcacgaccccctgagtcaggaggccgagctggaggaaccactgagtcaggagagcgaggtggaagaaccactgagtcaggagagccaggtggaggaaccactgagtcaggagagcgaggtggaagaaccactgagtcaggagagccaggtggaggaaccactgagtcaggagagcgaggtggaggaaccactgagtcaggagagccaggtggaggaaccactgagtcaggagagcgagatggaagaaccactgagtcaggagagccaggtggaggaaccaccgagtcaggagagcgagatggaagaactaccgagtgtgtagacggccaagtactcccctatctccgagagcagcgactaagttcaggcccagccgccagacctcagagatctcaccagcggggtgcttgccattctgaagataataaaatgaatgtgttgcaaattgatctgagtgactctgtgttctctgatggtggggagggagggagggagggaggaagaggtggtgtgtggggagggagggagggaggaagaggtggtgtgtggggagggagggaggaagaggaggtgtgtggggagggagggagggaggaagaggtggtgtgtggggagggagggaggaagaggtggtgtgtggggagggagggagggaggaagaggtggtgtgtggggagggagggagggaggaagaggtgtgtggggagggagggagggaggaagaggtggtgtgtggggagggagggagggaggaagaggtgtgtggggagggagggagggagggagaggaggtgtgtggggagggagggaggaagaggtgtgtgaggagggaggaggaagaggtggtgtgtggggagggagaaaggaaagaaggaaggaacaagtggtatgtggggagggagggaagtggggtcccgtggggttgaggtcagggggacaggtcacagttagccagacaggaggataaggattgcgtcatggctgagcactggagacaaatttccccttcacaggatgactccgcttcttacacggtttgtttcttcatgcaatcttgctagcacatacaccaagtaccaagaactggattctacctacttaggtttcactgtcaaaataccttttcggttatagaaacctatggaagaatcgtttccatctctttcctttcagcgtcccctccctacaatctaatataattaagaagaaaaattcaaagtagagaaaaatctatctacttgaaaaaagcctttttatttttgcaactcaggagacagaaagtacaattcatatttccatacattagaaatacacaggtcttttctacatctagtagaatttactatatacaaatatatgtaaatttttatataaataaaatatacaactatatttactatagacaaacagattatatgtttacatataaaatatatacatatagacaaaatatggaatatatatttatatataaaatatataagtataaataaatgtaaatatagattatacacattagaaatacacaactcttttttgtacatagtagaacctattatgtatatttatatattaatatatcttatgtttttatatttagattacatatataaatatttatattctatatattatatataaaacattaaacatatatttatatttataaataatatatcaatatagacatcaaatctatatatgaaacctatctataaatataaatacatgaaaatagatatatataaatatatataaaatatatattctatatgtgatcatttattttagaaggtaaggtgttgtgattgttgaagcatccttcacagattaaaaaaagaaaggaaattatcattttaagaaaaataaaataaaaataaaaaataaataaagtacaaaattcccagttgtcaataattacaatgagagaataatatagaacttgctatatatagaaagtatttctatatatatttctaatatatatattatgtatatagtatttctaatgtgtatatatgtaatgtacatttatatatataattatataaatgcacagatcttttctatatatagtataatgcactgctgtatttctaatgtgttatatatattaaacctatatttatatatatttatataaatacacaggttttatacatatttatataaatacacaggtatttatataaacatataaacacacaggtcttttctatgtatagtagaattttgtatagtagaatttatgatacatttagaaaagacctgtgtatttctatatttatatttagaaaagacctgtatatttctaatggatatatatatagtttgtatttatatgtatatttatagataaatatataatctctatatatttatatatctatttctatgtatttacatttagatagagatctatttcacatatagattatataaatatattctatgtaaatatataaatacatatataaatatgtaaatatatttatatttatgtataatatataaataatatataaatatgtaatgcataaagataaatatacaatatataaaatatatattctatatgtgatcatttattttagaaggtaagctgttagtattgttgaagcatgcttctcaggcaaaaggagaaaggaaattatcattttaagaagaataaagtacaaaattatcacaatttaatttccagttgttaataattacacagacagaataactcatgtcctttaatcttacaatgaatagcacgttaaacttttatgtgattctgaaaatatgaatttccatataataagggtttgagatgtaaagcactaactttataggcagttttcacttgttacatagattgttcttagagctttaaagatgttaaaattaatggtggctttgaagagatggtagcatcatttgagaaacaataaatgggttctgtttcatcctttccttggtgcagtcagggcttcacttcattagcttaggaagggatttcagagctttgcatgttgatcttgtagttgcctcctgtggaatcctacgaaacctaggacgctataccacagaaacagggccttgccccatgtcctgaacaccatcattttgtggtatatttcttttgtattatttcttatatggaaataccatataagaatgagcatgcttggtataactcaaagcctgtttatttgcaaggctgtattgaccctggacaataaatatttgtatgttacggatgagaaacaagtctgcatgaaaagctcctgctgtcttttaggaaagcgtattggctgtggttgtatatctctttccaaagggaaattggtgaactctctgctatagttttttccataatgacagcataaaaactgaaataaacttatcttgtcagtggccacttttggggttggtgtatattagggagcacttttgcaatgtgtttcaaaattacattcaaggattaatttcatgcaccttattttaatgccatatttccattcaagctctgcatgtcaaaacagtctgtgatgattcttttggcattgaaataattatccatggcacttaaaccgtgtttctttcatcatttcatggcagtaggagcttcaactgctatttgttgggaacccatcctgactagctctttcactagggcttcatgttttattgtgatgattggcagacttgtgtttcagacattttcagatttggaaagttactatgattttgaaattatagatgcaaaaatgtcattgaatttactttcacaaacttttaattcattatagacaataagaggtttaatcagaaatcaggccaggtgcggtgggtcacgcctgtaatcccagcactttgggaggccaacgcaggcagatcacttgaggtcaggagcttgaaaccagcctgcctaacatggtgaaacactgtctttactaaaaatacaagaattagccaggcgtggtggtgtgcacctgtaatcccagttacttgggaggctgaggcaagagaattgcttgagccctggaggtggaggttgcagtgagcagagattgcaagactgcacccactgcactccagcctggctgacagagcaagactccatctcaaaaaaaaaaaaaataaataaataatttaagtaatcttttaatttgttggagcattcacaaatactacatcttcatttaagtctctctttattctacatgttatacacacagttaaattagttaataagagtgttaaatactttccctccttctccaactacccacaatctcaggcttaaaataaacagtggaatgcgtaaagacccaaaataatataacagcaaaggtgcagttgacttttgtaatcaaatgataaatatcaaagcttcctgacgtttttaggcaaatcttcctgtgtccctaaaaggaggatccccttgacagcagtcatgaacaacaggtgatctgaaattctcagctgtcaaagacggtgggagaatttgaaaacaccttgtacatattaaagagctaagcatgagctgatgcatacatacatatgtctctgtctcattagaccacaggaaacaggacacatggcaggaaggctcacgtcgattccccttgaccatgcagcttcctctgctcctgactcctaagaactttctgacctattggtcattcccagcttcagatccccacgcataccgattgtttttggccccacgtcagtgatacacacgacacagaattgctctcaaaaaacactctggaattgaaaaatgacaggggaagctcaacgcgatggctgggtgccagagggaaggccttccgctgttttgaacactgatgctaagctctagaataactgtagctgcagcctgttggacctgggcatgtgtcaggcagggtgtgaaatgctccccaagcacgacctcatttctccctcacgttacccctgtggattaatcggggctctagagagacaccaccaacaggttatcagcaaagatagatgagaggggatttattaggggaattagagggtgaaaagtctcaggacaggctgtctgcaagctggagcccctgggatgccaggagcgtgactcaggtcacaaccaaaaacctcagaactagggaagtggatggtgtaattctcagtataaaaggagcctgaagttctggtgttcaagggcaggaaaagaagaatcccagctccaagagagaaagggaggaaagtgcctttcctttgccctgtttcttctatctgggccctcagagaattggatggggcctgtctctattgaagacatcttccccactctgtccaccagctcacgccaatcttcccaagaatacctgtgcaggctcacctagaaacaatgctttactaattcctgacgtattccttaaggcagtcacgttgacacctgaaattaaccatcacaccctgtaaaatgggtagtgtccccactggacaaatgagacagacagtttgggtacctttcttatactgcttataggttatagagccaggattaaaactcaggtctgcaaagaccaaattctaaactccaccctcttaaggactgctgctcaacactgtggaagcagtactgcattagacactgtacgaggattgaagaggcattcgagacacatcccctgctttagggaccacatcttagcttgcattcatgacaggagtcatgtttctgtgactctactatagaccccggaaccaagtgtgaattggtacgctttaggtgtgcatacgctctgcagaaatcctaagaaagagccagataattataggctcgattcatatagggaagtttttatgaaaacagcttttagccaattcctgaaagaaaatatttttactggcagaaaaatgttctgctagagaataactagttgaagggctttgggggaaggggctctggacacatgtccacggaagtggggaaaaaagacacacagaatagaaacagaattggggacccttcaggaagagaagtaaggaaaagtgctagcccagtaagccgatatgtaattttgaatcttaactagattgagaatttggatacaactcaaaactagaaaagagtaattgcactaaaaaaaaatggcgcagagcagggtaaattaaaataaaaattcattaataatgaattaaattattcattcaacaaacatttattgggcaccttccatggtccaggtagagggctacatgctaatcaaaaaataataatcgctgccaggactgagcaatgcctgtgagtcatccttagactggtgctggaagatagatggggctgtcttattccatcctgagtttacaagagatgaccctgaggaccagccaggctaaataaccttttccagatcacctagtacttgaaccgaagcttgtctgactccaaagcccacacgttctctgatacgccatgcagccagaaaagggcagtgaagtactaaggtttgctaaggtgttgagtatatggaataagatactcaggagtatttttaaacttgtggtaaaacacacacgacacgacatatacactcttaacaaatgttgaggtgcatggtacggtattgttaactatatgcccattgtcctacagtggatccttacaactttctgggatggttaatattgtcaacttggttgggttgaaggatgtaaagtattgttccctggtgtgtctgtgagggtgttgacaaaggagattaacatttgagtcagtgcactgggagaggcagaccaaccctcagtctgggtgggcaccatccagtcagctgccagcgtggctagaataaagcaggcaggaggtgggagaagccgacttgctgagtcttctggcctccatgtttctcctgtgccagaagcttcctcgaacatcagactccaagttcttcagcttttggactcttggacttacaccagtgtttcgccaggggctctctggcctttggccacagacagactgaaggctgcgctgtgggcttccctacttttgaggttttaggacttggactggcttcctggctcctcagcttatagacgggctattatgggacttcaccttgcgatcatgtgagtcaatactccttagtaaactcccttcatatatgcatctatcctattagttctgtccctctagagaacactaatacactttctcgtcttgtatgactgaaactccatgcccattgcacctcaattccccattttcccctcccccagcccctagcaatgaccattctactttctgtgagtttaactattttagatatttcataaaagtagaattgggcagcatttgtccttctgtgactggcttgtttcacttaagcatgatgtcctcaggtccatctgtcctgtaggagtggtttctgacatcctacaaagtgagagggttttgaaacttgtgagacatgcacaaaggtggagagactactatagtgatcaccatgttttcatcatgcagctccaaccactacaaaagtcagctaattccatttcacctgttaccctctccaaacctgacctatcccctgcccaactcagttattttaaagcaagtcctagattactttttaagtaaactgacttgggcgtgtttaagaatttgcctcaagtcagatggttttgattttttaattttttcctggtgacaacagtaatccaagattgagtaacaattattcaagccttacagaagcacacagagagtaacattttatagatgttacattttatagatcctcagtgaggatctatattagctatgtgatatatgccactgtaaagctctttcccaccctgtccatgtgctaatgttgacctcacaatgttgtgagcttacgttgctctctaacgctgttcacttaacagtatagccagacaatgatttcatcatggaactgaagctgaagatgctgttccaacctctgcctgttacccagttccaatgtcgcttccacatttttcaggtaactattcagcaactccccactctattggtaccaatttaccatattagtccattttcatgctgctgataaagacatacccgagactgggaagaaacagagatttaattggatttacagttccacatggccggggaggcctcagaatcatggcaggaggtgaaaggcacttcttacatggcagcagcaagagaaaatgaggaagatgcaaaagcggaaacccctaataaaaccatcaaatctcatgagacttattcactatcatgagaatagcacgggaaaaactggcccccatgattcaattacctccctctgagtccctccaacaacaggtgggaattctgggagatacaattcaagttgagatttggatggggacacagccaaaccatatcaggtattatatatataacataagaaatacatgtttagtctctggccctcagttccttgcaccggaacttgccaggaatgcctaacaacctctaggtagaggtgctaggagaatcttttgttctaatattttgtatttgaccctcagttcctgacacagagcctttaagtccctaggaatgttttgggtgataggagcatcttttgttctcctggtgggctcctgaacagcctcacgatggaagcagattgccagggaaaccaaccatgtcattagagggttagagctccctctaggaaggggagagcaactgaaggttgagttgatcacttgtcttagtccattcagggtggtataacaaaataccttgctggaggaggaagaagatgaaggaggagaggagaaaaataagaagaaaagagggatgagaagggagaagaagaaagagaaggaggaggagaaggaagaagaaaaggaagagtggaagaggaaggaggataagatgaagatgacaaggaggaggaaaaatagaatcttaagagacattaacaaatgactatctctaagtgacaacattatagtaacttttactgttttttattttcaagatttccaaaatatcattaactattgtcgtaactggtactttataaaattaagagagtgtaacaaagctgaaaccccaaattttgtgaaaagcaagatgcataggagtcaaaagctgctattaggaaaaaaaaaaatagggacagggccccaagcattacatgaggttaatgttggttgttttctgatgaacacaacacaggagaatgtgaggatcaggcttgaggctctacccttactttcagtaataggggacaagaaaatgtctgcatcaaagaatcaaggttaaggataaagaggtttccttttaagcaattctgtgggctcactgcatccccagcaagatccctttatttagtttcaaggcatggaagtgtcaaactgtaagttacctatagtgtaataccactcagactaaatttagaccaggaagcgtagtgcactcaaagcaagtaagcattagtctaaaagtgattgtcctactgacagaagacatgttgttttgctaccttttccccacaaattactgtggtcctgtatatcagttggggagaacggcactattcacttaggacaagtatgaagaaaataattgttaaattgttaaatccttacctttggcacccacccgaagaactgtgcttttacacaaatgaacacgaatgaatacgacttttgaaaacagagcattcttactccaaggtagtgtgttagtaggaaacttagatgatcttgattgtacttcagcaaaggcatgagtgccaggcagatgctgttctgacggctctgtgtggtctgacagctggttgaggtgccattggcattcatttgagatggtcacctgggaaaccgaaattaacatagcatccctgaatcaggtaatcatgcaccatcctttaccaggtagccactttgggtttgaaccaaaaaaagatgagcttgaaaggtgtggagcctgtagtagtgttacttgaaaaagaccttgtcctttatctagttttgttggcacaagaaaataagcatatttcttgttagatctctttttacgctagctatcaggaggatagttaaactcttcatgcagcatgacaaagatttttttcagacatatttcagatagctgagattcctttctttgacacacacacacacacacacacaaacaagtatacaaagcatatacttgtatatattttaattttatacttttgattcctattatgttaaatcttggaaatttttcaaaaagcattttaaattatttagctgttatttttgttttaatactgttattaaacaatttctgttgtaaacacattttcttatctccaaagatagcacacacttagtcaatgtttcttatcttcttggtcatcttctcctcttccaaatgttgaactctcccaagaccccattcctgacacctgtttttcctccagctcttctgcctctgcagacaatgttatccattcccatggttgtgtatagcgtttatatcacgatgaccccaaattcttatctcctgttctgacttctcctctaaagtcctaaatcctaaatctaactgcctaattcgtatctacatttggatgcctacaaggcaactcaaaatcagcacgtccaaaataaagctattggttctagatcctacacaaactccagctctcttcttcagtttctgtgtctcagtgaacagcatgtgcacccaggcatatacacgtgattcctgtctttccctcatctcacatccattaacaggctgtattaataactcttgtcagctctggttttatattatattccacatctgttcaattttcttcatttccactagtgtcaccttattccatgcagccatcatctttcatcttcgttcttgcaagagtttcctaaatggtcttccagacaccattagctgaaaattcccatactttgggttataaaatattattccttggatcaaaattctccagcacttccaaacatactttaaaatggaagcgaaactcttacctagccgagaagttcttatgtgactcgggcttatgcccttctgcaacctcattccctctcactctcctctcagtcatgattccttcagttctgttagctcaatgttttagttccttaaacactcaaagctaacattcaggcctgaacactcaggctaaacactcaggcctacagcctgttttagaagctgctccctctgcctggaataatcttccccagtatcttcatatgtctgagttcttctcgtcttttagattgcaatttatatatctactccaaaaaaaaaaagaaagaagccagccctgacactacaaaatgaagccatctaccagtcagtcttcctaacatttacctgacatatttttttcgtgtcacttattacttactatttacttgactttgaataagtcatctttttacatttcatattctctgactttaaaaagagcatatttcataaagttgatttgagtattaaaggagttaatacacatcaagtgctgagagtaaatattcacagaagcaatcaatttattcttccacacagcagtcagtaaatgttggtggactagtattaactatcatattattcaggatatgaactaacttgttttaaattgcagacgataagtattaattctgccatgaagtgcccgtatccaattttcaaatcaccattgctgccttcacactcaagcaggtcagatggcaaaagccctaaaagtgtatagctaaaattactacacaatgacactataaccgttcttgcatgtgtctttggtaaacacatgtacccacttaggttggatatttacctaggaatgaaaatactgggtcgtagagcatgcatgtattcagcttgtagatacttctgaacagtttcccaaagttctttttccaaaatacacatttatactatattttaggtatagtcaaaagattttcaaattagctatcataaaaaaaattatctgagaatataatccatgtgacaaaacatattcctattagctcaaaagattattataattagaaagaaatatatcagcataaaaatgatataggaattacaaattatatatcactctacatttgtaatgcctatatcactgtttggaatatctcattattttaattgtaaccaattactccagttggaagcgtcacagcaagcagtattatatattttaggaataaattgaatatatcatccaatatctcatcctaacttcctactctttcatttattaaagcgtcaaagttcccattaatgctcataagaattttgaatccacataaatatataattaagctgaaggtgaatatctttcaggtggatttaccagcaagtatgaatgttaaaatgatagctaatatacatttctacttttaatttattcagtgcagttatgatactgctacaatactcatattgttgtgccatctataaggtttaaaaataattaacatgaagatgatgttctataattgttttattggtttttttattgtgtgcaaatctaatattgcctcactattgactccctatataaacaaactattttccaattccttacagtagacaaatatgcttattcaataagagaaatgaatatattgaaaacaattttgaataataatatcttgtatcttaagacacaacttcaaatattgtggcataaaaattgaatctaataatgtgcctttctagtggactttactatcaaaataaaaattcttagagttaaccttctatggtttggagatagcgctatcataaactttgttactttgttgtgtttttttaagactctttccccagtctacggacacaacatatttaatctgagttgtatgtgatgtgtggtgtggttaatttattgccccggtttacgtaaagtgtgttaattatatttaatttggcattttactttcactgtctaatcagattctaactatagaaattgacaacttgtggctaaattcattctcttcttgtgtttccaattgtgttttcattgggctcctcctttgtgtcattttttgtatgtcttttgatttggtcttactaatttacctggacgaaggagtaaatcctacaaaagtacaaatacatttatcatggtctttatattgggagaactaatcaattgggcttcattttttagaatttgtgtttttcttatgcaatatgggtttagaagtggatagaaaataaacccatttggaacatatacgaagcccagtgttggtctaaacttcctcacaggttacttgagtcctgatccatcacaaatacaaacacatttaaaaacataaagcattattacaatggaatcaaaataccatgactaaatccattttcccatcacaatgtcatttcttagatgaatacaaacaatgttcatattaaatagccatttctatcatggatatgagtttctggtgacttgtctttgcataataaaaagatctcatttttacataagcaaaacgagcaccataactttgcataatttatgtttgtatcttggctttgctgagagttagatacaatggaaggaacaagggcatcgaaaccaggcaaatgtgagttctaaaccaagctctgacatgtgacttcaaattgatcaccataccattctgagctgtggctccatcttatgcaggatggagacaacaataccttgaaaaaatatttgtaaggcacttagcagaccataaggtgagttgcccctcgaaatgcttgtagcaatttacaaccttccattaccatttgataattccactgaattctctaccccactgcccatatccaaccagctgttaagctgttgctatttgatctggaataaagtcaaaagtggctgtatggctttgaatgcccaggtggcaaggtggtatattagtcagttaaggctgctataatgaaatatcataaactgggtcgcttataaacagcagacatttatttctcacagttttggaggctggaactccaagatcaaggcatggcagattctgtgtctgctggactaaattcctggttcacagagatggtgccttcttgttataccctcacagggtggaaggggcaagggagttctctggggtcccttttataagggcactaatcgcattcatgaagacattaccttcatgacctaatcaactctcaaagcccccaactcctaatactatctggtgggagttaggatttctttttcttttctttttgtttttttttgttgttgtagtttctttgagacagagtctcttggttgcccaggttggagtgcagtgccaagatcatggctcactgcagcctcaacctcccatgctcaagtgatcttcctgcctcagctcccccaagtagcttggactgcaggcacgcgcctcctcacctgggtaatttttgtatttttagtagagacagagtttcaccatgtttcccaggatggtcttgaactccagagttcaagcgatccacccgccttggcctcccaaactgttaggattacagacatgagccactgcacctagccagaggttaggatttcaagaaaggaattttggtgacataaacattcagtctgttgcagtgggtgataaaagatgatgctgacagtcttgcagggtctattttatggagaccccaagtgtcgtatttaattaaagctagtctttactctaaagggcaaaggcctttgaatgtgctcttcctttgtctggatgttctgctattctgcattcatccatttcctccctattctcctctctggattatcacatacgtaatgccaactcctatttcaaggaaacaacacatcttttccaagatggaagctttttaaaaaaaattttctgccacatttcatctgctccatttcaaattgctggttcctgatagatgccactttcttcatgaagtttgacttgcacctgtaactgatttagggactgtattagtccattctcacactgctatgaagaactacctagacttggtaatttatgaagaagaaaggtttaattgactcacagttccacaggctgtaaaggaagcacggctgggagccctcagaaaacttacaatcatggcagagggtgaaggggaagcaagcacgtcttaccatggcagaggaggagagagagagagacagagtgaaggtggaagtgctacacagttttaaacaaccagatcttgtgagaactcatcactatcatgagaacagcaaggggaaatccactctcatgatccaatcaccttccacagggtccctgtccccacattgggaattacaattcgacatgagatttgggcaggaatacagagccaaaccatatcagcgacctttcaggtgaactcacatgtacttacgtcttcagacattcatcatatgacgttgtagaagcttttgcaaatgtgtctgtttctccccatatgcctgcatcccaataaagacagggatggctttgccgttgctcaccatcatattcccataattctaccctcctctccagttagttctcactattctcacttccaagaccccagtcccaccagccttggactttctcttgactaatttactctcctatttgaggactcaagtatcattctttataggtacaagccctgacaaatactgattggatggcacaagaaagtgagaagtattatatataaaggacacagaggcgttttggccacacttggcacaagccctggtcacaacatagtctatagttgtttctgccattgctgcttagaattcatttcatttttcttccatttccttttcagtgagttttctagtttcccccaaaagacttatttaatcatggacattggagtacttaattaatttctattaagcatggtttcaaaatatctaacacttacatgcagggtccactgctttccttcactgacttccctggtgaatattgagctatttacctacagagcaggaaatacacatggtctcattaatctctactctgcctaacccaaacctactcccccgcaaactcaatgtgaaacagattgagtattcactctcatatattatttggagagtaccattgatttatacaactcttcctcggtcagaagggtagtgattcattggcccaatactcaatttaactgcagggaaagtttctatttgttgagaataccatttcccaatgcatacaactgttacaggggggttcatctggtttagccacaaaaggactctctgcaggtgtaacaatctgaaacataggaggactattttgggaatattgtctaagaatagggtaatagttcaaaataaattgaaacaattattaaagtgaaaacatttaccctaagtcagaaattatgctattaccaatgtgaagaaatttaaaggcaatatggaccatatctccagacttttcaacaataatgataaacaaagacacacgattaattcagaactaccacccagtctctaagtaatttttctattagacaagtgcctacttcttgctaagcagttcgcagcacacttttattattgttttcttgtgtgcatatcttaaatattgatattagctcacctaacttcctaaaattatatgaacactcaaaatctctactcatattttatgttttttaaagtttaactaaaaaaaataaaataaatatagtttagagaaaacaataccttagtgccaaaatcttaaaacctttggtaaagaaagggctaagagcagtttaggaattctttttcttgttttactggggacgccaagggaaagaaagaaagatgacttgggcaatttacctgtaagcttgcaaatgtcagaccccttggaaaacactataattttatctcttagtgggagataccattaccaagtttttatgatccacttttagcagactgttgtaactggcctggttagtattgtttatagacttagggacatggatttctgaaaaatgttacataaactatgtaactgagtctaattggaaatgtctcatgaaagaagcaactcccttctgcatgaaaggtgctctcacaagcactacttagagaactcatagttggaacccagagtcagaacgtgtcctaatgaaagaagaaaggattcaaggaggagtgtggatggtcccaaactttgttttggctgtgtgaaattattagtagcatttgccactgggcaagatttcagagtgaggctcatttagtagtccaatatgtctaagctctatgctgattttattttagaagatgttccttacttttgtccctatttattttatattttaatattttatgccatagcattcactatctttgacatattcgtttgtaaagatggaaggctcaaaatcaatgtactaagcatctaacatcagaagaaaaaaaagaagaaatagtagagatatgctcctttaaggatagttttcctctttcttctgagtctcttgttttttaatctctattttgtttgcctcagtctatacatcatgttaaaacctatgtcaactatttggtcttcctggactgctcattccatgttgagagagacacactaaaatgtcagttggtagctcctgttttctaatggtgacctttatggtacaataactcactagaaaccttgctatttcacaagatgaccatcactctcagcatctaaatttttttcctttgggttggtcaatttcttgagagaggaattctggctgttagcagttggtgaacagaggaaaaaaatcaattaatgattgtgtataaagaatttaacctaattcagacttgcaaggttaagaatgtttactttgaaaaaaaaatcaataatcatgttgatatggaattttgcactaaaaatgcttgagggtggcagccaataaagcaattccttcaaaaaactatgagaaagttattctccacctagaacattacacaatgccaggtaaagttaccaatcaaatctgagcatacaatacaaatatcttcacatatttaaagtccgaaaaatgtatcatcttttctgaggaaattactaaagggtatgctttaccaaaacagaaaaggactgagagtaaagaagtcatagtgccaacacaagagagaaactaaagaaactacaggagcaatggtgataagaaattccaatatcaaagctatgcagcatgtccagaggcagtgagttcagtggttcaagaacatacagatgtttttggttattttgaaaacagatgtatatttctgtgggagaggcagagacaattcaagaagagctatataaaaattagacaagtaaacaaaaggcaattactaactccaaggaaaaccaaagagatgtactagaagggaatgcaatcattgttcatcatatggtttgaccgtgaataattgaaatatagccttaataacataagcaaagtatacttgatttagccaattcctgtgttcattatcggtggagagggagtgaaagaagcaaaatggtagcggaagtgataagagagataaatcaataagtaataggtggataatatctaaatccaaaaaaaaaaccataagcttgctattcaaaaaaaggaagtaaatatcttgagaaaacaactaaaatagttaaaaatgcgtgcatttgcaatgccagaaatggagaagagtgatggaaagaactactggtttttattgtagtccaattaggacaatttcattaaaatatgcatacataaataatattacatatatatataatttcatttatgttgaaattaagcatttttacaaaattaaaggttgtgactgccctgagattttttcccctatattgctaaaggaatacacgcattgttacatgcaaatgtcagtttaatttgcataatctttaaacatttttcaacctctaagttttggtattattgggcaaggctgtgtcctttcattctagataaacttctcctttgtggagaaaatctgtcaaaatctggcccattctttctcagatttcattcaaccctcttctcccatttccttcaccttggccatgatgaaaccgtccccaatattttttatgctctgcaccttttaatatcaaattccttcacctgcccccagtagaataaaaaacttggaataagtttttttctaagtttttaattcttcaagaccaattaaaactaaggctcctttcagatgaggcagtcaattcccctattaccttcctctgcccacaatactttatttccattctttctcctttctcctgagaaagaatagttatttattcacatgacactctttctgaaccaagatgttcaaaggtagagaccgtgtcttattcctctttacatcctttgggctggactagcacactagctggctcccagcagaaatgcaggcaatgaacacattgtgagtaagttagtggggggatgaccagcaaaggtgcagtgtaagtgtaagtcattcttcctcttctgcatgtaaaatctgccaggagcgactgaatgcagcgtcccaaaacaaatatcaaaaactaacctacaacaatccaaaccattgttcgaatactaaatttttatgaaccacagaagtgaattagctcctttatcaatttgcaaaacattcaattttatgtacaaatataatatcattataatgagatagtttcacaggaactgtctctcagcagaataaaattgttgctagaaaggaaatcaaacaaaatattataagatgtgtgtttgttcactcggaatgaactttctgaaatacttctcttgaaatatcatttatatctcacacttaatttgtctatgccgtctcgttacatattattcagatgaaatatcaataatagaagttgtttctgaattttacagagaaattatgtgcaaagttctttgagttaatcgtgagctatttttaaacttctgactgttaatgtccagaagggaatgctaagttgcagtattttctaaacagtgtccacatgtttacatggaattttggcttctcttcacctatcactcaatgctgaattgttacccttctgtcttcagaaaagatgaatggaaagaaaggacagagagtccaatatttctgtgaaatctctgaccagaagtgccgattcttcacttattttattttttatttttttagagacaaggtgttgctctgtcacccaggctggagtgcagtagtgtgattatagttcaacgcagccttgaactcttggattcaagcaatcctcccacctcaccctcccaagtagctggaactacaggtgtatgccaccacacccaggtaatattttaaaatttttgtagagatgagggtctcaccatgtttcccatgctgatctcacactctgggccttaagtgatcctcctgcctcagcctcccaaagctctgggattacagacatgagatactgcaccaatcctccccttatttttagatactcagcatccaatacactacttgtgtgttgcatggtatatccttgatacttattttaatgaataaatgcactaaaggaatgtgcaatctctacagatgaagaaaacccagtgatattaaacatgttattagttgttataaactgtattttatatccccataaaatcatatgttaaatctctaacccccagtggctgatatttggaggtgggggcctttgggaggtgatgagatcataagggtggtgccctcaggatggcgttagtgcccttataagaagagacacaaagtagcttccttcttcttttccttctttccaacatgtgaggacaaatagagaggacagccgtctacaaaccaggaagtgggttcttttcatcagatcttgagtgtgctggcatctcaatcttggacttcccagtctccagaactgtgaggaaaaattatttgttatttaagccactctgtctgtgacttgttatagcagcctgtactgaccaagacatactaacaaattatgaataggtaaaacacagatgatttctttttcttctttttactttttgtatttctgtatattactaaaagttcttaaaaatcctctgaggaccctctactcaaattgtggcaaaaagaccagctgcatcatggatatcacctgggcacctgttaggaacacaaatcctcagtcggctctccaggtctactgaatatgaatctgcattttaacaagatcccctggtgttttagatgcaaaattcagtttgagaagtactattttaaaagagtttgctgtaataactcgtaaaatgaatctctccatttttaaaaaaagtacctgatattgccattaactttttcttttcttaatgtaaatcccaagtattgagaaatacttggggaagggtattactgcctacttgactgagccattgagaagttcatttttcatacaaccttgatgatggtgaaacacccagccatttggttgcctggggggagggtattctggggagaggaagtggaagcaggtattgcccatgccttagaagggcaattggagtgttcaaggatcagcaagaagcttattttggccggattagaatgataaagggagaaagagtaataaagtggtgggagggaagtcatgtggggccttgcagatctttgtaaggacattgatgtttactgccagggaaatggggaattcctggaaagctggagcagacagaggctggcatgatacattctatcatagaacagtgtctctctgcctatgtgttaatagtagtctacaaggggaaacattggaatcaggaatccagctaaaatgtgaatgctgtgcctccagggtacaatggagatggcttagagaaggtaggagagaaagtgggaagaagtggtcagattctgcttgtacttggaagacagactctataagatttcctgaaagatcagatgtaggttgggaaggacagaaagagctcaaaaataattcctgagtcttcaattgagtcattgacattaattaacatggaaaacactgcaagggaagaagggatttttactttcttctttttccatttttgttttgttttgttttgttttaatttttggttgtggtgatgacttctggttttgacatgttagattgaggtgaatattagcaactgtgtagaactattaaggaagagttggatgcacaaaattagagttcaggtgagaggtacaaattggagataaaaattttgttaccagcagacaaataggatttcaagtcattagtctagataagaccaggatgggactgtgtatagatatgaaaatggaaacattcaaagggtaaggctggaccacaataacatttaaaggttgcgtagataaggataaatcaataaaggagtctgggaagaaacaacaggggaggtagaaggaaaagaacaggagtgtgaggcatccacaccaagaaaacttcctaaggtaagaagagagatgatgactgtcaaataaatgatgctgtaggtccagtcagctgaggtttgaggttggcattgcatggagcaatgtgaagatcattggtgattgagaaaaacagcatattcactggtcagttgtgaagaaaacctggtttagaagaagaaattgggataagaaagagatttatttgcttccttccttccttccttcttcttttcctttcctttcctttccttttcctttcctttcctttcctttccttccttccctccctccctctctctctctccctccttcctcctctccctccctcctcccctcctgcccccttcctctctcccttccttctttcctcccttcctaccttcctctcttccttccttcctgcctgcctgcctgcctgactgtctttcttcctgttagtattgtagagttctggcttgcttccaaatgtagtgatctagtccttggtgacaagctgataatgacagagagagggagacttgtcaaagggatagagaggtccactctggtgtgaacgtggggtgctttcattagatgggagcaaagatggtttgaaatcacaagagtgaaggaaagaatgtgtgggcatgatggcatgtaggtgggtagagtggaggtcagagcttgtgtaatctccctactgatggtttggattttcctagtaaaatgggaagcaaggtcatgcatggaaagtgaggataggagagagaacgtatcacagtattggacatttctgaggagacaggaacaggtgagaaataagactttaggtctgtgctattcagaatgtggtctatagaccaccagcatcagcctgacttgggagcttgttagaaatgaagaatcgccccaaaacaaacaaaccagaatctgcactttattaagatctccaagtgatttcaaagccagcttttctcaaatttgcacactggaatgaatcaagactattctaaaaatctgcatgcccaggtcacacccaagaccaatttcataacaatattctggggattgagaccccagcatcagtagtttttaaaactacctaggtgatgttaacatgaaatcaattttgatgaccgaatgctctgggtatttaagcaagtaaataaactcgggatagcccccttgaggataatgatccttctttaaagataccagtcttctaggctgtgaatttttctccagctatatatggctgttcaggtgcaggtgtggaagaggcaatgaagtggatttaatgaaggctgagattctgccaagcaactgagaacagcagatgatgttccacttgctgtcccgccttctctcccacccacaattctcctttccaactagaacagctccctttgtatctgttctacattttagctttctgaaaaagagttaaaagcaagtgtgcaagagttaaatgcactgaaatgtatgatgcctttcccctctgtattcatcagatcaagtgtctgacaatacaatgggctcccgctgtgtatgagtgtgtgcacatgcaaggcataagattgatttttttttatttaagctagaatatactcattagtaaatctgtgtgaccccagagtcttgaatatcatttccttttttttgttttgcctttccatttcttcctttgttgatttatacacatttccaacttttctttaattcttcatttaattttgataatttgtattttctaatgatatttctctaaaattttccaatttgtcttagggatttgtacgtagtgttgccttagaatcatttaatatcttttctctgtcctattcaatttgtcaggtctaatttttaaattttctctttttttgcctttttgttgtattttatagagttttgtctatcttgctcattgatttaaagactaattttctggtcttatgtatttcagttttctctttttatgaaatataaacatacataagactaacatttattatagacaaattagactgatctgtaggaaaaggcaaaactagtcatcagagacaacctaggcatattttaaaatgttaattatatttattattttctttttcaaaatttgttttaagtttttgtagatatacagtaggtgtatatattcataggtacatgagatattttggtataggcatgcaatgcatcataatcacattatggaaaattaggtatccatcccctcaagcatttatcctttgtgttacaagcaagattattttagttattttaaaatgcataattaaattattgactatagtcactctgttgtgctgtcaaatattaggtcttattcattttttctttttttttcttttttttttttttggaacagagtcttgctctgtctcccgggctggagtgcagtggcacaatctgggctcactgcaagctccgcctcccgggttcatgccattctcccgcctcagcctcccgagtagctgggactacaggcacccgccaccgcgcccagctaattttttgtatttttagtagagacggggttccaccatgatagccaggatgtctcgatctcctgacctcgtgatccgcccgcctcggcctcccatagtgctgggattattcatcttttctaactattttttggtactcactaaccatccccattttcccctaccccccaactacccttcccagcctgtggtaaccctccttctactctctatcttcatgagttcaattgttttaattttcagatcccacaaataaataagaacatgtgatagttatctttctgtgcctggcttatttcacataacataatgacctccagttccatcaatgttgttgcaaatgaaaagagctgattcttttttatggccaaatagtactccattgtgaataaatcccacattttctttatccttacatctattggtggacagttagtctatgcatattcaatagctctctgtaaagatgcttctatgcatttatgtacagactctgcctgcctatttgtatttaaaatggtctcatatgacagtcttgattatatccttgacttattcttagtttgacagtatagagagtaatcaaggtggggatggagttacggagactgggattcaaatgctcactctgctactgctttgtgagattaaatgtagagtattttttatccactctgatgatctttcttcccacatattttctgtagaaagcagagatgatcacacctacctcacaaggatgatgagagtattgtgattgcaagtacttaccacctcaagaaatttacaccagtgtcaatggccatgttttgatctttattattgtaagcaaattgtttttcagtccctcagtatgcattttgtgtatttatatcatattttttacatgtttcagaagtactttcggtggattaaaggattgaaaaggatttaaataaataacactcctaaaatataatagccaacatgataaacaatactcaatattcaaatgtcatttttgcatagatgaaaaattctattgttttaatgtgaatttacttaaaccctttagggttaaatatttattcttcaatgatatggaagaagaatatacccatgaaacgtggataagtccatgtagctcctttcaaagcagattcttggagagaattaatccctccagcaatgacttttcttctctgcatctgccactactagttctaaaaaacattattaaaattatttttatattgtatggttgaggtaaagacccttcattaagaaagactaaatgagaaaaattaattcaacttcattcactatatttaagatgaattttccttaaacatgtttttggcaaatttggcaaactgggcatatgcaaaagcaataatttgccttaggagaattttgcattagatgaaccaaattgtgaaaagtcagttatccaataagtagagtttatgccacacagtataatatatagtgatctttatgattttcttacattttccttgtttattttttgctttcttgtgtcaggagcagagaaataggttatatcttcagctgtcacatttattttaatttgccatttatggtttcctttcaaagattcaggttttctcctaactcattaattcacacatttatttatattagttcactgtgcttttgagttttgtccagttttcttttcctatttgtagccaagtaagttgaaagaatagtgaatgtatttttgtttctttgtttaacgtagaaaacttttgtgagtatgaacttgcctctgcatacacattaaccatattctgtgcacttcaatatttagtaatttctgatcatcaatgccaccaagtgccactgtcctgtttgcccaacacgctccagtttcagcatgcttctaaatggacatagttgctatttccttttcctctttaaccctatttatttatttaaaaatatttatttgttgatgcactgaacaagatacagtagataagattggggaaatagtcaaaatctaaataaatgcatgaataaaaagatgctttacaattaagacagtgtgatattagcaaaagaacagacaaatcgatgaaggaaacagcatagagagcttaggaattgagccccatagacacagccaaatgttctttgacaaagtagcaaaggcaatgcaatggagaaaagatagtctttcaacataatgcattcgtcaagactcatagaatgtacaacaccgagagtgaaccctaaagtgtgggctttggatgataataatatgtcaatgttggggtggctgggcatgtgtcagggcaggaggtatagggaactctattttctgtacaactttgctgtgaacctaaaactattctaaacaatttaaaaagatacttcagataagagtttttgaaggaaatggctgaggttagtatagtatgataggaaagaaggggagggggcaaattttaataggctctgggcttcctctctgagggtaattaacatcctcttatttgggtaagtgaagctaatttcccagttgtcagagtttgctgctgctcttgtggggacagtaatatcattgctaccaaatgttatcaaattttgcgtatgtgtgtatttccatgtgtttaggtgaaagaatattttcaaaattattattattattttaaagcttagtataaattatttattgcctaacatgatccttttggggaagcaacatgtatatacttgctaaaacggaaagagcactttaattaatttgcatctattaaccaacattattggtcatattgctcaaattctccacatttttatgtatttctgctgacttgttctgtcaatttctgctgacttgttctgtcaatgacagaaaaagtatgtcaaacaatttagtatctttgtacttcaaaaaacatgttgtgagtgcatttcagatacacatggatgctttatcattcacctcataaatattcatgatgggaatagctccattgacattttatcttaattgaagagtgctttcaaattttgtccttgacatattttagtatcaaatgtttgagcaaatcaaactttgttccattttagaggtttttgttttgttttgtcttatttttaactttctttagtcatatgaattaggcaaagacttgaaacattcatttttatatgatttctataaagatgaaactaagtcaaattacttaaaaccaatttcagattgtgaaaacaaaatataaagacttcttagtaacctttcctagggtgatttaaacaattcaaatatcaaccaaaacactaaatgcagttgttatcattcgatgtatattaattttgacagcaagttgatgagataatccagttcgacttttaaaaagagaaaactagacaaagagaaaacatattggcatgcacattccttggttgaaatactgatatttactttatattcaaagtgctttcagtgtctgatcaaatcatggtttccattttactatctcatgcgcttcaaccttagagatcattgtatcatgacgtgtcttgtttggttgtatccatttatgtatttcacttggcacattggtacgtgttaatatgcatatttttagaatccacacagcaacgcagtaatgggtgtggtcaagtaaaaagaataattctttcagggtggaatcaccatttgtacaatgcagctgtattggaacttctttgaaacccacagcacacagctgagatagtccaatttttaaaaagaaatttactataccaattttgcaagctcaagattttagaataatttgaaaagctttgagttctactcattgcttattgtcattgctggcttaaatttatttcccatctagatagaaataaaaggtaaaaagcttaattattttgcatcatatttcattattttcttttgttagtggtaatgaaatgaaacacatgtctgaagttcacagaaagactccttggtaatgactttctttaggcatcattgagttttttcatttaatcaataattttattattttatgcagtgctttgcaaagcattcccttctgtgggtttacatatacatggatacacaaccagtctgtggttttaaaacattaattcctgtcaaaactatttatgtaatttttaaatattataaatccccatgtttacttcttattggcatgctgtctttattatattatggaatattattatttagacctgaagttttgacaaatgacgcaaacaaatctattgattcattccgttacattataggaaaagtccctgttggtagcaacgccgctgagcttcaaaacagtggccttgtcaggtaatacaagccgtggcattttcttcgcctcttttgacacatggtgtaggatagtatgcaaattggtacaattctacagggctggaggacaaaagcaaaaatcaagattaagcagggacatttcccccatgtatattgctaatacccacctaaaggtaatacaagacattaacggattatgtgaaatctccacttgtaaaattttttaaaaatttaaggggaaatgtgcttttagtttctctgacttttgtcagaaacttttcacctaagtaaagttgctcttttacttcttgaaatgtttcttgtatttatgctgagtgagtttgactagtttgccagcagctccatctacctcctgaagcaacatttgaagatgtttcttgcttttataagaatatatgcttatatacaaaggtatgctttctctctgtgataatccctcatccctcataccacttgataccacttgtaaatgcatacatatatatacatatatatatatttttttttttgagacagagtctcgctctgtgtcccaggctgaagtgcagtggctcaatctcccctcactgcaagctctgcctttcgggttcatgccattctcctgcctcagcctcccgagcagctgggactacaggcgcccgccaccacgcccagctaattttttgacagggtttcaccgtgttagccaggatggtctcaatctcctgacctcatgatctgctcgcttcggcctcccaaagtgctgggattacaggcgtgagccaccgtgcccagcctacatatattttttcaaacaaacaaaagctttagagttctgcaggctcacaaaaacctccgctgttatgaatcatgttatatttgaaagaattttaaacctatttttcagttcagttcttctcctgtggttcttatgccaaggtgacttcaagagtaatatctacatggctaatcaagttctgaaatagagattgattggtgttttggtccccacatgtccacatggcattttccttgacaaatctacaaaggcactgataggattatgggtcatggataaaggaaaccaggtctgttgtggttggtgcatctgcttgggggaagagcctgaatccagtatttttgtaggaaaggaaaccgacatttcctatgccgccatcactccctgtgtaggcaatcctcttagcaacttcaagtaaattttgtactcatttggctgataaatacatttgagttcaggaggttaagtgacttgtaagtggctgagattaggatttggtttgtctgggctcttgtgactgctccctctcttattttctgtgggagaataaatatgattaattgggtaacccatatgaccggcctgtttgtagcaactggcagacaaaccattgaaacatatctcttcatataggaaaactagagaggatggagataaagacataaaaatagcatagacattttagaaatctggatgtaaaagaggaatagacacacaaggcgagatgatgtttgattatgatacagaacagattcctaaaacacttaaatgtaattaaagatataaaaaggatagaacagaacataaaaaagttatgaatatacagcactataattagttgcttctttttgagacacagcactagtttcagacttgtccattaaaaaggaaaaaagagagaaggctgcttctgaagacaaagacaatttaaatgcagagcttggcaggtggctgccattgaggaaggaaaaacagttaggatagccttcgagaagatcctccaagtgatcaaatattgtctagagtgctagggaactttcacaattttattggcaatttaatataattcaatcgcagtctacatcatcaagacttagtatattcagttctattttgcagagagtaatgaatctgaaatttatgtttggcagtacactccagaaagtaacatttcccttgatgcatctgctctgataatttgctcatttaactatacaaatgacactgcaactgacctggaaagccagttatacaagattccaacacagcagagaccctgcaagcttctaagactttctcccactttcaaatgtcacaaagacagattcttaagagtgtttctgaaaaaaatagcaccttggaattggtccatcttcaattaaatgatggtggtgatcatccctatgaagttttgaaagtcacatctcttcttcaagaaggcattttgtgaaaggaaaccaggatcattgtatattgtaaaagaaaaaaaaaatcttaaagatagactccctttcttttgagaaaaaagaaacatgcaattttaaatcttacaaacactactgatttgaacttaatgttgactgtattaaattacaaattttaaaatgtggcttctttttttaattaattaattaatttatgttatttattttgagagggagtctcgctctgtcgcccgggctggagtgcaatggcacgatctcggctctctgcaatctcctcctcccgggttcaagcgattctcctgcctcagcctcccaagtagctgggactaaaggcgcacgctgccacacctggctaattttttgtatgctagtagacacggggtttcaccgtgttgtccaggctggtctcaaactcctgagcgcaggcaatctgtccgcctcagcctcccaaagtgctgggattacaggcatgagccaccgcgcccagccaaaatgtggcttcttttagcccctttaaattaaacttataaatattgtttttatttataaatctagaaaatctataaaataagaacgattcttttcaagggatcatttgaacaatatttgttaaattcaaattgaatagtgtaaataacaaagcagtgatactatctatgttatatgtgtgagaggggcttaatacctacatgatgggttgataggtgccgcaaaccaccatggcacatgattacctgtgtaacaaacctgcacatcatgtatatgtaccccagaacttaaaataaaaataaaaattaaaaaaagagagaaagatcatttacataagtcaagtgtgaaagcagagtttctcccactcagcactactgacatttgtctctggataattctttgtggtgggggctaacccgtgcattggaggatgttgagaaggatccctggtctctactacccactggaagccagtggtagtccgcttccaggtataacaaccaaaaatgactccagacattgtcaaatatcccccagggagtgacactgtcccagttgagaaccactatgttagaattttttcttgtaattctgccattaggaatatttttttccccttttctcatattttttatcctctgaaatcttcctaccctcacctctcagaaaatgtaagctccatgagaaccttgttcatcttgtttaacacacgcagatcctagcaacttcaatacttcttgaatacgtgaatacaaatataatcaaaataaatctgctcatgctctatttgactggataaaggatgtgattagattaataatatatgtaaatctttgtgagttcttcttcagctgtgtattaaatggaattttatttactttggataagtgaactttacaaataatatcaattgttcacacttgccctatctcccctctgcttattgggttacaaattcaactaatagccattgtaggcaaggttgtggagaaataagtaagaaacatattattatatactgtgactgctttgtggtttataaactgggaaaaactacagaatgtcaacatcccttgtcaattgaaaaggaaaaacacaattcacataaactggttgtttggctttgattacttttcaatgggatgttccaataacggaaatgatgtgttcgtacttgtggggaaaaattaatggtggacaagctcatagacttcaaaagaatgcaaattaatttaggcagtttcagggcaggctatactggaaaacaagaatgaagcaaaatgaggtatctgcttttattaagggaggtgctagagcgtgtgaggatgtgagttctaagcttgatctgaagctagacatgggccagactcagcacagaagcaaaaatctcagcaacacctgaaatctaatgtgttattcaagaaagtgtggatccagggactggcagagataaaaacaccaggcaactagtgacaaaggtcagagaaagcaggagtccggtacagagaaactctatcactggagaacagacataggggtagcaggaattcagcttgcttggatgccagagcttaaaccagcatccagatatgggagctaagagtccagcagacttagagaactagaaggggctggtggtaatgtgctcctagtctttttggtcccagtatgagggacttatttccttggaagactccctcaactgggcttctagtagagccatcacatgagaaatgttttgggctacagttgctagcaggcatgctccagcacctcaggctggaccataccctgtccatctcattgtggggttagaggaggcatgtgccatctgttgctattgactaacaggaaacttggtcctgttgtacaggaagcaaggtagggagagaaggaggtaagcagagagggagagaagaaaggagggtgggtgggagaatatgatgggtagttatgtaaagatattacatcattcatggattttacacaatatgcttaagttaaaagtatactttacaaagctgtaaatccagagtgtgtgcagagtcctttcctgtaattgttctgtggatgtcatcatgttttgagatcttcccacaatttttcagacagacttccctagaacaaagcatgccccctcctcctgttgcaatcaatactctagttcctggaacagacaaaatgtgagaagctgtagctcttacagaatgctgtttaataagaatgatttccagtctaaaagtgtgaaattttgggaacttttctatgcatgtaagctattgccagtcttctttgatgacaaactgatatggtttagctgtgtccccacacaaaacttaccttgaattgtagctcccacaaccgcatgtcatgggagggacctggtgggaggtaatagaatcatgggggcgagactttcccgtgcttttctcataatagtgaatgagtctcatgagatctgatggttttataaagggcagttccccttcacatgctgtcttgactgccaccatgtaagatgtgcctttgctcctcttttgccttccaccatgattgtgaggcttccccagccatgtggaactatgagtccattaaatctctttttctttaattacccagtctcgggtatgtttttattagcagtgtgagaatggactaatatacaaacatactcaggtgtcctttgtggagaacaattcttccccaaatctcccgtcaagacagaacctttgtgccactccacttcatgctaaacagtccaattgagagctctgccttgctgtatctatttaagaattcttgccatttcatttgccccccttttaaagtcactttcttctcccagtgctctcctgaagctgctttctctgaggcatcttatgaatttatgctggttacatcattctcacatctttggtatctccaaggaattgaccattctgttccctcccgtttggcatcaaatgagcccactcgattttcctgctacttcccttattatttacctgacaccattggtctctttgtgtcccatgagccctgactgtatttctgtgattccattgctgcaggctcctcctgatcaatcccctcatctggcagttgcttgtctcatttccttccctgcttgcctcttcatgattttgcctgagaaagcttccctgttatattccttgaacttgaatccctgggctggggggagttctgcaagaacctgagacagacaccctgtcttcttagaccccatcattccacccattatcacatcattagactctagctttgcattcactgtcacatctttaggtctatttatttcctcctgaaccactcccttcttccatgaccaccaccaccaccactccactggaaacctcttgcactgtcatagctctatcacctccaggacaacacataccaaattgccatcctcaatgctaacctttctccaaagctcccaattggattattttcaatgaaatgtctacaattcccacatttaatatacataaaagcaaatccatcttctctaggccacactgtctcaaggacttgttgttgttaatcattttcttcctcgtatcttctgcaaatagggtcaaagcagcccactccacagtgctgaggttggagctgggggtagaatggagacgtttaattctggtttacattcatgtgatgcctatacttaaagttatagtgtctcccataagaccgcgatactggggagctcttgcacccagacatctgtccccttcacagggcaagagctccacccaaatccaaacccatatttgtggtgttagccaatcctctctgagtcaaagcagtttgaaagtcccaatatttacctaattcctcttgctttaggcttttctccaaaactactggtctggcaattctttagagtctttgcaaactcttgaatcttttaaagatactttaaaatcatattttattcagatttttaaaaattactttcagtcagaaaggaaattgttttgaatgacccagctagcattcctggaaattcaacgatttctcttttctccaccattacttcaattcagaaccttctaatcccatcagagaatgataaaatcatctctaaatatgatttcttaagtcatttcttgttcccactcagtgaattcatattcatcttcctgaaatacagttatgacaccttcctccaatacagttctaacaccttcctccttccacactcagaaatggtcaatgttgttccgtcgccaaagagtcattacaaattcctttgtcacaggaatgcaagtttgtttccaggacatgccctcatctaatcttccacttttcactactgtgcatttaaaagatgcttcaaataaatgaattccacattagcaaaccttctgtttctaaatatgtttgtgcatacaccccctttcttcagcacagagtgatcttctcagcttctttacaaggcatcttattgcacatagtgcttacccggccgcccatgcaaagaagctctcctattcccttgtctcaagactcttttgccttcaacgatacttgtattaccactttgtattccaggactgtgtttaatatagctcatcattttgagtactggtatatcactattagggtaccctcatctcacccaattacacctgatgtagtgcatatgacatgtagtgtaatccatccttaccctgaagatttatcttttttaaatgtacacatgactttttagcaatgaagaaaatttcaatacagttggtgtcactcttacccaagtcaactggaaaaagaagtaaccaagtcaggtgttgaatcataagaggggtaggtaaagaataaaagaaaagcctgaacagaagtggacttttagaataaaacttggaataggtatcacatgataaggtaaagtaaatccaggttttagaactatctttctatgcctgggagaagggaaagagctcagacccaaataagagagactgagagtatatgtgttcagtgctaaattggcagtgctaagcctagaacacagtttaggattgcagactgagtaggttaaataaagtttctgcttgttcatccattttaagcatccacagaactcttctaggacaatagtaggaatcagcagaccataattaacaactgcaagtcataaaatcagaaagacaaggaacatttggctcaggggaaaacaaaaacaaacaaacaaaaacgtgttccacagaagagcatcattccccattgataaggtttggctgtgtccccacccaaatctcatcttgaattgtagctcccataatccccacatgttgtgggaggtacctggtgggaggtaaatgaatcatgggcgtgggtttttcccatgctgttctcatgatagtgaataagtttcatgaggtccgatggctttataaagggtagttcccctgcacatgctctcgtgcctgccaccatgaaagatgtgcctttgctcctcatttgccttccaccatgatggtgaggcctccccagccatgtgggactgtaagtctattaaatctctttttctttataaatgtcccagtctcagatatttcttcatagcagtgtgaaaatagactaatacacccatgaaagacactaacttctaaccattgacttaaagctgtagggaaagaaaatttgtaaatagatctagtgagcaagagaaggcaatcatcattgattatagaattttcttaatttctaatttagtatcattaacatgctctgaaggaagaaagcttatttgttgtattttaatgaaaagagtataattatctaagattttctaaatttgtgtgtggccttgatcactctgttttcccatcagatcttaaaaatttgcacccaaaacgtcctctacatggttattaattgcagttggaatgcactcttgtgttggcctttcattcacgtatagcaagtgagtgaatgaatgaatgaatgattagtggaatattatatgaatttcttgtttgcctttctgcctcttcagatactaccttcacttagaatgatgcttaaattagaagtgaaactgggattcttatcttctcagatacagcattgcttttcaattttgttcataattttctccatgagttgttcattttagaaaaaccctaaacaaatatcaaattattaggctgattatttataatgttgactaatatttaaatccatattgataaagtttatttgtgtgtgtacatctggcatatggactttgcctttattctgagttgtgtgttttagtattatgcagagagtgtagcaaatttactgtaagattagcccattctgtgagaaacatctgtgtacatggaagtttagcattcttatccaatgtttgtcttcagattttacaaaagctttggaaactttgacaacttttctgttccttgtcatataaaacttattccttatcctcttcatcttagaactacagttcaaattggaaacgataattcaaatatcacattgtgcttataattttagattatatacatgatctgtgaagcagtgctgcacacttccccccagtctgatatccttcggagaagcaaagaaattccatacagtaaaatttaccaagtcaaattaattttacacgaacacaccaactctttttctcaacacaaatagtttgaagacttggagtgctacttcagcatatttctcttcctctcttagttacttacgctcagatgtaagaactcatgtaaagatttgcgtcaactctctacctacaaaccgtaggatgtgttatgtgtttgagaataaattgggcttaaaaggtcttctacccttgcaacttcccttctcctccatttaggccctagagtccatcttgggggaaatggcaccagcaaagcaagttttaaccccagttaccaagctggatgcatgaaaaactacagccttcctttcatatttcatgaatagaaaagaaaactgaaaggaggtaagccttctgtgcaagaattttgaagcctctgtttgaacgcaaaatgagattccaagagaaagaaagaaccaagtccaggtccagggccatctcgcgcattgccatctacctagagaacaccactgagaaaacgcccgccttctctcttgcatagacatgaatgaaggaagcagaaagatgtagagggagtattttcccaatgctcataactccttaaccatggagaagagtttttcttctcttgacaggaaataagaagaggaataataagacataattctgccgccactatcaaagaaacatgtgaataaggactccaactaatggatatagcttaagacatgagtttccaaatatggatgaaatcgatccttaaaatgataaaaaccaacccaacttaagattaatatgttttctaaattaaacacggtatatttctgtttgtgtatttctgccaacctgatcctcaaaatttgaaaatattaacactatccacagttattgaaggtgtggaggaaaatgttctcaaaaaatgttgagagagtatatcttggtacagccttatttgaagggcaattgcctagaatgtctcagaattttaattgcgtatgcctttgagccagtgatgctacctgtagaggaatatcccgtggaaatatttgtagtgtgcaaagacagatgcacaaagatcaaagagaatctaagtgaccacatgtaggaaatgatcatatgagttttagtgtactcagacatgggcaatctgttaaaaccaatggttcctgtggtgtactacctagtagtaggaaaaaacacaagagaaagttgcagatgagtacataccttatagaaagtatgaaccaaatctatttttgtactagaaagaaaaaaagatacacttttgcatctgtgtacctacatacaaaggaatacacaccaaagaagaacagttaatactcctaacatgtgaatatgatggactgattggaaggtgctttttttgttgttttttaagcacatatacactttgattttcaatatgcatcaccatttggcattaagacatacacagaattttttaaatgtgctgccagatgtgaagtttctaaaaacactcagaatccatgtagtagaaaatagttgggtatttgcctgccgcccattgaaaacccaaatctcaatgggtggcttgacagccatatatagacatacatatacctgactcctgtcttgcttagaagaagtaaacccatctaaaaccaatctgccccatgttgtcaggctcaaaagcttattcattctaaaataaccctgaaaagaaaatacttcagctcaaatcacagtttggaaatgctttgcatgtagaaaacaattgtaaaactaagtgactttttctctataaaatttcaggaatataatatttctatgaatgttactgcagattatctggtgtcatgaatgatataataataaggctgcttatctgacaaatctgccaaatgcaaacagagcttttaataagagtattcatcaagtgtggggagataggtcaattctaaaaatgtcaccataatcaaaaaacattaggaagtacaaaaactaagtataatataaaaatttaatgcctatgtagagtaattcaagtctttgcattaactcctctttgtatcattatgtattcatttattttcaacattttgttatacaccataaataaaagtttgtttctttcacttctccatgcctgttttcccataaatcaccttctactgatagtcgtagattattcaggaagaacaagataatggagtcttgttttcgagtgtttttctttattctaaacattccatctgtctaactatatttatggtatgtaaaacacctgcttttatttccaagggacaaatatagttctaaagtcacagctggtgatagtctgagagggtgttcagatactatttctcaagcaggacagatggctatcaaaagaaactttgtaattttattttttatccccatcaagaaatttggacaaactcacagaactagaactgggaatacttcaacatgaacagtacaggactacatgtgaggaataatcataggcatgtgacaatggaagagatcaaacactaggattcctaatctcataagaataatggcaatagcgtcaatacttaggactaaatggtggatgagcaatgatttccaagagccatatgaactaaacagttagatgtaactagctttggccaggtctccttcagaacaagcaatggcagagaacactccctccagtctgaaaatgaaggtaggcatgaaacaggtaagtttagattgatttgtactaggatgagatgtccagaccaatagatgttttgggatcaaaggtagggctaccaaaaaaaaaagatattgacaaactgttggagacagtgatatggacaattccttatgtaaagggcaaagttaactctaaaagtaagacttcacctgttgtgtaatcaacttgggtaaaatcaccctggaaggtgaaaaaaattctgatgacccacaccataaatttgttggtaaaccagatctttcaaccttgggcaatctaaaatgcttcttctttgtctccaggctgcgtgagtttactgaaacactccacacatgtacaattagtaaaactgataaaaatgtacaagaaagagagctctaaaaatgaatgagagagaataagaatatagataatgaagagacatcatgaagttacaggtattagcacttttgacctccttagcctgagtgaaccaatctaattataacaattgtaacattacctgtgcttgttttgtctgctttgtatggcgcttaaagcatgaagaaaatcagatctatcagactgtgattttaatgaaatgattaaaattatttgattaggtgtgtactcaatgtttaaatgtctatgggaatctaatttgttaaattgattcgcttttgctttattggctacataaataaatatggatatttaaaagaatgctacataaataaaaataaaccagatcaaaaagtaaaaatggtggtgatcttaatgtgcataaacttttgggatattaagtaatttctcaacactaaaaagggcagatgcctcagtatttcacattgtttatagcttgtacaaattaaactctggaaatactggtaaaggaaggatgaaactaaagatgcaatgacctctggaatacggtaaatacattatataaatctgaaggatataatcactagttgaaaatattgtggttttaacatatttaaatcgagtgataggaagcaaagaagatcactccatggaagtatttatagctattagtagaattcattcttaagagagattttgacactgcaaggaaaacttgcaatataattcagcaattaaaggaataagttgaaagaattaaaaatcaaatgacaaaatgtaaaattggcaaatatattatatatactttatcatacatctagatggggtatggggccacttgagaaaaaaaacaacattttgagggtttaagagatggtgaggatgagatcagtgtttggttacagatatgtcaagtttgaagatgtttctgagacacccaacttgaggtattttgtgagcagttagataaaccagtctggggccatatgatggtaagtctggaccagagctagaagttgggagtcatcgactgatggattgcacttgatgcctgcattactcagcttagaagagtgagtgggaaaagcagagggttcacaagatcatctgaagagctctgaccttgagaggttgtgcagaagcaaagaaggtgacattagacacctaaaagagtgcccaaggacttaggaggaaaatggcaggagggtgcaagtgtttggagacagcatgctaaatactgccaggacatgaagtaaggtcaagaatgaaaaatgtcccctgcatttgtcaactcaaatacctctttggtatcacagcaagagcaatcttgatggcatgttgggggcataccctacaccacgatggaagaaatgttcctaggaaatgagtaaacggaggtggcagtggtacgactactgagaagtttggttctgaaggtgagtagagagatacggtggtgccttaagaggaaagtggggccctgggaggcttttatttttcacatgggggatattgaagcctgttagtggcggagagtatgaaggagaaagggagaggttgatgatgccggagagggtctatacatggtggaaagagctcccagaaaaggtaagatgtgttgggctacaaagtcaacacacatttcgggctttgagagagggagagacattttctccattttgtaaaagggaaaaaggggaagttggatatattgaccgtgagaaggtgatggactccccattagatgtgtttcatttcctccatggtgtggaagatgaggtaatatgctgactctgaaaagaatggaggcaccatgatagataaggagaagagaggaagaacaaaaccgttatcccagtggggaaagtgaaagatgaatttactaggaagcactggttactggctctttttaagtgttaaaattaatttaatagaatttgaaaactaagatttttgcaaaatgtggatataataaaaatataacctataaattattttataaagccttaaccctcaaattattaacaaacccctaaagtgattctatcatctgaggtagaaagacaaatactatcattacttatcttttaaaaaggttactaccaaatgctctattagttattaatagtatttttcctggaatggtagtggaatttgtatattcattttctattaatggcaatagtaaagcaatgttctctaatgagttcagaaacttgctcaccaacactaccgttctatgtacagaatgtttcataaaatttcatatcagaaataaaacttttgattgggatattttctggtttctcttccaaactcccatccctcatttcttccattttcatcaacctacctaaccaaacctaacccaggcagccatgacaccagcaggcattgttgccatcctaggcttcttcactccacaaccttccaggctcccacctgtccggctcccactaccatcgtcctagttctctgcttgcggttgcagactatttaagtgtggtaggatgctataaaaacatggtactgttttcactaattgtcaaaatacataatctcagctagtctcttgcattttctctggtagacccccactttttcatagctgttccaaacttagatgatttgccttttattctgaaagacaacagacctgctcatgtttctcttctctgttcccaaatccctttgtcatagccagcttctctctcttcctaagattatgcttctctcgaagagttctgtctcagtcctccatcagtgtttttgatctgccctatgccaactttcaccagaaactcgctcaacaaatggactgcctgggtattctcttcctgtcttccattctctggcccttctttatttgctgacaaatatgccccattcttctttttttcccatcatcctactgtccacaacccaaactaatttctattcacacacctaactttcaattttacagccctctctccatgtttttaatatcacacaacttgggaaaagttagtttataaaatacagcaatgttgtctgtataatctgtcactaattacacacttaaaaataaatttgtattcccatcaccatagaaaccaccatcttagctttgcttctcaaaacttaatgcgcatacaaatcacatgggattgtagttaaaaatgtggtttttgtttagtagctgggagatggagcctgagagtcttcatgtctgataagctcccaagggatgccccaggattggttcacagaccagaatttgaaatgcaaagagccagtggatcatcacccaaagtcttgttatttttttttttacaggctgtcatttgaagattaaacctaaaatagtgtctatctatttttatcttttccctctttaagtcattgctacttgtcttccaagtgcgtctctccatacaatccattctcttcagtcatctctgcggtgtcacatccaatagatttttcttcatcatctcattggctgcctctgctgaattcaacacagactactcatacaatgaaacggtacaactgtggcttctatggaggaagagattccccttatagcattactgggtaacatttatgttgtgctttcgaaaaaaccaagtcataaaaaggtttaaatatttacctctttccatgttgcttgagccacaggccaacaaactgaacacatgatttaaaaccgaactgtcaggatatccagcccctatgcccacagcaggtcagggatgatacatgacttaatcatgcccaatcagaattctctcttacactttctttcgggcctattaaaaaaaaacaaaaacaaaagaaagcttatactctgtggctgttaaaatatgatagaatgtgagttttgctctgagaacagccatctcacccaccatctgtagatctgttgtgaaaacagatggcatttgaatgccttcatttcagctgctatgcccaggtggccaggagatagccctagactgtacagctatatgtacttgtaaattcctttctctttctttgatctctctgtggcttgtggtaatttgtgttgggcttccttcacatgcaacaaaaagttttgacaataatccctcataaataatctcttatctatagatttttatgagaaaaaaatagctgagaaaatgacacgtctacaatagatagaaaaatttggatataaacaatcttagtaactgtttttaagttttataaattaccaatttaacaattgggaaaataataagttagctatgtttttatggggttttcttctgtttgtttgagacaggatctcattctatcataaaggctggagtgcaggggtgcaatcatagctcactgcagcctagaactccttggctcaagcagtccacccaccttagactcctgagtagctaggactacaggtgcacgtcaccacactcagctaatttaaaaaaaaacatattttttgtaaaaataggatttcactatgttgctcaggctggtctgaaactcctggccccaagcaatcctcctgctttggctgagtcactaggattataagcctgagtcaccaggcctggccagctatgttttcaatgtctaaaatgttacttagtaccctacatatatattaagaattaacacattggaaaaattcagcattgtattgctcttcctggaatattttcaaatggctaaaataaacgaaagtaaaaatgaaaataaaaagaaaaagatatttctctttactctgttttcctaaaataaaaatatctccagccaggagcagtggctcatgcctgtaatcccagcactttgggaagctgaagcaggtggatcacttgagcccaggaattcaagatcagcctgggcaacatgtggaaaccccatctctacaaaaaaaataaataagcggagcttgcagtgagccgagattgcgccactgcagtccgcagtccggcctgggcgacagagcgagactccgtctcaaaaaaaaaaaaaaaaaaaaaaaaaaaaaaataaataaataaataaataaataaaaataaaaattagcagggtgtggtggcgcacacctttggtcccagctacttctgaggctgaggtgggaggatcacttgagcctgggaggtagaggctgcagtgagctgtaattgagccactgaactccaggctgggtgacagagtgaaaccctgactcaaaagaaaaaagaaaaaacaaaaaacaaaaaacctctaatacctctttagaaaaataggcaaaagacagtgagagaaaattcactgaagaatttaagaaagtgaatattaagaaattacatatacagcatggaatactatatagccattaaaaagaaggaaattatgttcattgcagcaatatggatgcagctggaggccattatcctaagtgaattaacacaggaatagaaaaccaaatactgcattttctcacttacaagtgggagctaaatactgggtactcattgacataaagatggggacagtagacactggggattactagaagggggagggaggagaggggaaagggttgaaaaactgttgggtactatgctcagcacctaggttctgggatcacttgtaccacaaacctcagtatcacacaatatacccaggtaaaaacctgtacatgtacccccagaatctaaaataaaagttcaaaaaaaatttttaaatagatttaaaaaatagttaatcttttttggctattactgagcatttattctgccaattgaatttttttttttttttttttttttttttttttttttttttttttttgagatagggtctcactctgtttcccaggctggagtgcagtggtgtgatcagggcttgctgcagcctctgcctcccaggctcaggtgatcctcccacctcagcctcccaggtaactgggactacaggcccataccaccacacccagctaattttttgtatttttagaaaagctggggttctgccatgttgccaggttggtcttgaactcctggctcaggcaatcctcccaccttggcctcccaaagttctgggattacaggcatgagccagcgcgcctggtctggcagatgaactttaacatctacttgtcacattttgaaaaccaaggttctgagtgcgattgccatttgtaaaatttgtggtttaatatatgggtactcaacaccaatatacaacgtaattttcccattcagcaacataatatgtctagtatcacataagcagatttaatgtgcagagtttttgaatgtatcttgcacattttctgtgtgttgccatttttttttgctattgtgatttcatttttctacttttaaaatttctggtgatataaagtattattaatttcaatatattcttatagacatttgagtgaattctttaacttctcatattactttttcagttgattatactgaaatatttaggcattcagttacttatttattccacaattattgaggatgtgcatgatactagagacaatttacaaatataattgttaggttttgaagggaaggtgagggttaaaaaaagacacacacacagaaagagggtggctcaacagcaaatgcaggctttgtgtccagcataaaacctaaagaagtgggggaccagcttaatgccagagcccaccgctgcttacaggctgggggtacttgggtttgggcagtatggcttgctgcctggcgggatgttgataagatgttcccacgataaggtggttctggtccttgttctggcgggatgtcatcatggtgttccttggatctttgcccagcaagatatgatagggacgtttctttagttggggctttgtctgccttgtgatcaggtggttaggcaggatgtttctcacggcccgaacccccgtgaaatgtttcactttgaccaaggtcagcacaatagcggggagcttacataaaggtgcagtttggactcacattctttcaaggtttgcaaaatagcggggagcttacaaaatgatgcagtttggaccaacagtaatgattccagtatcttttttttcattttattggtttttctttttctttgttgctgcattttccaagtcttgcagaacagtgtgtggaatagcagagatgtcaggcacacaagccttatccctgatttaatgggaatgctcccatgcttcatgacccagaatgaggcttgccatttgattgtgagtttttaaatggtattttactgaaacttcttttttattcttgagtatagctattttattaatctatcatgcccagtgaaagaagagcattttcaaaaggatggtctgctttgactgaataaagtcagaaaagggcagtgttgtgtctacaaaagaactgtatggggatgatgccaatctctctgatacagcacctggagcattacacacaaccctcacaacaacatcaaaaaagacttttaaaatttattattatttttattattatctatgattttacattatttgtgccaaaagcatattaaactaatccaaaaggaaaagctaaagatcagtcccaatagcactagcaccatcagacaaaacaaaactactgtgagctaatatctctaacaacgtcttcaaaacagcagctgggccatcatggcacaatcctgtaatcccagtacttcgggaggccaaggtgggacgaccccttgaatccctccaggagttcaaggccaacctgggaaacagcaacaccccatctctacgttaattagctggctgtagtggcatgcacctataatcccagctactcagaaggctgaggcaggagaatcgcttgagctcaggagttcaaggttacagtgagttatgcattcactgcatagtgtcactgcactccagcctcagtgatagagcaagaccctatttctaaaacttaaaaaaaaataagaaaaaaggcagctgattatgattgagcaggcatcattcgtatcaaagtcattgaagatgtgcattacaatagcaaaaatacaataacttcccagcaaacggcaataaacctcttgaggaaataaagtcattttttgaattaatgcaaggatactattgggagtgaggatggcactgatcctgctatgctttttgtggggccatcttcccccttagtctatagcaccatagactattttattctatttatttttgtaatttaataaaatccccatttttaaccttgtttattgactcatttacttgttactgctttctcacccagtaaaacaaatattcccttaagtcaggaacctgctttatttgttttcatctacatatcaagtatgtagcacaaattctggcacatagtaaattctcaataaatatttatggaatagaccagaaagcaatgattaaataccttctttctgacccttctaatccatagaagtactttgcaaatcactgatattttgaaatgtacattaaaactacattggtaccctctcaatcttcccagttatagacaataatttaattacaccatttaagatgacatgcaggctaaccagtaaattgtagccactaagtaaatgtgatagatcaatatagaacatgaattgtagaaagatctttaagcaaagtattttacaatgttgattgcatattctaactccatatgcattctttttttaacagtaagttaattatttcactgacagagatagtgaaggtattgtaaaacacaattaaaaatatattatatactgttgttatataaaataacaacaaatgaaaatgaaatcaattgcactttttcatgctagtggcctggtgtactaaattgttcaaggacaatctagccaactgattttatgtttattgttgcaaggtgacaatgacctatgttagatataaagtatttgcatacttacaggtatatttactttatcttaatgtccacaatgtggctaaaaaataagaatactttttggtttatataattaattgattaaagaatttcatcatggaatgactatcaccatttaagtagctttatatagatgaaatacataaactaaggaatttttatccatagcacccatagaaaataatcatgcttttgagcagaaataatttctgagatattctgtagccataaagttaaataaaacatatctaagacttaagaggagaaagaataggaaattattttaaataaagtagtaattatttttggatgccatattttttgtaaagtcttttaaacacaagttgagaatttcagtgtctgtgttgttctaagtttgcattagaatgttttcaaactgcagattgtgatccattagtgattgtgaaattatttaagtgtagcatgacaatttttacaaatcaaaatggaataaaaacctcaaaaaatattacacataataaaagtgtttcataaaaattatttttatttatatgagtaaatagttttactcaaatttatatttgcatatgtacacctatatgcatatggaaatatatgtgtaaaatatgtgcatatatgtattggattaccttataaaacaggtcatattcaagaaagattggaagtcattgaagaaaatgttgtaccaaacattagaatacataggtggctataatatgcaaccaaaatgtattcagttcttagtgtgtgaggaggattttgcaaagactgtcagctaaaaacaacttcatggtgaaatgtaaggaatgataatgtgataagccatttgatctccttcagctcctcctctcagtttctgagtgttaaggatgttgtatttgaaggcggacactcctactcttttaccccacacgtaagttctagttaagcaccaggttcctagttgggagacagatgacaacctctcctgttttaaagacacatgtcaaagctgcatatttgtaaatgacaacctaatcaaagcccctttatgtttcctaactttcaatgcttactttaggaggaaagacctaggtaccctaaaacaagcacaactgtgctgccctacacaggaattttttaacataagaaattaataaagaaataattgttaagttctcatctgctttttcaccagttgttgggcaggtatttatatacagttcatctttgaacaatatgggggttaggggtgctgacttccctgtccaccactcctgtggtcaaaaattcacatgtaatttttgactctcccaaaatgtaactactaagagcttactactgactggaagctttaccaataacataaacagtcaattaagacataccttgtatgttatatgaattatacactgtattctcacaatcaagtaagctaaagaaaatattaagaaaatcataaggaagataaaatatactcactgtttacttagcgaaagtggatcataagggtttttgtcctcgtcttcacattgactgggctgaggaggtggaggaagaggaggggttggtcttgctgtctcaggggtggcagaggcagaagacgtagaggaagtggaaggggaggcaggcacacttggtgtaatttttactgaaaaaatccacatggaccctcatagttcaaacccattttctccaagggtcaagtgtacattgactctaagtggggtcctttagcagcaagtaatagaccctggctgtgttaagtcacacagagcaggtactggaaggatatgatatgaacagttcctactattggcagctggtaggagaacaggcttctaaaactcagctacttggcatcaggttggccatcctaggtcactgtggctgccactgtttctgaggtgacattgactttcctcaatcattctctattccaggtggcttccttttcaggcacaggtcaggtgatcagagtccattttccagtgacatgactcaaaccttaggtcctcagggatgtgtacccttgcttctgccatataaggttgcaatggcttcccactaactattccactagtgctggttgtagactggataaccggaggggttaccccaatttcatgctcattcctccctatccccatcatatggcagcaaatccatctccccttgacaagtacaataagatcatccattaccatgattctgttcagccagtaggaggaggaaccagaaatggcaaaatagaacagatcatttccctcactgggagtgattggcgctagtaacccccttggatttgaaattgtcaagagatagttctgactgaggttgatcagtagagctaaattgcctagttccatgaccttgccaggaaccaagttttggggttgatgtgtccacagtgtcaataagcccagtgatcaccccttcgaccattttaccttcttcctggagtaacttcaggatttgaacatgtgtcatcctgagcctttcctccagggggtcctcttgtgagtggtgggtgtccaggtgagtggtgggtgaggggtaatagtgaagtccctgtcttggctagcaacagacaccagcacatctcgctgttggacaaaaggagaagcagccaccgtaaatcttcctcaagcttcctggccctttcacattgcttgtgtggcctgaattatctcacatgattgttttcttagttgctcaggtgagctccgtgaagggagggatccacaaaagtgcccagtagacttttgcacggcccaagtccaatcttgcaagggacagtttatgaatcagggacccacctgcagggccatgagcttggccatagctggaaggtcatgttgcaaagccattgagcccatcaagggagggctgatattcttggactggctggaactgtggggctttccaagagtagagtacgcatatgcactttactaggtctgtccacaaaagtgaatctgactatataaaggttaaagagcacttataaactcagtgaaatcgggcattacataaatgctgcttcatctcggcacagttaaaatgcagctgctgtgacatgttttaggtatgtgtatatgtacatacatatatatgtgcaagtatgtttgttcatattcatgtttttcacaaattatcttatttcaagattaagttggatgtgatattatgacttgtacatgactgtgtactcagacatgcattctaaagtatgaataaagttaaatcatatttctcccctctaagtcagtcaaaatggggaaattatactgagttaggggatatgtgtgaggaaaaataaacatgtgtgttagcattaagtaagcagagctttgagttgtgcagttagaaaaaaattgaagtgcagaactaagcaaataaatggtgaattctgcccaaagaaactgtcaatttgcaaatcagaatcatgatagctgtctaaaaatctgtccactttacatgaactgcaataactgccttccttcctactttatttagataattacttcaacttctgattttattttgctatcacgtagacaaaatttaggcaagaaaaatcccaaaacactgatcttccatagttaggctcctcaattgtaaaagtaatagactggatccaaaaactttctacgactaatatttataaacatgtttttatgtaattgtatttatcttttttaatcttccaaaaaattaaaagcataatcactaatatctgtgtattttgagtgctcatgcttgtttagaatcaaaattcaatgcccagagtggtgagactgtatctttgcaagcttctagtatacacaccctgcacctgatattaagaacccagaattaacagtttttttttctttcttactttttaatatatggcttgttcctttagagcactattgaacttcaaaaccaaacctattttctctaattgtcaatggaagcactgggttaccatagttacatagtaaagtgtcttattgaaaagaagaaaaggaagactaatgacatttttaatgacagattcaaatatataaggaaattgcccccacagggaattgggaatttatcaagctgccaatcacagtaattaccctgcaaacatatcagtatctgggtcagaaactcctttcagattttctatatgccagttctacaatgcctcaaaattttgatcccacaagtgaggcagatcctgttgtgaatgcctgttttcaattagtatggctgcatgagcacacactccagcaaaggtaagcagagcatgcttggtagcatgctcacaggagaatttggtgcaccagccccggagagcgcctagtgtgcaccaagtatgtgtttcattacaccgctgtattcccctcatgtaggaaagttgctgcagactgatacgtcaatgatcttacagtatttttaaagaaaagtaccaacacctgggtgataaattaatctttacaacaaacccccgtgacacaagtttacctataacaaacctgtacacgtacccctgaacttaaaataaaagttaaaaagaaaagtaccatcctcccacagggtcaaatacatatgtagtcgatacaagatacttcaaaaaagtcttatacaatgagatttggttttgcagcttaaatttcttcaatttaagggtacatcaacaaggaatttattgaaatacagtgtatcatacaaatagaatattcacatgaaatgatcaaaggaaggggtaaggagaaaagtattaaaactgaaaatttacctagtgaataagtggacataacaattgagaatctatccacttcatgtcacttatggaaacaacacattaagattaaactacatgtttgctagagtaggagaaagtatataccacagggaccatcattactctagagtgggtctatgcataactcctcaaaaagaggccatcgttggtgtttatgtgctaaaagttgtgtattttggcttctgagaaccataaaattgactcaaagaatagtttcaaagagtaaaagaagaaatgcgtgacaattgaagacatggaattaaattggtttgtctctaactgcctcttagtaatcaagagttcttgcttggcaaaacctcataaaaacagatttaggatttaagacagtgtcagtaaattggtacaagcccatacacaagtcctcaaagtgatggacaactactcagaaagtaaaaaacctgggatcagtacaacgtgatttaaaaatgagaagtgaatgattattctggatttaattcttatttactaggctacttggttctttgtgtttagtagtattttatctatttaagttcccataatagatgtatccagtatatagaacaatagctaaatactcagagaggtatggcgagagagagagagagagagagagagagagagagagagagagagagagagagagaatgaatgacaaccagcttgataatctcctaaactggggtggggtttaggggaggaagatgagaggggataagcctcttcaaaatctcctaggcttctggatatctgcccctaactgcactgggagcaactgcacacacctgtggaaagcaaactgttatggtttggctgtgtccccacccaaatctcatcttgaagtgtatgtagctcccacaattgccacacgttgtgggagggacccagtgggaggtaactgaatcatggaggcaggtctttcccatgctattctcatgatagtgaacgagtctcaagagatccgatggttttataaaggggagtttccctgcacaagttttcttctcttgtctgctgccatgtgagacatgcctttcaccttccaccacaattgtgaggcctcctcagtcatgtggaactgtgagcccattaaacctttcttttgtaaattgcccagtcttgggtatgtctttctcagcagtgtgaaaatggactaatacacaaacctttgttcctccagtcctgatcaaaggtctttaaccatgagttgcctatttctcaaatccttcctctcctacctagttccttcagttccagagctacagggacacagctaagtcacggaaacacccatgcttcacgtcaagatcatgccacatattctccatggaacctaagtggtggccctccattttccatgttcctcaatttacccaaagaacctatcctcctccattttttaaaggacacaacagttcaccaaaaatgattccttatcacctaagtgtatccttcttaatgacgttgtcaaattctaataaagtgcctcttatatccatgtgctaagtaataattcaaatattaaaaataaacacaaatattacaaggagtaatacaattgagtcatgatagattttctaaaaaggatttgattagaaacttccatcaaaaactatctaaaacgtgttttgcattataaacttttatgcattttattcaaaccaattttctttaagtaaaaacttaacagtgtcatcaaaaccacactgatacaaagattccattttcctcttgcttgggggaaaaagggcttggttgagtctcaccaggtttgccagggacaactagaataaaaagaccaaaatttaagctgtaggatattgcagtacaggtaaatatacactatttttataatctaggttttcttatcacagatacaattagcagtaacaaaaaatcagtaggaaaaatttaaacttcagaagttacctccactgatacactaaaggagagtttctcagccttggtactgctgacatttggggccacgacgtcttaactgtgggacagtcatgtgcactgcaggacgtttaacaccattcctggcctctacccaccagatgccagtagcaccactgggacatgataaccaaaaatgtctagtacaatatcatcccatgtggaaaactattagactagattaagggaatcagtatttttatgtcaattattcatttgggtccctaagtttttctccactatttttatatatttcattacctccatctttctaagcaaataaatgattttatttaaaattgctctgggccaggcgtggtggctgaggcctgtaatcccagcactttgagaggccgaggcaggtggatcacttgagcccaggagctcaggaccagcctaggcaacacagtgagactttgtctctgcaaataatttttttaaaaaagtagttgggtgtggtggcacgcgcctgcagtcccaggtacttgggaggctgaggtggcaggattacctgagcctgggcggtcaaggctgcagtgagacatgatcttgccgctgcactccagcctaggggacagagcaacaccctctctcaaagaagaaaaaaattgctctgatatcctaccaagtttattgatgtaaaaaagaagtgaagaaaaagcagtgacagttaataagcagcaaaaatgggtgggcgtggtgcatgtctgtaatcctagtgctttgggaggccaaggtggaagaatcacttgagccagggagtttgagaccagcctgggcaacctagtgaaaccctgtctctacaaaagataaaaaaattagccccgttcctatggctgatacatgttataaagtattaaacaacacactaaggagaagatgcaactcctacctacaattatcaatgaacttccagtgcttgggaaacacgttgaattctgtgggaatttttagtagatcagaactcttcaaatatcactgaacataattactcaccatgatatcctgcttggcgatattaacatacagatctagctgccctttgtcctgcggggagatgtccagtcgtccactgaagggggagatggttactgtccggccgacgggcaggatgggaagagcgttggtgaggcctccgtccacccacttctgtggaaagaaacatctcacgtcagcacacgtcaacaacacatcctgcacaaagaaaagcagcttctaataatatgtgtgccttggatatgcttttaaattgctatttttgaggactaatcccattggggatctgttctgggggtaaaacaaatcttggtacacatatcacttaccaatataagaacaactctggacagaatttaactagattattgtctgtaagacttgaattcttactgactacagtgcatgcttaagaagccatgtgtaattagattggggttcattatttaatcaaactaaaaagtcaaatttactgtggatgctgaacaaaacatccaccagcagaggaggttccatttttattatatgaattggaaactggcattttctgtggcaaacttaaaaagtaaatacagcaactagaaatgcttctaattccaaagtggttcctgtgctcttgaagcaaggggcatgtcctgaagccataaggaatgggagtgctgcatcaaagcacacattcctcagtaggcactcagtgctctcaagcccaccgcaaaggggagtgagtgatggagaaggcggaggacagaagcctcccaaggaagaaaatgaaagagtcttggggcaatgaggacggacaatgaggtgctcaaggtgtgtgcagcctcagcccctagctctacagaagcgcacaatgagaaatggtgactgaagaaccacacagacaatattccttctgctgtctattccaaggccaaacagtctcaatgcagccatgatctgatgtattcacatgatcagctatagcactcaataaacacaacacacatggaaataacacccaaattgtctaagtttatctgttattaaaaatagccttcagataatatacaaaaaaacaaaaagtctggtaacagttgaaagtcctgtatgcaggaatctttagtgaagtttgtaaactgagttttgcttcaatgtgtaaaatgcaatgcagataaaacaaacctttgttattcaacataaaggtggcaagaggagggagaaacaggccaaaataaaatgttctcaactcacttaaaaccatgcatttatttcttccaatgtgtctttttcatgtccttcttgtgtttatttatttatttatttatttatttatttatttatttatttgagacagagtctcgctctgtcgcccaggctggagtgcagtggtgtgatctcagctcactgcaagctccgcctcccaggttcacgccattctcctgcctcagcctcccgagtagctgggactacaggcgcccgccaccatgcccggctaattttttgtatttttagtagagacggggtttcaccgggttagccaggatggtctcaatctcctgacctcgtgatctgcccgcctcggcctcccaaagtgctgggattacaggcatgagtcactgcgcctggccaattgtgtttatttctaaagctgatgacaaaatgagtggtattacattatttacaaaggctctggacagccacaaactcctccaaaggaaataaaagtaaataaataaaagataaaaatgggttgaaaattccttttgagagaattgcattttggtggaggagagagtataagtagattggattaaaataaaactgacctgcataatttgcatattgtcattatttttaaaagatataaagattatgatatattatgtgttatgtgtattacacatacttatttatatgtgtatgtgtatatgcatgtacacatgtgtttgtgtatgtgtgtttatatatgtacccatatgtatacataaaatatagctggttatgtaactgtatgatctaaaagggaggtttgcaaaaaaaaaggctccaaaatatctgattctgtcccagaacctgctttttttccctgattgctttaggtgtaaatatcaaattctggaataggataatacccagaagggaaaagaaagacagcttccaaaattatttcatattgtcaacagaagctgtcatcaacgatgtaaaaattcatacaggtttcatcaagaaaaattaaagatatgcaactttaagtaacagctcttctgatttattcaacttaatgaaaagaagggcaatctggctcagtaaattaaaaagtgttctaatttactgtggggttaatgactgctgttttagggaatcgaaaatcctttttccaaattttgttcactcttgttagcttattctgattagataaatgacaagggaaaatgtatagcagcttatcaaatcacttgattaaacttgcaatgataccggctccttcacaacccttgatgctatagccccactgctcagatatgctaaatgtggtacctcttactcctgatttatgctctcacgagctgtatcacttaggacaatcacacattcattcgggcatacagattccagcagtttctggaaacaaccgtcacaacaacaaatattcttcaacctccaaattaaaagtagaaacattttatatcttgtgctctactgatagtttaaaatcttgcatagtaaacacttctgcccatgaattctctggctgttcacaacatatggctgtgagtcattcccaccttcttgcttcatgggcagcattttacatgctggtagctacttccatgagcttctgtgactccaaaattgtccttaagaaaaatagctgctggtctaccccgttagagttttcctgtgtgtttgtcagttttcatcacatatcaccatcatcctcaaaggaaaagggagagcaagtacataaaaattccaaggcaaaatagtttcaaaatcatactcgttacaggctgtacagtgaccacctctcagtcccactgctagacctactactcttttctctaatctttggccatattctaaatgtgttccacattcaagtcaatgcctgagtcctaagacatagaaataagcaactgctcaatagaaaaaccaaaaacaaaacaaaaaaactcatgcccaattgtggggcagacatctactgtgattgttctctgaaagttatagcactgaaaactggaattaatagaatcacttctaaagagataaggctacccattacacctaaacaggctagaatattcatctggcagtacttgttaaacttcgctttagacattcatgtgttatgggtagctattgagaacatgccttatgaattcaagtaactgctattacataacgcaagtggaaaacttaagaaaggacctgatgagttaacctgtactgaaagggccagtttattcattcagcaagtgatccctgagcatctagtgtgtgtctggatgtatggtagatgctggggatatgtttttgatagaacttccatgaagggctccattttcttaaggtatattttgctcaaaaaacaagtgaataaaaaatactttgctggaagaatgaatgttgctatctataattattataaataccatggcagagggcctagtagtttaaaagtgatttcacatgtataatttaatatgcgaaccctgtaaggcagaaaggtcatgcttgtatattcagttccctcatgttacagaagaggaaactgaggcttgcaggtttccttgctatagttcacggggtggtaaactacgacccaccatctgcttcagtaaataaaattttattggcacatgaccaggaccttttgttgagatattgcctgcggctgcttccctctactacagcacagttgagtaggtgtgttgacagagacaatgttgaaagcatttgctatctgatactttacagagaataaaacatctattgctatagaatatacaggcaagaagggatagttgtcttttcacttcaggttttttttctcgcacactgtaaaattcagggatgctcgatggggcagggcaaattagaactgatttctgaggggtgagaaagaagtaaatgtgctttgaacaataatttcttatttgcaaacatatctgcattgctttcatgagatagcctacagacagcaatgcccaacaatgctcttgattagcaattcctaaaatagaagggagagggaaagagacaaagagatatccacttccttagacacaggtgagaatcttccaattacggtgggaagaagagacagatgagattttttaatcaaagaaagacaagtaaaaatacaattctaaaagagaggttgagaaacctgccatactaacctctactaagcattgattcttggtgcattgctttcttggtttttgcatgtgtgaaggatgattaaaaatgatgactccagatatctacttttgagaaggctctaaagggttaacagttgaccatctataaacaccatacagaaaatttttcctagaggactaacatgttgtttcaaaaattaaacagacagtgcaaaaaaatctaaaaagtgactgaagaataagagcgtctatttcagaataactagaaattgatatccaggtttccatccagccaaatctagctggtggcaaggccagctaccactgtttgctatgacagtgacagagctgcatttccatgtaaaaagtctaagccacgaggaaatagaagcctaaggaccacagtatcaacctcatataaaagcacagttacatggagtattccacaattctctttcccacacaagtgtcaataatgaaaggaaaaatgacccatatccgcatggactagggtaatacaacagtgcattttcacgttcctgtaatagtatatacttaatcttaaccaaaaggccaagaagcgatcttgtaatactacacagtcaaaatattacttgaattccaactcagatgaaagaaacaatgcaaaatcctacagcttttcttttcttttttttttcagacagagtttcactcttgttgcccaagctggagtgccatggcatgatctctgctcactgcaacctctgcctcctgggttcaagcaattctcctgcttcagcctcccgagtagctggaattacaggcatgcgccaccatgcccggctaattttttgtatttttagtagaaacagggtttcaccacgttagccaggctggtctcgaactcctgatctcaggtgatccgcccgcctcagcctcccaaagtgctagaattacaggcgtgagccactgtgcccagccaaccctacagcttttcttctgatctgcatgtgccagttctggagatgattttattctgatattttagtcacctgccaatgctaattctatctcttaaaacaaatgagttaagaattcctcttgaaaattttcattcttattccaaattgacaagaatctgtgaaaacatggcctaaatgtgtgaacattcctgtggatttattctaccactggaaagagttcatatgtagtaaagaaaaatcattagtcaaaaatataggactaaacttcaatttatttccattcattcactgacaaatctattaatgagtatgtactataaggtatcaaaatagtcataagatgaagccagagaaagctacagaactttttaaaataatattttttaaaaagcagttttctttctttcttttttttttttaaacagggtttcactctgttgcccaggctggagtacggtggtgtgatcatagctcactgtagcctcaacctccccaggctcaggtgatcctcccacctcggcctccaaagtagctgggactataggcacatgccactatgcctggctaatttttgtttttttttttttgtagagacagggttttgccatgtttcccaagttaaaaagaaaaagcaattttcaaagacatcattccactttaaatcactggtagagggttttgaaaggactcatactggtatttgctgtggttgaaattaatcttaagtcttattaaggtatgattcttctaagcgattaataaaaacattttttaatgcacatattggatccacaaatatatcttaataaaatccagtaatacccgcaatgtagaaatgaggaggtctgtgtatttaacaaaagtcacaagtggagagactagactctgcccctgttggctgagtcccactttctctgcctttcctgactcagtgccacaaatataagtaacgctaagtccctttttccccttctgccacctccactttcgtcacttcagaaaaacaactaaagacaacaaatacatcaaaacctgagctgtatgaaaacatgaaaatctagaaaataagaggtgtattcagcacaactgaaatgtttatgtaatttaagtcacataaaaagcttatacccacattaaaacactgcatttaaagcaacattcacgcttccctgaaaatggaaaggaaagattctagaaaacaactcggcatggaagccctattagaatgtgggaggtgatcaggcttaaagagagttagtgttaagcagagaatggcacttctaaattgtccctttctggtgttataaacaatgcaaggccgctgtggctctctgtcaatcatgtgcatgaggcccccttattgtggactccattaaacaacagaggaaaactgaatgctttcaggagacataaggttcaactctacaagtaattattggtgtgcctcctatgcacagacaccacatgatcagcaagacactgtcctgggacattgtccagggtcaaggggcttgggtgggtcgctttccatcttcctcacagttctgggcctgtgcgttccctgctgtttaattgtggctgtcactctatgtccatgtccaaagtacttaatcacatcatggaaagttcactagaaactgattcctcattcatgcccttttaaacattgctagtcttcctgtcacacacccacaacatggcgctgcggctggacaggaagaaaacaaggaacgcattgtttgaaaagaactaaagggcaaagcagagtaagaggcatagcaaagatagaaacattaaggactatcttggggaagttgaccccttccaagctcagtgacttcagtgaagtagactgatgtctttacatctcaatttcctcacatgtaaaattggaagtaagaatccctacagcagatagcactggattctggtgtatacaataataacaaaagttttaggctgggcacggtggctcacgcctgtaatcccagcactttcggaagccaaggcgggtggatcacgaggtcaggagatagagaccatcccggctaacacggtgaaaccccatctctactaaaaacacaaaaaattagccgggcttggtggcatgcacctgtagtcccagctactcaggaggctgaggcaggagaatggcgtgaacccgggaggtggagcttgcagtgagctgagatcgtgccactgcactccagcctgggtgacagagtgagactccatctcaaaaaaaaaaaaaaagttttacttcttttttctggtaacaggaatatcgagggcaggctggtaaggtagactcctcaaatcatttaggacctgggtatttccagctcactatttggccatcttcagggtgtgatccttgacctcatgatgaacaagagctgctggagctccagtaatcacatctaagttctgggcaacaggaaaaatggaaagatatacaactttccttgtactgtaagtcccacagttattcggctcacatgtcattgcccaacaatgaaataaatggccacacctaactgcaagggaagctgggatgtataacctagctgcacagccacaggttcagataaaaattgggattctgttactaagaaagaagaagaaagtgtatattggaagagaacctggagcctctaccacctgcctctccttctaagatagaaacactcttaatttgtaagtgagagactggcgtaatagggacatagaggaaaaatattctaatctcctaagtggcaaagtaattttacttgtcaattcaacattaagtatttcaaatgacagcatctgaatatgtggaattttaccactcactctcaacccattaccttctgctctatcaaaacatacattctccatattacctgaagcctattatgatttgcactagagagaaaagaaaaaattccaaagctcagcaaagctcaaggaaagacactgatgaggaccgatgagatcagaacagagacactgcctcgatcctattagccaaagggtttgtaaaactcagttcttttgttgagagaccatcaattccttgagcacaggcctggtgctgggccctcaaggtgagtgggtgaatgaatgaatgaaagatggttaaagcactttgtatgtactcttttattaataaataaatatatattacatatatataaaataaatgtaatttattcatcctgaatatatgcttgatctctgatatatgctaaatagatactttattagatatatgctaaatacttttattataaaatatatatctctgatatgtatgaaatatctactctatttgattataaaacatatctctggcatgtgttaaataggtactatatttgattaaaaaatacatatctctggtacgtgttaagcagatactctgattataaaatacatatctctggtatgtgctaaacagataccctatttgattataaaatacatatctctggtatgtgttagatacctactctatttaattataaatagatatctactctatttagatatctagtagttagatatctactctatttaattataaaatatatatctctggaatgtgttaaataggtataatatttgattaaaagatacatatctctagtaattgttagataactgattataaaatacatatctctggtgtatgtgctaaacagatactctatttgattacaaaatatatatctctgctatgtgttaaatagctattccatttgattataagatgcgtatttctggtatgtgttaaatagatactgcatttaattacaaaatgcatatctctggtatgtgctaaacagatactctatttgattataaaatacatatctctggtgtctgtaaaatagctactgtattaattataaaatgcatgtttccagtatacgttaaataaacacattaaaccaaatactatatttggttataaaatacgtatctgtgacatatgtgaaatagacactatatttgagaataaaatgctcatgttgaacctgtgtccatgcaatggaggagctgccttgggtcgaatggtgaatactcaaaacaaactctgtgtagatcacagaaggaagctgggtcacagtcagcgcagacttcaggtggaagcccatgtctaaatttccctaaaagaactggcatcctgtcttaagtgccagctccaagtgaggagcactctcctcaaacaaaatgggttttggccttgcagtgatcaacgtgtctgggtaagtagagagccttggaggggagtgggtcgtcccctagcagaggggctgaggacaggctggaaggaacctatgccgcattgtctgggggaggacaaggtgtggagccctaaagccttttctcaccctgacggtggtacaactctgcttagaaggggctgtgagtatggactttactaggtggaaaaaaaatcgttcactgctaacaacaacagaatatatatatatgatgaaaataagagcatcacagtcaatcattcccattcacaagatcttgatgataagttatcactagccctgtatattctttccctcttaaagagaaacaaagctatttaggaggaaaaaaacataaactgatttgaagccactagaataattataaaattggatgtttcaaaagaaacatattaatatagggaggagggtaattcctcagttataacaagcttacctgccctttgtattccactagcttcagtcctgcataaatgggcacaaaactgctggctaggaggacctagatggataaaataaagaagcagctcatgattacaggcatgaacattcagacaatacagttgatgtagtattgactagcaaaatctcaataaataagccccacagacttcaagtgcagcactgcacgtaattacataaaagataacactttatatcggaaaagactctaaacagataggtacaagttgacatactctgaatcaatcaacttcacctaggtaaaaatcagcattttaatagtagacacacaagttactacaaaatgaaatttaaggtaagtctaagttcctgagtatgtaaaggttacagataaattatatgtaatgttccatcatatactgtaaaaatcatgttacagttgcactcctgctttctggaggaacaaagccctccgattatgacaggagagattagtccgcagctcagagatgttctcatttatgtcaccaggatttgcaaagggaatggcatattttatgttccaatgacgtggtcaggatatgtaatggaaccctggcaagcagtgacatcaattatgctttatctcccatttaaacagttgaaaaagattgtcatttaggaaattaccattccatacatcatgggaagttgggctctgatagcttttctgaaatgtaaatgttttattttgccgtgtagtttccaaatcactagtgttctatttgaaaacatacagcattagatactgaatattttttaagctataatctttcaactgataagtgaaagactctggctgtttgttgtcaaagatttcatgagttttttttcatcatacattattcagaaatggattatggctcaaatgctgacttgcagatcatccacttacaattatttagaactcagaaggcatttcctccaaaaatcaatgttataggtatggtttttgggtcagctctcaaaagcctatttattctgaactgcaactaaattacagactcagtcaccagcataacaatttccataggaaaatcctcttttgagctgtgacccgacacagctggaatccactcttgccatgtttatttctgcaccaggtacagggaacttccatagctttcttatgcagtggttcttccttggacatgtctcctgtttcctcattaccaaaaaacccactgaaaggagagggacttgtgtctctcctggtatgtccagcccttggcagagttagtactcaacaaacatctgttgggtatctctctcccttctctgtgatgggaatggacccaacactcctccacctacctcaatagtggcactaaagaaggttgcccagtgctgttggtggcatgttggttgcaaaggcacaggcctggttgtaacagctcctatagcaacaggctcctgacgagtgcccacagaagcttctggggcctcaggtttcagcagtggcaaattcaagggtaacagcacaacacaaggactccagcaggaaagaaggtaagaaatagccaagtgtgaaagggttctattgcaccatgctggtgctaggtgccagaatcagttatataatttctgggtcctgtccaaaataagataaatgcagggccccctgttcagaaagtatggagaatattaagatgttgacagcagagcattaaaccaatggtgaggccctttggatagtggagccacgtgcaaatgcacaggtcatacattcatgaagtagaccttgcctcaaatatagtgtctcatttaattatttctcgaccctgtctcaaaaagataaagttgctcaaaggtctctctgctaatacgtggttgagactgtccccagaatcaatttaatataaaatgtatatttttaccagagccaacatacacgtcagatttctcacaatgggtctttttttcatcttttggtcaatttcatgcacatctatctcaatcgcttgtttattgaaatattgaaagcatgctaatttgcagcactgtttcccaaaggaaagcatgcacttctatttattttttatgtgcttgtttatttatttattacaaggcataataataacctcacgcaaggtctgccaaccttctacaaaatgtcaatgtggacatgcccgcactgtgacattcttctcaaaatctcaactttaaatggcccgcataatgcaatactgtgacattagagcaatcatgtctctttcacaaagaggcaaagcaggagtgagtagcaccttgggtgatttggtgaagatcgcttaataaatcaataggagagagaggacagaaagcaggcatcttcaactccaaccctctcagtccaccggtagcaatgacatcattggcttcagagaaaggttgtttacggttaaggtaactgcattcaccctaactaaacctgaccttatcatcaattggctatgcttttaaaaaaataatcacagaccctaggtatgtttcgcaagcacaatgtagctatttaatgaagttattcagcaaatgcaacactgcaaagcaataactagagcaatttgtagatagcgtacatattgtgaaattacagtacttagaggtctttaaagaaccaaagacaatacataaatataatgatttatttcactattctgcagagagacatgtggactgcaaaaaaatcactaaccttagaattatgttttttttttcttttcccccgtgtcaaagtataatgtagagttcacaagttaatgcttgcaactattttgagatatttggatgaaaaatgctatccaattactttcctacagataataacagtaagaatcctcctaaatgatatgaaaagtgcaatgaactggaaaatacttgtcacttctccaaatcaatgtatttgtttttgtcatagctgactctccctttatatggactgatgatttgtatatcaaaccaagtttagttgggaaattagctttagatagttaagagctaagcagcttttcttatttgtagtcagcttactgccattttattgcaggcaaatagaatttcctaagaaaggagataaagactgacattctaaggtcatgtaataaaatattatgcctaaacatgtgcttttagtgtatctcacctcacaatattcccagtgaaattcacctcgccaatgaacctcaacacgtctacagcacttgttctcaactggaggtgattttacccgctagggacatttagcaatgtgtctgtcataacctggggtggagggtgggggggggggtgtgtcctgctagcatctactgaacacagaccagggatgctgctcaaattcctacaaaggacagacagctgtcacaatacataactatctgggtaataatctgggcccttactgccaggagtgcagtgtttgtggttgagaacgctgatgtggaaagcaggggtatacttttcacaccctatcacttggtacagcactttaaatgttggacatatgtgaaaccactgatttgtgttcttactaaacacacaatgataaaaatgagagctagtgtcttcctgtagcaactgtataaaacatcgccaggtgcgcattcccgacacgttctgattgactctcttcattttgcattttacagaaaagaggtatttagaaaattatgtggcctagcttccttagggattaaattctcagcaagtttcatttatgcctaaagtttactgtggactttaatgagaattaactgtttatacagaacttgctgctgtagttcaaattcaaagacagattcaaatttatcttcctcagtttttccaagataatgaccaatcttaaattcagtttttatttcaccttcacaaggctaaatgtgagaggatcttgttaagagcattctcacacatgcaaagaaattcaggacatcactgcaacagagacagggcagaattttctcaagacggccagggacactatggtgcaggaaaggcttcctgggtacctctaccctagagcattcacacgtgtcaaaagaccctttcggaaaacacttgtgcatcagtcttaaacatgaagaattcaatgatttgtaccaattcagggaagtagtggaactctacgacgccattgcactgttaatttatgcatcatttcagctcagccttggaagttgcatatgactttcttttaacctaggggctcacctccctagttaggctttgctgaaggctaacattaaaatgtgtttggatttcctagttgcatgcatgcttctaaagaaaaagagcccacaataaaatctggaactcgaaatgaatgagttggtatgcaaaatgcacacacttgacactcgggggatactgtgtagagcggcacaccaggagaggaatcaggaaggaatcatgctaaataatgaacagtatgaagggatggatgtctggagagtggaggcacttgaaggtgaccatgcacatctggtgtgtacttaagagctgatgaaatactttcatacatacttcatttgaccttgttctgaaggtctccatcttaaagatgaagaaaccaaggctccaagaagttgagactcgccaagggtcccagagcccaccaacaacagggttaggtggatgtgtaccacccctccatgactcttttcaattccctaaattatctgcatttgcaggaactgatctcagcttggtgttgatctgctggcgacccacagacataaagggtcatccttgggggtaacatttttctgggtgtggcacctggaaataaatctctcagacgggaaataaagacatgattttggaggggggcctcctggggctctggttaactctataaaggggtctcccctctgcaggctgccttcaagtagttgagcagacatcatctgtgtttccctttgtcagtacagttactataaaggaggaggggaatggttggcaccaataaattctgaacaaaggaatgccttaaggcctgcacctgtcttataacagtttataaagtagaaaagactgagttaaatcctcatgaacgtaagattcaaaattctgtggaaattcaaccccaaataaaatgaatagttggaccacacagtccacaagggtttcaagaaaacaatcaactagcattgcagctatcaaatgagtgatttttccatgctactaaaggtgaagctcattaagataaattaagtatgaatcatcacacaaaattatttattttaaaaaagaaggcttataatgatgagctgtaaaatcagatgcctaaaggtagcaagaactcagtagcaaccatttcctgaagtattacagatatcggttagcacattgttcatgaagacaggtaataagcaaggggttaaagaataacactgataagaaaaagtaatcctattcagcctgaagaaaagaaagttgtgatttaatatggctttaaaatttcatgacagattcatacaagggtgctgagcaggggtgtgtgtgggttattatgttattcgttcattatttatgaaatattagctccattcagcatgcataaagggctttatcatttaaaacacactttcacatgctttatcttatttattctgtacagtaacactcattagtattactgtgtgaattactccatttcagagatgagaaaactgagactcaaaagtaatcagtccaagaggacaacgtcaggaaacgacaggcctagacatgatcaccgggacactcataaaacaagtaatcattcttgaggagattcaaaaacacgtcaaaatacacacacagacacaaacacacaagcacacactctcacatattctaagctacaggtttctagttggattttcaggtacataggcactctgtaacaaacagcatcagtcagctagtggataatgaaaaactaggcattttttaaaaaattcaactattaagtagcagaataaatgagttaatgataaaaacagaaaatacaacatggagcaaagtttaaagaaggtgaaaatcaccagtgtttagtatttcatgctctcccatgctcttttactctaacttgagttttaatcaacctctctctttctctctgtctcccatcccctcccatctacagaatatccagatactgggaagtagacctgtattagttcattttcacactgctgataaagacatacccgagactgggtaaattataaagaaaaagaggtttaatggcctcacaattccatgtggctggggaggcctcacaatcgtggtggaaggtgaaaggcacgttttacatggcagcaggcaagagagagaatgagagagaagcaaaagcagaaaccccttataaaaccatcagatgttgtgagacttattcactaccaggagaacagaatgggatggggaaaaccatccccataattcaattatctcccactgggtccctcccacaatacatgggaattatgggaactacaattcaaggtgagatttgggtggggacacaggcaaaccatatcaagaccccaggctgtatgttcagagcgaggtgtgccaagccctgggagacccacagctacccatcatcgagctgcttcaatgcatggcttcagagcctcctgtctccacctaaggggagtggggtgaccttcaggcagcctccccagtcccaaccaaaaaggtcggaagcaccatcctcccatggcaccacctcagacaacattctcccaccagccacttctttcaccggaacatatatacttgatcatgtccctacctggcagggggtttactttacttcctcttcacacttcttcctttgctacatcatccctagtcttcccgcactctcactcttttcccctaaatgcttcatgagtattccaggcataggtttcacagtttgataatcaccatctgctatcaaggaactattcatccttcctttttagttctgaaaaatgttaaaacatcctcctaaacacgtggaatgtttcttgtagaacctagaataaatgtcaattattccatattctccttacaaagtattacacatttgtgtcaacaatttctcttctgttcaatgaactcaagtaattacacaaattctctgaatagttattatccaaaacaaaggaactagaaaaacgtcatgttttcttaacagcaatagtttgctattgccgttataacaaattactacaaatttaaccccttcaaacaagacacatgtattgtcacacagtctgagggtccaaagtctggtatgggtcccactggggaaaatccaggtgtcggcagggctgcatctctttctggaggctctgggggagaatgtgtctccttgctcagtcaggtgttaggagaatccagttccataggttaaagggcagatgcccccttttctttgctggctgtcagtggggacctgctttccgagaagcctctgtgcttccctggcatgtggttgctacatctccaaaccagccatgacacagaatccagaaaaggtgtccacttttcaagattcatgtacttagtttgggtccacttggataatatgggatcatcctcctatctcagacctttaatttaatcacatctacagaatcccttttgccaggtaaggttatatctggacaggttctggggattagggtaaggacagttttgggtgtcattcttctctctgccacataaaagggatggatagggaggatgagcattttatccagtgtggggtatatatagttagggaagaatgctagacacatgaaccacagtcacagctgggccccagccagctatgtgattttgcccaggtcatacagtatggagggcccagcttctttcttttcttttattttaaatcgagccagtgtaacagatgcaaccttggttcatatccattcgtttcacgcatattacggagtgcctacacaatggctggcagtgtggcaggtactgggctgcggcagtgagcaaaccagagaaacccctgcctcttggagcttacattctggtgaaggaggatggacaatgaaagctgaacaggacagcagtaaaagaggtagcatgctaaagagtgatatgtaaatcaggagggatgtggggagatcaggggctgagagttctgtcattgtagacagaaaaaccagggatggaccccgtgagagagatctggggcagaatccccctcattttatgtcacaagagcacacagtctgttcctaggtaaacaagaggatgcatgtctgcccaccgcaagccttatctgtctgtattggacattgatggcttaggaccacttagcatgggttgcccagctcttcccttgacactgtcaagtctacataatattgtaataagattatagaataatgtctttttataagatagactcttgtaagtgagagaatgacgtaatagggatatcgagggaaaatattctaatctattaagtggcaaagtaattttacttgtcaattcaacatttcattaagtatttcaaatgacagcatccgaatatatggaatcttaccacttactctcaacccattaccttctgctttcgaaaacatacattctccatattacctgaagcttgttatgatttgcactagagggaaaaacaagaaaaaattccaagagaagtacaccctttccaccctacaaatattcagtgcattaccacagcaggcacattggtatttggaaatcaaccagctgaagtatttcccagagatgatgaattctcaaccaaccaactttcaaatgtgtttggatagaaagacatcagaacaaaatggaagaaacaaaatggaacattagattgaaaagttaggagacctgggtaccagaattagctcccactgccacgcaggataatcttgggtacataggtacgtacatcacataaaatctttccattcacttctctgttaaaaacataaaagggatcaggtgtggtggttcatgcctgtaattccagcactttggggggctgaggtgggcagatcatttgaggtcagtagttcaagactggcctggccaacacagtgaaaccctgtctctactaaaaatacaaaaattaggtggacatggtggtacgtgcctgtaatcctagctactcaggaggctgaggcaggagaattgcttgaatctaggaggcagaggttgcaatgagccaagattgcaccactgcactccagcctaggcaaacgagcgagactccatctcaaaacaaaaacaaaaacataaaagggtcacaataacacctaccctacttgatttacagaaggacttgaaggactgaataagagagtacatgttaaaaaccctacatacactccaaagtattagccacataaatttcaggaattattattgctactaaactgcatcagcgacttgcttcacataatcaacgtgagatctgaacattgcaggaaaacactgaacaagtacagggagcatttggatcacagtgcatcataaggcggcctcaggagggatcctggcgaatactttcatcaaacaagtaatttactgagcactcaaccatctatcgggcctggtaagagacacaggatctaaagaacgtggtaatgctcattactttatatgaagtattgaaatcagcacttgctgatttcttcaaataggaaacatggctttgttaccttaatgaggtcctccctggaggaaaaagtggagactaagtgattttctctggttttggcgttggtgatggatacgtgcagtcggttctgggccagctcgtgagcgctgggaggaagaatcgactccatcccacttctaaagaagaaaaagcaatctgaattactcacctttaattattgaactccctgtaaatattttacaagagagaatgctgagcttgccaaagtttgtacagagagtcgtcaacattctgtcttcatgtacttttgggcaaaatgtactctgtataccttagtcgggccatgaagtcataaccgggcgttactgccccgaaagactgccttctgatttcttcggcaaacttgtaggtaaattggttacattcctaaaaaaagaaaattaagaagtgaccctaggtgttgtaaagaaaacaatcattccacttctaaaacttgggattctatagacccaacagcaaatgtagggtgtcatgttattaaaggtgtgcaaattccccacctggccggggcctcacccaccactctcaggccctttgcaaggtatacactctcaagaatcctaatctttttttgttttttcctttgtaaagcaccttaaatggcctttgccccatctgaaaaatccttgaaggctcaatctgaattttaattgagcacattcttcaaaaggtttcctcagcgcaattaaccttctctcccacccctattttgtggtctcagcagcagtttgattacaaccgtgcaacaaagctgattacaaatgacagcaccagtgacagaaataggagtagtgacgtctatggtttgcacagactgaatcagagtcttcggagattcatcttgggcactggtattttataaagtctttcagggatgctcatgtctaccctggactgggatccacagaggtgacactgtcagttcatcttcacatcaccctgcagggtgggtataaccatcccacttgacagacaagaaaacggaggattggagagttcaagtgtctatcccaatatctcattaaaaatgagtctcagagccagaatttacatctaagtctattttgtattaaataatgaattaatttggcaaccaactgggcaccaggtacttggctaggcactgggacttggagaggacaagatacaaagaccctgtgctcatgagagtcataagtgcctccaagagcaggtcatagagggctataagagcccccacaagggtgtgtttggctctcatttagtgcaaaaaataaataacaacaggtaaactgttttgagaatatgaggacatcaagtctcaaattcaggtaaatcattcaatgtcttaacattgcagaatttcagttaagtggctatattattgcagcagtctctcctctccccacaaagatgtccacattctagtccctggaacctgtgactaggagaccttctatgttaaaagggactttgtagatccagttaaggaccttgagatgaggagataatcctggatgacctgggtaggcccaatatcatcacaaggtttcttgtaagggaaggagggaggtaggagaggcagagttggagagatttgaagatgctgtgcttatggctttagaaatcaaggaaggggtcaggagccaaggagtctgggcaccctccagaaactggaaaaggtaaggaaatggattctcccctggagcctctggagagagtgagcatggacattttgattttagctcagtgagacccttttagacttaagaccgccagagctggaagatgataaacacatgctgttttaagccactacgctgaaggtcctttgtcaaatcagcaacgggaaatgaatacagtgtgtgtcaacctccaacctcatgggttgccaaaggtttccctccaatttgacacccaggctgggacttaaatataaacaggagttgggcagaggacgaaggtgaaagcagaggatagtaaaaacaacagcaagaacaattctgagaggggcacagagctgaaatgtgtccctatggcgagccacaagtagggctaagtcacatggggccttgtgatacatgctgagaaacctgggtcacattgtcctaagtccacagacagcccctgccccgggggtaatgaggtgatcagatgtgcctttgggtgacatcactctaagcgctatgaggtaggtggattgtagggagcttgaattgatataggctgtgggaagctcctgggtgagaaatgggggtagccccaccaaatgtatgttcattctactgagctagactgcccatctagcctatttctttgtactaatattagttatattcaatactctccatagcccggaccagactgtaaacttattaaagatggacttattcatctttgagttccccactgagtctagcaccatggcttcctcgcaaattgtgagggctgaggaaagtcttgcagcattgagctcttccacatcaatgtctaaatttgcctaccacttaaaatatgcccagtatcaggtgctcctcttaattattcatgcataagctcagaagattaattacacacgtatttgtcacaacagtaaaaagcttgaggaacttatatcatcagcgagaaccgagcgaacacgaatctgagtaggtagaaacatttgctaaaaaaaactcaaggctatcctacaagtggattatttcagatgctaaaaataaaggaactaaaataaccttaagtcaaagggttactttggctgaaaaattattttgaagaagaacaaatgaggatgccctaaggaaactaagaaaattattttctaccttcccatgggagcaccagataaagacacacaccttttcatcataccagcaccatcagacaacacaacccagtctctcatttagtgcaaaaaataaataacaacaggtaaactgatctgagaatatgatgacatcaagtctccaattcaggtaaattattcaatgtcttaacatggcagaattttagttaagtataaatggctgtactagtgcagtatttccaaatcaggttaattctaaatcatacaatacattttttaatttgctgataattggaaaccaagtctacataactccaaagcttaggatttgccacagctcaagaaaagactgcagtaaaaaggaagaagtgacaccctgaaagccctctgcttcaaaaacgaaacacagttatgggaaggaggtagcttgtaattcaaagcttatgaatctgctagtttagggggaattttccgacctcatttataccttgcatggcttaaggttctggtcctgtttaatctctgcagtttttaaatcacttttctagttccctgtaaatcaaccatataaagacaggaagataggtggatttctgaatgattggcctcaaatctagcttccctttgataagcagctcacaaaagatctgaaatgagattctgatgtttaacattgcatagttttggaattttaaatgtgactgaaattcattcttgggtatgagggtgttaaattgttatttcattattgttcaaagctgctagagtacgtaatgattaacaaatataatattctccaactacggaatccagctctcacagtcagcaaatgattgatcactgtctggatagcagaaaacagattttaaaacatagattgcattaaataaagtacttaatgaataattatttgtattacttctggataaattgcttggaactcagagcttcctcttactgtgagaattaaaaaagaattaaattcctataccattccacttaatagaaactgcatgcccacattttaatttatgtatctatttctaagtagcagtgaggtaagacttgttgcccacatgttcaaggccttgaaaacaggccccatgctcttctcatgatcatagaaagaagaaatatcctttgcttgaaaggaacagagctggaatcttaaggataaataaaaactcaagagtaatataagtcattttatttccttatttcactatcacccaaaataatcttttccacaaccagagcacagatccctaataattacatcttaagagaaaagtcctaatcctttctgtttccaagcaaacgattatttctctgcagtgttaacttagtagagtcaatgctggtgtttgcctttgggtcttaatttcttgatgaggaacacagcctaagttactacttaattacctctattttttctggtgctgttagcagaacagaagcaaccaacgatcccgcagacgccccagcgaaggctttgacatccttcacaagttttttgccatgtctgcaaagtgcagatgctgcccccaagtggtaaatgcccagaaatccacacgctgcaaatgataggttgatgtgcttcattctagctgtagcactggcaatacaaaaaacaaaaatgctgtaagttggaatagtttatcccacatactgtgtagtcttatgttgatcatcgttccaaggctttcttctaacatcattctctgttttaagcacagtggtttcaattaattctaattaaacacaagaatctttcaaggaaaccctttctttccctcctcaccttgacccaagtcttatacattaaaacaaaacaaaacaaaaacattccacatttattcggtacatagattatgaatctacgatttaattacttggcaggaaacagacgtataaattccagttgacaagggcatttggtcttttctcttgaccctttgaaacgttttgcgggtgggggcggcactaccattatgaaacagaaaattattagagaccgtatcaaattccaaatgaacaatacatttgttcttggtaagtgtatcagaagatttcaaatacagttccctactccccttcccaatttctattgtgagcacccatgcttttatgaacgccaatacaattactcagtaacgcaataagcaatcactcaacaatgcaatacatttctttgccaagtatctcaacacaaactgaggtcatgcctggtgaaggcaatttaaggctctatgaaatgtcagccacgccactttatacttggaacacatctaaatacaaaattacatgttttcctatgcctcagtgcgcacaatttgcccaagtgaatgaaattgtgcctccacaaggctgtccattctgaaggtctcagggtttccttgggggcccaagggccccattcagggaccccaagatgaggcacattacagggcctcgaatttagggacctaagaccgcctgttcctgatgcacccggccaggccctgtgagggcaggtggctcggccgccgcaggctgcgctggcgtccgcgtaggctgagtcccagtcatcgatccggggtcaagccccagttttgattccacttctgcaaatggggacgggaagggggttgggtgtgtagcaaccaggcggccaggcccagccagcacaggctcagtgccctcccgcggcttggaggccggcagggccggggtggtccccgcatcagtcccgcaggagcacacccttgctgggccccagggctccgtaccaatgcagccccgggacacttccgtgttgaacgagtccctttaaccagatggcggggccgggccgtcactcaacgccattccgccaccaaggccgcgctacgctctccgcgagccggcccaggaaagtcctgcggcaggggttggtaccgcctcccgcgcaggtatgtgacgtcatcgcgccgacgaaggcgcccgctaggccccgcctgctctatttaaacttctggactcaacctggccgctagaccggagcgtcctccagcgcaggcaaggattcctcgtttagagtcatgttatcttcgagtacctagagagacattttaacccacaccctagagaggcgttgtaatccttacgtgtcttttaacgctacttggcccttacctgcgagcaactgacctttaataatcctcattttctgtgccccggaagtgccttaccctcttcgcgtctgtttcccggaagtggttcttctccctctccaccctttcgcccgcctgggcggtccagctgcccctaggggccaactccagcggctattttggggctggacatcccgcagcttttcaaggcgtgcctttggtttttttaagaagtgctatctaaaggaaaagctggactatgactctggggaactttcatatcctcagttgaccttaggctgtgtgaccttgagcaggtagcataacctctctgagtttcccgcgtgccttatgtgcagattgagatgctaaaatgagagagctaaattggaaagctttttccacatagggggccgtgagcaggtggctgttttgtcctctggcacctttggctcagacttaagcagcttcaacgaccgccaagatgcctgccatgcccaccaagatttaaaggactctgataattctttctctccccaaacggtgttttccttatctaatcctaataaccaagcctggaggaatccctgacttcgtgattgaaggctctccaggtcccctagtttaagggcagagatttactttctctgaggctacaaaggagcgtctgcgagaatgtctctaccttagacaaaacagggaggaggggtggagctctccaaattgcctctggtttgggctttttctttctgttttggtgtatcgtctctggccaacaacacctgtgagtccttgatgtgacgattagggaagatgtttttaattcacataactattctttagagaaaattgatcctgaaacaccttattgccttatcgtagaatgactgcattactcagaattctttacctctaccggaatttagtgaagggaaggcacaacgtacattaggaaaatacaggacacactccagtccttaaaccttccacaatcttctagctctttaaggtcgagtgtgatcctccccagaactgcatcttccaggaagctcatgagaaaggaaggatcccaggtcccatctctgatctgagtcggcatctgcgttttaacagaatcctgaagcagtggtctaactcctttggtggtgttattgtttgcatgtatacctccaaaattcacatattgaaatactaacccccaaggtgatagtattaggaggtggggcctttgggaggtaattaagtcatgagggtgaagccctcatgaatgggattagtactcttagaaaagggaccccagagaggtctctttccaccatgtaaggataaaagtacacggagaagatggcaatctgcaaactggaaaagggccctcctcagaacctgaccatcttggcaccttgatctcagacttccatcttccagaactgtgagaaataaatttcttttataaacactcagtcaatgctactttattatagcagcctgaatggattaagacaggtggtctggtttaaagtgatgtggtggcatcagaagtttaaggagagactggatttacagaaccagaatctgggatgctgtttacagagcaagttatttcctgcatttggacactgtcagcaggtcgattcaggagacaggtgaaaactttatcaccgggcagcctggatgaacaccacaactttgatatctttcacttaaaggaaagataagggcatccactatttctacacctggctggcagagtgagagctcaccaaaggtaagtctctttggagcagcaaaatgctccataatttaactcttaaaattttaaatttatttcctccttactcccttcaatcccgtatcatatctccatgtaactagttaaaagttcagctctcagctgggtgaggtggcatgtgcctgtagtctcagccactcaggaagctgaggtgggaggattgcttgaacctaggagttcatcttcagccagagcaatgtagtgagacctcatctctaaagaaaaaacaaaaaacaaaaaaagttcagctttctaatgtaaggaaggatatattcattcacatttgtctttgtcatctcatcgccaagcttagcacttggcccatagtatatgatcaataaatatttgttttggatgttggatttatgtaaattaccattgtgatctgaatatatagtaatttaattgctctttgaaacttttttttctgtaattaatttgcttatttttgctcgtctattttccttagtaatttagtttcaaacgggtttgtttatttagccatttacgtaattattaatcatctgttgtatagcaagtgttacgttggtacagggcatacacagttgaaagaattcagcccttatcagggatgcagagtccagtggatagggagacatctgatgtgtaattacagaggcgtgatgatgtggtattgcaaagccatgcacagatgccctggttgtgcacaccagctacggagtaggaaacctttagcttcgggaggtgcctacagtagcacccagcacagaaacaaaatgccccagcttgatggctccttttcctctccagtgcttcctctcaggagattttatcctgtatcccataagggaggagaaatggacatgggtaagtgttgcttgtccacacctctgctccagggaaaggaccatatctcagaatctttgagtctaatcagttctttcagtctactctccttgtggtgttatttcattttccagtcttggcattttttttttttttttgagacagagttttgctcttgttgcccaggctagagtgcaatggcgccatctcagctcaccgcaacctccgcctcccgggtttaagcgattctcctgcctcagcctcccgagtagctgggattacaggcatgtgccaccacgccctgctaattttgtatttttaatagagacggggtttctccatgttggtcaggctggtctcgaacttctgacctcaggtgatctgcccgcctcggcctcccaaagtgttggaattacaggcgtgagccactgtgcccggcaggcatcttaacacctcttgtcggtcaacgttacaagtgctttggttttttaaaaaaacaaatctcttgtcgtgtattcaatatgctttgcttattctgcctcctgcttgataactgctcttctttgtcacttcctccccaaatcttgcaaactgatcccgatgagctgtggagcttagatacatgcactttaatttcaggggagtgtggcaacactgctggagcactgccctttccatgggggcttcaaagtgatactcatgataacatgccctctgtgcctagtttaagcaatatcttgtcttgagaccaccatggagttcagagaaaggaacttttgcaatcttggagtagaactgcccatccgaaaccatagaaagaggggctacttccttcctatagatcaccatctctaggaacacagtgagggaatagatgaagaaggtcatgtgtgaatgccactatgtggagggagccagcctgaaaacagaggcagcttagagggatccagagctgagaatgaggtagagagagagagacagacagacagacagacagacacagacaggcacctaggtgtggttgcccctcttgagcctgtggatgcaaatgtaatattatacattgaactgaaaaatagagatggtaaggatttcctgagtatttctgttatcgtattagaattccttaattacagtgcttgtaactggtgttctagataaggtagagccggtaagctttcaaaggtttcatgcataaacaatatattttatattcctgactcgctttccccactacacctacccttttctatttgttaagttagttagcattgagtttctaaagcttgcaaaccaaaccgttcttactaatgtaagtgctttttacattgcgcatggctgttttccattagaaatatgctacaaaaactgactacttaaaggaacactgggtaaattctttctaaatgtaatatactttcaaaaaatatgaattttatatatataccatattatatatattacattattacatatttctgttatatatatgtttacatatttatataaaacaaaataagacttttctttgatagcatctgtgttttagtctgttcagactgctataacaaaatacccaaaaccgggtggcttatgaacaatagaaatgtgtttctcacagatctagaagatgaacattccaagataagtcactagcagatggtgtgtgttgaggtcctatttcctgattcatagatggcacctttttgccctgtcctcacatggtggaaggggcaagggagctctctggggccactttgataagggcactaaacccattcatgaggctccaccttcaggacctcctcccctcccaaagaccgcacatcctaacaccatcactgtgggggataggattcaacaaatacatttttgggatgggacacaaacattcagaccatagcaatctgaaaacataattcaaaatagccatcctttggaaatataatttatttatgactcagtatatctgataatatatgataatctttagatcttttaacatggtgttgaaactaaatatcagactatttctattaaagagaaacattttaaaaatgtgacatttattttataaacttcattttaatttaatatgtgaagggttccaaatgtaatattatgcattgagctgaaaaacagagatagtaaagtaggcaagctttcagagttcttatacttaaacgatatattttatagaaaacgggttcagatccttgatagccaggtggtgagtatgtggtaccaaatgtacacataatcctaaatattttttaaaatcccagtcaaagaaaactggtattctctgctctgtgtacttcatcgcaaagcaactgtacagtggacatggctgctaggggtccaccaattgttcagacataaatagtcctttctagccttcaaatatttttcttatcatggagccgattactgaggaaataatatcaatatcaagtaagtaatattgttgggtgacaggtggacagcttcagtgccttatgctccatcaaattcaccaaaatactgtattttaatttggagtacaagatctagacattaccagtgctgttatcaaaatgaacaccgtaactactaaaacatttaattatctaatcacctcatttcaaagagacaaaataaagattttggtctattctttgttagtaaaatgccttgctttcctgagcacccactcctattattagaatcttattattaatatttactacacttattgtctgcccactccatgccagtcctttatatacattgtctcatatcacttgtacaatgttaaaagatagaaatatatgggccgggcgtggtggcttacagctataatcccagcactttgggaggccgaggcaggtagatcacctgaggttgggagttcgagaccagcctgaccaacatggagaaaccccgtctctactaaaaatacaaaattagttgggcgtggtagcgcgtgtctataatcccagctactcaggaggctgaggcaggagaatcacttgaacccgggaggtggagcttgcggtgagctgagatggcgccattgcactctagcctgggcaacaagagtgaaactctgtctcaaaaaaaaaaaaaaaaaacagaaatatataataatatataatagatgactcaaataaaaagagaaatatataatagatgaaagtttaaggtagcctttccatatctgtgctgagattataaggccaggttgccctgctctaaagcctgtgcacaaattagtaaaatactaagcttttatgatgtgccaagctttgtgttatttggctactctgagtctcagaatctttcttcctgtaattctttctcaggttagaatttgtgattggtttcatatctggatgtttataatttaaaaatggtaaaagtcttaatagatgttatatatgagtttatagcatttaaagaacttgttcgcgtcttgaaaagaaaaataaagcaagcctagcaattaattaaaactacccttctctattgatcatttgcagcagtaactcttttttatgtctccttttcctggaagctatgtcataaagtaggtgattgtaaaacaaacataatttccattaggagcaatgttataaaaggggattatgttattggctaaggtcttaactacaaataaattatgtatctattcatttgtcttcacgcctttgctctcattagataaactttttgtccaatatatgaaaagagctgggctaggcattacaaataaattttaaaagaatcttaaggtaaactgttcctttagctcactgtattttcttgttcaaatgtcctttcatacttctgtgtcccattaagccctactttttcttcaaggcctaaatcaaactctacttgtggaatacattcaaccacctctgttaatcttagccacaccctcatctttgttactatgtgtacattattgctgtagcatctctgaccttttatttcagttagggatatgctcgccaccactctctaggttcagagttcatttggagcagggactatgacttgtactttttggctttctccagcacatagaagttagctaaagcataggaaatgagtaaatgtttataataagaatctttaaactgggctgggtacacgcctgtaatcccagcacttcaggaggccaaggtgggcagatcacctgaggtcaggagttcaagaccagcctggacaacatggtgaaaccccatctctacttaaaatacacaaattagccaggtctggtggtaggtgcctatcatcccagcttctcaggaggctgaggcaggagaattgcttgaatccgggaggtggaggttgcagtgagccgagattgcgccattgcattccagcctgggtgatggagtgagactccatctcaaaaaaaaaaaaaaaaaaaaaatctttaaactacatgtttcagatatctagctagctttagcagaggaaaatatgctactttaaataatcaaggtgctagaggtagtgctaactgcagatatggctcggtcaggcactcagtgaatgctgttagggccatgtattagtctgttctcacactgctataaagaaatacctgagactgggtaatttataaaggaaagaggtttaactgactcacacttccacatggctgggaaggcctcagagaacttctaatcatggcagaaggggaagcagacatcttcttcacaaggcagcaggagagagaggagtgagcgaagggggaagagccccttataaaaccatcagatctcatgggaactcacttattatcgtgaggacagcatgggggaaactgccccctatgatccaatcacctcccttccttgacacatggagattatgggtccctccctcaacaggtgggaattataatttgagataagatttgagtgggaacacagagccaaaccatatcagatcaccattttgccacttcctctatatgtttctcttcttagtctcattctgcaggcagcccctcatcttcttagcttatcagtggaaaagtgcttttatcactatctccctcccaaatttagaaaaagattcctgttggttctgtttttattacatgcatgtccttgcaataatcaatgtgaacagcaaattatgatacatgatggtttgagcccatgatgagatgagcatgggctgtgcagacagtgggtaaatatgaatggatgcactgcgggtccagagacagttgggtgggaaagccctcctaggaagaggcctggcagactcaatccacctgtccactgcagtatttgataaatatttgttgaattcaatgaaagcaaaagggcggctgtaatctctgtataaaatgggacaatttgctttactccttttgatacataaaactatatagtacatatctaattggcacacattccgcctaagcgaataggaacacaagtatgatgtttagtacaaccaaaagttagttgcaatattagatatgttcaaattaacagtgtgttacttggcatcagtgttgtccagcattgaattaactatagggttacttggcttctttgaatttcatgggctattttggatgtgagagggggcataagacttgctcaccaagtcagtgtaaatgaatgatttttcactgtgataaatttccccatagggagctgtgctacttagagtggtggcaagaatcttatcttacacatgggatgaaagtagatgctaagtaaatgtttgtttttgacatcagtgacaataatgataatgcttttctgccaaaaatttttaaggagtaggaggagatcccaaggttctctccatcatctcttactttagaacatagcatcataaggcattttgaaaaagagaatagtcaccatttagtggacatcctttaaggtatcatattttgtgttaaagccataaataaatatactattgacataaactttcaaaaatgttctttacaacaacttcactaaatttctaacaaaagtaacataataccccaacctatacagatgcattccccatttggaaaactacaaaaagaataggtaaaagtgggccaggcatgtgagttggaagtcacagtgaaattccaaaagggccctggctgacatgtagaaggtggctgtagtttcaggctctcttattatgacttgaattctcagaaaaccagcagagaagtagggggctaatagaacccaataatatgtgggacaatatttgttgaattgtatggattgattctattattcctggtgaaaaaattcccaagctctaatgaactgtcattgattcctgtaagcagctaaatgtaaaataatgaaaacacagaattcaccctctgtgaacgaaagagatggcaagttcaaagtcattccaacagcattaattacatgggaaagcctatccccaggtatacctgcctaagatgtgttttgcatttttaaaattcccaggtggaagctggagagccctatctatattgtccttttaagcaccaagctttctttcctatattttattctctcacctcatcttgagggagcatgatcccactcttaagatgcactagaaatgtcatattaagacagtaaacctttcataatataaacatttgagtagccatatagcaccttcacatctcacttaaaaagcaactgtagaagccaggcatggtgactcacgcctgtaatcccagcactttggaaggctgaggcgggcagatcacttgaggtcaggagttcaagaccagcctggccatcatggcgaaaccccatctctactaaaaacacaaaaaaattagctgggcgtagtggcaggtgcctgtaatcccagctactcaggaggctgaggcaggagaatcgcttgaacctgggaggcagaggttgcagtaagctgagatcgctccactgcacttcagcccaagtgatggagtgagactccatctcaaaaacaaaacaaaacaagacaaaatcaaaaagcaactgtagaaagcagaacacaccataaatataccataaggttaaggttcttcaaaaggctcattatcattctggaatttagttttcctgtatcttcatgtatatctacaccaaaatttagaaaattcactgagcaccaaagatgaggacatttttctagttttatcagagaaaataattcagattctgtagggtatagaaacatttacaagataatattttaaagagaactgagcttcatttcaccattctgtgaacctaggcaaaagttacattcacttctgttggaaaagaaactgaaatgacatttttgcttaattgttaaaagagaagtaccttctgttaatgcggacaaacacattggttcaatgaccccaattttacttacacttaacatccacccaaactaaattttcattaactgttgatgtgattgttgaaattgcaggccattttccatcacttagatgttttcaaatatcttttctttttttactttctatactcattttgttttttactttgtatactagaatggcaaattactatgatactgtatgcaacacaaaacctctctgtatgtacttttaatttaccttatattttatgttgttagaggaaagagtgttaagtttatgtttttttaattaacacacacttgcatggtgtttactgtgtgtgtcttctaaccaccttacagatatcaatgcatttaatcatcttaataacgctgtgaggtatgtactgcgctggcactaacattttaagagtggctaaatggtctacaaagagactaagtaactttctcaagatcacacatttgatcagtagcagagccaggattcatttctttaccattttgccatggtgcctccccaatgccaaagtcaaaagtagcaaagtagacccatgttcacaggttgtttatggcaggcattttcgtagagacattgataagtgaattgagaaatgaggctgtccagctgtaccccagcaggatcttgagaggctcatcctcctctaccaagctattaaatgtcgagttatcaagacttagacttggggtccatttccttgtgccaactaggggacaccattcctgcccaaagctttggtgtggtctctcagcctccggcctccacatcaggtagtgtggtaacacgaggactcctaatttggactgcctacctgtgcataggggccaactcaggatataactcagggaaagcccctgcctaggtgaagggggaaagcccatcctgcccactagcacagtcgaggtgtgggagaaggaaaaagggctaccgaggcagaaaattaatgtgctacttcccccaccttcatggttctatgttgggagtgctcttgtagacgcacacaggaaggtaaagggcatgcctgttttcccacacatggccttggggagctataatactctagtacagtggttctcaattctgctgcttttgatgagtttaggatggagcccaggcatcaatattattttggtggtggggagtcggcggggtaggggtggcggggggagttgaggggacctctcaggtgaatctaatgtgtagctggggttgagaaccactattcttagagaagttctctggttggtcaacatgacaccaggactataatgcaggtttgggagaaggatatgcctggatcctgagctaacataagcgtcagcctggtgatcaagggatctggaagattctgcctaccccaatgaggagtgacagaatagctgagcaaatccaggccggcctgagatggggatgcagtcctgggggtatagagaacagaggcaaggaccaggaccatggagtccagcatcaggaacatagctggtgccacacgtgccaggtgcaacctcagggaacgccagtccaggaaccacccagaccagcagagacagcacagagccttctggtacttgatcacacctcccatttcttccccgttcacaaagtcctaggaacagtgctggatacacaatttgcagggtccagtgcaaaagggaaatgaagaacctgtgcacaaagagcaggaaaaaaaaaattgccattactagctttttccttatttctgtggcctatctccctcaatttgttaaagagttttaaatttgctatttgatgtctaagtaaagaaaaaatggtaaataattagcatgaaacttcatcattcatgtttatattgcatgatgccagttttacagacaaatatcagagcatttaagtaggatgtgggactatcacaatcacacaacccatgttttgtagcctacacatgcacatgcgtttcattctggcctgaatagtgaggatgccgtgcaagagtagcccaactcttctgattccacttcttgatatgcacacattgaaccaacactctccacctgctgagtgaggaaggcctgaaaggaaaagaattgtgggctcctctatcttttgctttcctctgtgtcatcattttgagcttaagtggctggccaatccaggagatgacatggataggtaggaaaggttataacaggcttccttggtcacatgtgtttctttagtatacatttgctttctctctgctttcgaagaaaattctggttcaaatgggaaaatgtggcatctgaggctggcagcatttctcctaactcagccatgagtataacactgtcccttggtacttgctttgagactgtgatctcccacgcattgtgggtctattgttcttctgtgctcatgaagcatcatagaccctatgtgtacgaagcaggcagctgggaacagcagacgtgcacattgccagtatctcctctgctcatgtttatacatcagtgtcccatcagatgtcccttagaaaacacaagttcaaacataaaattactacagatttcaagatggccacagcagagcattaatccaagtatggggtccttctgagcatggggtcctttctgagcatggggccctgtttgactgtgccagctacctccccatgaatctggtcctgctcagggatgctttccagtattcccagttaacatctcacagaaaatggggagagaagaaactttttgctctgcatgaaatgagactgttgtgattattagatactagtgataacatgaaagaacaaaataatttactcttggctgtttgtttaaaatttctattcctgagattcattgccttagttaagactgctttggttgctgagagaaaaagcagaaattatatgtggataaagaagattactgttagaatatacttgctaaaaaagtagatttcaagtgttctcgtcacaaaaaaatgataaatatagagataaggcatgttaattaagttgatgtggcattccacaatgtaaacatatttcaaagcatattatacgtgatagttatataaaatttttctttgtcaattaaaaaaataatacagaacccagggaaggggggatgtctaggggattggcactaggaagtggaaagccaccggaaaccatgtgtcctctttggatttccagggtcttgtggattctcacttagcatctcttgcttccattccaggagatccactttctctgattctcagtgtgcacaccataaccaaacgtggcagccttcagctctggagtttatacaacctcagctcaggcaaacagcacagacagtgtagagtctcatttttcctagtccatatttctggcagagagaatgtgattggacagatgtccctggtcctagcagtgatgaatggtgagggctggggggccaggacttggaagctcatgggatggacaacattcctgaagttttctactgcacccttcgtacttggttaaatgtcctggtcataagttaactttataatagataaatcatacatctagatctagatatctgctttttctcttactattgtttacatttctttttttggtaactggatcaatacagaagatgagcacaacattttataaataaaagataataaaaataatctgggagcagttgcagagcccacgctgtgtgccagtatctttgctcatcgcgttgtattcattgtgtcagtgtccacaataagcaccctggagctgggtaaagtcactcaccccaaaatgccaaggcactttcccaggggcctggacaggaaggaagcagagccaggaaagaaatccagattcaaatcagtgctgagcctgtactctttttactagaaaataacaaacacgagctggcttgattatgtactcttttgagaaactatcatcattatcattatagccctcactttctccctggttattcattgactgctgtcagagttcagacaacttctgatgcttgatttttttcaaggaactcaattaaaaagatagtagcaattaagcacagcagattgtcagaaatgtttgcccttagttaatgagtgactttcagaatagtgctagtgtgtcctccaagattacatgcataatcccacaaaaattgatgccaggtgggcctgacctgcgtgtgaaagtagatttcttgtgttttcaagatgtttttctatagccgtttccagtctgccctctgctggctcatgagaattggatattgcaaatcacagacccaggcaagtaaatgccagagagaagccacaattccctgggttgaaagagccaaggaggtctcaatctcataaggccttagtccattcagaaaccaactgactctcccactacctgtattttaccctttcccaaaccaactccaggaaggcatcaggaagttttcagatcaatgttatcctctgcttgcatttacctgtgctgcatggcaaaaggctgctttatgttacttatctgagtcatgactgaaatgtcagtgcaaaattaaattgataaagattgaaaagagaataacttagattagtgttcatcatctttgtgtctcttgtttcatgcatcctttaccttgactctgcggagctcttactgattttgaacatagatgaatttgattttgtccagaattaaaaaatcaaacagtcatagagtatagctacttgttcagactgtttttaatttttatttttatttaaaatgttcactatattgccaaatagtaattactttattaagcccacttatggattcattttatttttttggtgaagcaaactaaaggttaaaagtgaacataagacaatttctacattaagtagcataattattcattagatcttaaaattaaagctactgctaatgtaacctttaggatatgaagctaggctttagaattatgtttgtgtgttgatacacacacactcaatggggactattcatttcacaaaccaaatatatgttatttctattcttgttggaatttagttttaaaaaaaattttttttctgatttccaaagaaatgcatgttcaccatagaaaatttaaagaatacaaacaggaattaaaagactacctatataaaattatatgtatgatatattcacacacatataggtaaaagcattttgtaatttactttgtagaaatttctatgtcaaattttaacacaaaacattatatcaaaactaccaatatgttataacctaataaaagagctgccagtaatttaagttcttacatagtaagttacctaatattatgaaatatacacgactcctttttacatattttgtttccagacatcaataacctagactcatgaatatcatttttgcacataatagttatggataggagactaaagattgtattagatgttggtgtttgattatttactaggctttgtcaccactgaaatgacttctcacccactgtttttaacaaccttgctggtggaatttgtgtcctaataaatttataaattatgacatgccaggggcctcaatactagaaacattaaatgcatgaatggcgaggatgtctataaagtaataggatatattttttaacacatctgtcagtactcatactttcaagcaagtgttttcgtcaacataggttaagagcttaccaactgtttccataattgatgaatgtgtttccatgaatctatttattcatcaatatcaactgagagtactctgtgtcttggcattttcataggcactgtggacataataatgaatgacacaggtagtccgcagtctaaggatgggggcagatgatagcctttgcaatacaggaactaagctgtaagtggaaggtggtacaagacaatgtgggatcttacccactccagtcccaggggtcgggtcacatgtgaaaacaacatgattcctatgctcagtcttggccattggaattccagggcatggctaaacagttgagaaggtaccttaatcaggattgtatcatagtcccagaaaaaggagagagctgttttggaattgccttcaaaggtttagggtattttgttgaatagcctatagggaagtaaatgataacatttgatgtaatttgtattctttttctctaagctaaagtctaacgtaataccggctgctaggtcagtgtagtattagtcacactgaccttttaatagctccagggttttaacagagggacaggcatgcagtagatgctcaatggatgcttatcaataactgactacaagacagctaacaaaatgattgaagcacaactggaaaattctagtctaaaaccagatagatgtgagtgctgagacagatttgcttgtatagcttgctagttgattatattgcttccaggaactctcctgcagtaagagactcatttgaacaagttagggcaggttgccaatccgagtattggcagcctgaatatgccttgactattcaagttgagtacttcgacgagggctataagcatttggattttaacgttctgatacactttaaatcaaacaattaaatatacctgtatgtaaatatatgtatgtaaatatatgtatgtaaacatgtgtgtaaatatatgtatgtaaatatatgtaaatatatgtatgcaaatatatgtatgtaaatatatgtgtatgtaaatatatatatatatatatatatatatatatatatattgttcactttaaaattactcagtttgcaagtgtgttgatacctttacatatgtacacacattcacagactgcaggtttaattgatgtgacttaagtcagcatttgcttttcttgattcatgcagattacctggttcaaatccagactctaccgtctatggctatgttaccttgggaaggttacttaacctctctgtgcctcagtttctttcttttcaaaattttttttattttcaatttttgtgggtacatagtaggcatatatatttatggggtacctgagatgttttcatacaggcatgtaatgtgtaataagtacaccaggaaaaatggggtatccatcccctcaagcacttatccattgagttgcaaacaatccaattacactctttattttaaaacgtatggttattattgactgtagtcaccctcttgtgccatcaaatattaggtcttattcattatcttgttttgtacccattaactacccccacctatctcccaccccacccccgctaatcttcccagcctctggtaaccgtccttctactctctatctccatgaattcaattgctttgatttttagatccacaaataagtgagaacatgtgatgtttctgtgcctgacttatttcacttaatataattatctccatttccatccatgttgttgcatataactggatctcattcttttttatggctgaacagtactccattgtgtatatgtaccacattttctttatccattcatcggttggtgttggtggacacttaggtacttccaaatgttaggtattgtaaatagtgctgcaacatacatgggagtgcagatatgtttttgatatactgatttcctttcttttgggtatatacccagtagtgggattgctggatcatgcagtagcccaaattttagtttttttagaaacctccgaactgttcctcatagtggtggtgctaatttacattcctgccgatagtgtacaagcgttcccttttctccacatcctcaccagcatttcttattgcctgttttttggatataagctattttaattggtgtgagatgatatctaattgtagttttaatttgcatttctctgatgatcagtgatgttgagcaccttttcatatgcctgtttgccatttgtatatcttcttttgggaaatgtctatttgaattttttgcccaccttttgattggattattagattttttttctagagagttatttgagctccttatctattctggttattaatctattgtcagatggatagtttgcaggtattttctcccattctgtgggttgtctcttcactttgttgattgtatcctttgctatgcagaaggttttaaacttgatgtggtcccatttgttcatttttgcttttttgcctgtgcttgtggggtattgctcaaaaaatttttgcccagaccattgtcctggagacaattcctcaacgttttcttgtagtagtttcacgatttgaggtcttaggtttaagtgtttaatccattttgatttgatttttatatatggtgagagatagggatctagttttattcttctaaatatggatatccagttttcccagcaacatttattgaagagactgtcttttccccagtgtatatgcttggcacctttgtcaaaaatgagttcactctaggtgtatggatttgtttctgggttctctattctgttccactggtctgtgtgtctgcttttatgccagtaccatgctgtttgggttaccatagctgtgtagtataatttgaagtcaagtaatgtgattcctccagctttgttctttttgcttactatagctttggctatgctgggtcttttgtggttccatataaattgtaggattgttttttctatttttgagaagaatgtcattggcatattggtaggaattgcactgaatctgtaggttgctttgggtagtatggacttcttaacaatattgattcttccaacccgtatacatggaatatttttccattttttcgtgtcctgttcagtttctttcatcagtgttttatagtttttattacagagatctttcacttctttcattaattcctaggtattatattttatgtgtggctattttaaattggattacttcttaaatttctttttcgccttgttcactgttggcatatagaaatgctactgagttttgtaggttgattttgtatcctgcaactttactgaatttgtttatcagttctaatagttcttttgtacagtctttaggtttttctaaatataagtttatatcatctgcaaataaggataatttgacatcttcctttccaatttggatgcccattgtatctttctcttgtctgattgctctagctaggacttccagtattatgttgaattaacggttgtgacagtggtctgattttcttttctgctctaatagaacagcactgagttaagtgctactgctgtggggcgtggggtgagtggcattggtgattcaggactgtttttttctctctttagtgcctctttcagtgatatgaagttaaaaccaggccctatgagtgctcatctgatatttagttcttatgaaggtgtttttttctgtgtaaatatttgttaacttggtgtccttgctgggggacaatctgtagagctttctgttctgccctcttgttctaccttgtggagtcctgataagtaagcaacaacaaggaaggggctccaggtcggggaggttcccagattggggagggcccctagtgagagtgagcaatgaatttgtattgagagacagccaatcacaaacaacccactgacacaactacctccctgcgcacataaccccaacagcatgacctcattccactggtagccccctccagcacaaccctgtaagacttccctccaccccctgcctcttggcagacagccccttttctgctgtgctgcctgttgcacccttgtaatgtattttcatactttctctaataaatctgcctttctttacctacagctgtcttggtaaattcctttacctcacgcaacactggccccagcctattgcacccgcgacgtgcctccctcagtttcttaatctatggactgtggataatgattatgcctaaattatagaatgtttatgaggctaaatgacctaatatacgtaaggagcacgggatactatttgtcaagtgttcagaacagttgaactattgtattgttatcctaaatcatgacaagattaacattaaaaacatttaacttagtagatcagagtaatcaataaaatgtgtgttaagaggataatgattatacttaaactttaaaatgtatctaaggctaaatgagttaatatatgcaaagagtatagactactgtttgtcacacagcaactattttgttaaccttaaaaatatttatattaaaaacatttagattaccagatcaaactaatattttgaaatactttactatttttatttagcatgaagctttttgattatctttaatgttttaaatatgttgaaaaataaaaattactaaaacaagaatgaaattcaatggttaacatgagcagtaatttagaacaccttttctctccccagatgaaaaatgtatcttcaagtaatccaattccttggaactaaatacattttgaaattctaattcactttcctataatttatagatctaacattattaaaatattcatatctttgagctaatgtggcttaacaaatttaatttgcaaaacaaagatgacatgaaaagagcatgatccataatcacttttttcctaagccatatgtggtaggcacgccattaaaaagacaagctagtcaaccttataactccatagaactgtcaaaataaataagctattagaaaaccaggaaaataacagaattttggaacaaagtgtttccctagaattttttttcattatttctcaaataagcagagtacaaccttggatagggttgtttaagatgtgtggagatgtttgaggctgttattttgcacctggggggcttttgaccacggtgcagtctgaaacctgtaaagggaagtgggagtggaggaagattggataggaagatcctcaggtgtcattgtgtctccgaggaaggttcagccagcccaggggtctccagtgcgaaaatcattcatagggtagcaacacagaagacagaaatgggcataccctactgtttggtcaccatactccaccttggctaggagctcccacaagaagagtgtgacttccacataaacacagcagctgatcttgaggcattgcagctggaggctaccagccagctgtagtccctgaagctagtaaatgacctcttttccaaagggagcttctggtggcacatctccaaggctgccagtcacctatgtttctaaatccattcgagtatctgtatagagtctgttcctgtgctataaatgccaaggattgccagagttcggtattgctacatttctgggtgtttgtttctctacattgtcttacttgaagactgttcatgtgtggtttgttttatttaagagtgtgtgggagggggggtaaagacaagcacaaagggcttcattgtaattaagcttgtttagttgaagggacacttattgatattgtttggctttgtgtccccatgcaaatctcatgtcaaattgtaatccccaggtattaagggagggacctggtgggaggtgattggatcatgggggtggttccctgcatgctgttctcatgatagtgagtgagttcttaagagatctgatggttttataaggggcttttcccgcttcaccctctttctctttcccaccaccttgtgaagaaggtacttgcttctccttctccttttgctgtgattgtaagtttcctgaggcctccccagccatgcagagccgtgagtcaattaaaccttttctttttaaattacccagtcttgagtatttcttttttttcctttttcttttctttttcttttctttttttttttggagacagagtcttgctctgttacccaggctggaatgcagtggtgtgatctcggctcactgtaacctccgcctcctgggttcaagcaattctcatgcctcagcctctcaagtaactgggactacaggtgtatgccaccatgcctggctaatttttgtatttttagtagagatggggttttgccatgttggtcaggctggtctcgaactcctggactcaggtgatctgcccaccttggcctcccgaagtgctgggatttcaggcatcaggtacttatagcagtgtgaaaatggactaatacacttattctgcctataatactgtcttagtctgttcaaactgctataacaaaataccataaactaggtagcttataaacaacagaaatgtatttttttttttttttttggagctttggaggctggaagtccaagattaaggagccaacagatttggtgtctggtgagggcctgttgcttggttccgagacagcactttcttgctgtgtcctcacatggtagatggggcaagagagctctctgaggtcccttttataaggacattcatgccatttgtgaggcccaatcctcattacctcatcacctcccaaagaccccatcaccttggtagtgaggatttcaacataggaatttagaaggagtagggacacaaacattcagaccatagcaaacagggattatattatgagttctaatagtagtagtaatgatagtagtatggtaattacagtggtaaaaggaaggagaaagagtggaggaagagtagtaatagcactaatagcagtgattgctaatatttattggacatagtacaaagacatttcatgtaatacctcatgaaatactggcatcactgtgaagcaaggattaatattattgtgactttagagataatgtttaggttaaatgacttgaaccaatctattgagctaataaagagacagaagtagaattcaaacccatacaggaagagggccaggcaccttctcttatctgccaccatttagaatcaagacatgggcttgattattccatttgctctttgtataacttaaatctgtatatttacactttgtaagcaatgatttcctctcctacaaaaaattgataataataaaccaacctgactttctcacagggttaaggttagaacttaaaaaaaaaaaaaggatgacactgagaaagtgtttttgcaaactgcaaaccacttttgcagtaaactgcaagccacttttgcagtaaactgcaagccacttttgcagtaaactgcaaactcttcctaaatgaatattggttattatcttactggtattcagtagttatgtgttctagatatgagaatagtttgcagttacacaactttgccaatagcaagtgccataaatttatgctcagaaattatgatccctgaatttgaaagccagaaaaggttttagagatgatccagttcagtgtgtgtgtgtgtgtgtgtgcatgtattctcccaagatgattctaatgtatagtcgggggacaaaaatgactgaattggaccaacacacttctttctgataattacgataactgtatatttacctagggcagttacagttgacacttgttgctcagtgtcccatctgatggtcctgccctctttcactctcaggtgtcacagtttggatgataaattgtgtagtccctctgctgataaggaactgagacttagagaagctgtttcccttctaaaaaggaactaaatatagtgtctgacctgggctttcagagactcccttggagtcatgttgaacaccatgtgggtatgcaggctgcttcttggtattcttaaagtgagagaacttcttaatttttctgtgacaataaaactgttaaaaatagaaatatgctgtgtttccctgtcactcaactaagtaatgcaatactgaggtctgttatctgacccaattcctttatgaggacatttgattattgcttacagttgctggaaaaatcttctcatgcatgccatcaattgttctttaggaaattctgtttagaaaacaaatcaagagctttatcaactgccttgacactggttttctgaatatcatcatgcatagcaatgtggatcctgctgtatgtgacatgtctaatgatgacatttaatgaaacctctaatcaaaagacttgaacacgcaatttggacgtggtgatgcagtcttcttggttgagattttgcagccaatgtcaaatttaattttagcatttaggtcatcataatccattatgtgcatttctcagaataatgaagatacttttaagctagtataaaggaagtttgtattctgttcgcatcaaaatctattgatatgggcacatttctagagtaatagttaagtgtttcttttcatcattgggcatattgttccagtttgacccaatcagaaatgtagatcttgaaaagtgaaggtttgcctccagaggtgttgccattgaaacccatcagaatgaaactaaggacagaataagttcttttcatccagcattaatgacttcacctacttggggaatccagggattgtatgatattccaaggatccaatgtgcatcaccctggtggagactagagtattcacccgtcttgctcatcgacgattgtgggtgaaagtcagaaactgattgagtagcagagattctttctattacaaagtctcaagaaagcctttgcaaactacgctgggacttcctttgatgtaaacagttccatagcctcactgtgaatgttgggaactgtgttatagctgtgcatatgtggcccctcaacaaactcttgttatttgccaagtgtattttctaacattgagatttagagtctgggaaatctatattcttataattacctaatttaaaaaagaaagatcaacagatttccctagacacagaggaaatgggacacttgaaagtgtttttcctggttcattcaagccttgttgagtgcttcttctctgtattcctagtgcagtatgcacatccctttatcgtgattcatagcacattgtactgtaattatttgtttgtgagtctttctctattactagactggagagcagaaatcaggtcagacgtatttgcatcccccgcacttagcaacaaaattggaacacaatggatattcaaaaactttgagtgaattaataactgcccacaaaatgaagagcaccttgagtatccagtcaagccgtgtgacctcggagtccttccacacacactcagggagctataatatttaagctgaagccaaaatggtaaaatgaaatttcctatgaatgagacagttaaactcactcaatgtctagagagaatcaccatcttactatacctgcttggaagagcaagggaagtaagaaaggcttaccaaaatctgtttttgctcaaatggaacaatttaatttaataactcttctgaggatgctgaaacagtcatgcccatcaaaattcattttgagttaatccaatctgtgtggaatgtctttcaacctggaaatgcccaaagcttcattgataccctttctagaacaatgttattatgagatcaaccgaggatgacctaatgggaagattttaagaaagcctagaaaattctgactcactatgtgagtgaaaatcactgcacatatcagaaacaaggctggacacagtggctcgcacctataatcccaacacttggaagctgaggcaggcggattgcttgagcccaggagtttgagaccagcttgagcaacatgatgaaagcctgtctctaccaagaaaaaaatacaaacattggccaggctgtggtggcacgagcctgtagtcccagctactcaggagggtgaggtgggaggattgcttgaacccgggaggggaggcagaggttgcagtgaccgaagacgacaccactgcagtctatcctgacggagtgagaccggtctctgtctcaaaaaaagaaacaaaagtgagttactaatcctactatcacctgcctcatcagtgacagccctttctaaagaggtggttcagctgtcaactccaaaatgtaagagctctgagtctgttagactttccatgtgtttttcttacataaaggtgccacctttgagccactgcatcccctacatggtaaagaaaaaatttaaaaaagtatagagagttggattcctgaacagaaagctgctttttgtaatgtcaagcagttactgatttccaagcgtgtattcaagagtataaaccagctggctgagttcagttgtgcctatccataaaatgccagatggccccgagacaccagttttgcttactaatcaaaagcgatgtcatgtatataccagtataatgtgtaggttgataaagttatgcaattctcgtgggagtaggggagttttataaccgaaccagtttctacaccttcacaatttgtaatgtttacaggctgctttgggaatttttctccaagtataaatcaatccctttaatctcgttaccatctatacatcactgaggtattttgctctgtgcttttgccagtttgcaggatgatgggaactcttccttctggatgccaaaccagcatatgtaaggagctgctgggcaacctcagactactggaagccccctcacagtctctaatccccgacccaccaacattacaaaataacagggatttggaactgtattgctgtccagaaaacagatttagagaaaaatttccctgaaattagccctagcagaggtggcagagttgactaattcatctctcctttcttcgagtgtcctttgtttgcctgtttgcttgggaagggtagttgatgtttactgctaaccactatctgccttaaagaaatcctgcaaaataattaacttcacaatttactgatgacagaaactatttcatgtgacttggataaaagtgattatgtttctgtttttctaaaaacacaggagagatgttaaattataataaccttggacagcagtattacttttaacaggaatatattatacataagctgcagtgaaagaataattacctcatatgttcatatgaatattgtttgtctcatttctatgtgtcagttcttcatttttttaatctaatgaaatcaggtattttagaactaggagacagtagttctaattttcaggacagacatttctgaagattatgaaaaaaataatatttttgtctttttcataagcaattgaattacttttcccaggaataaaaccttttttccataaaatctgcaccctatagtcgtgatagtattaattccagttttcaaaatgatgaggaaatcagcatactcaattaatttctaaaggtgttactattagaactttctgccactgtattaattctaactgtgtgaactctttctgcagtggaggttagcttccatttttaaaatagctcgataagagatctagggtgaatgcaagacccagaaatccatttatattttcagccttttaatacagttgtagtagagagatgcagcttctcagtcctagagaactaactgtaaatgacccagaatacttgtgtctgtgtctgcttcatgctctttcttgcaataatcatgaatatccttttgtattttatagacctgcctgctctgcttagtttaagttttcagacagtgcctaataaaactttttgcagtatttggtgactcactggggctactggcttgtccttgtccaaactgtcaggaaaccatcagtgcctcttcagatcagagtgtttctgcccatactccatgcaggtgatggcagttcctgtctgaggtggagtctgactggattgccacccttgtctgggcaggtgatctatctgctctgaaatctcatgaagcccaacatcctaaggagagcaaaattctgtaactgcaaacacagcttcttatctctcaaatatatccagatatttatgttaagctgcaaggaatctccatcagttaaaactagcaattacattccaatgtaacatgactgatgatttcaagagattagggccttacttgattgcatctaaatgcaacttaattctcttcttgttcaaatatcctgtgttctctatcttggtttattgcatagttcctttgcagaaattctgactcaaagcccttatttaatgtgttattttgtgaagccactctgtatcctaggtccagacccctttctgtatgctggcatagggcagttatctacaagatgccctaccttgcaggcacttatttgaactgatactccagaatccactagaacccatatttctctctttttatccaaatgtgtggagttttaataattttctaagtacccactatgtggcaggtatacacactagacagcattttatcatttaatctacccaagagcctgagtgaaagatgggcagtcatttgatccccattttaagatcagacacttaaagtttactgaagttaaattaatttcttaaggtgacatagctagtgattcgaccaaccagaatcaaagatctgtatgattccaaagtcaatacccttcacatccacgatgtctcctggttaagagctttgcttccatcacttactttctaccaggtctaatgaggtctgattggctggggcacccggccacattttcagcagcagcacccagtgcctctctctctgagtgtcctacgtttcagtcagggttgtgttctttcatgcattccttatatgcacacacagctccctgtgtttttctgccagtttccctctgccctgaccattttgctaactcctcctcacctgcatcacccacttaagcattacgtactgtctatgactttcttgacttccctcctggcttcatcattctaagctctgtggcatccctccatatattgaattgtggtgacttcgggtgtgtatctctctgttctactatgaattccttaaaaacagtatcaggttttaatcatctttgtgttctcaagatctcatacagtggtaagaccataataatgatggaatatatacttacttatttcatttgaattaacatttcctgccactttgctcctacagccctgttctgactctgatttttagtcacattaccacaggatcttaccagctgggagcatgcttccactatatcttctccactctcttaaaatggacccatcaacatctcatcccttctggcgtggggtgtgggcatgttgtgaacaatctgacctcaaactcttgttcatctgattttccttgtctagaaactcttgtcctcctgcttcacccacctccatcaaattccacatgtcctacttttacatccatgtctaccttgacctcatgtttgccttgtgcttcccttgaatggttctcagtgatgcttatgactgcatggttagtttacttgcatggatgtaaggccttattatacttgactttctgctttcccagagggatacaggagctttaagaacagaaacacctgtgtgtttttcacctcttggtggaagtctttatgaggaataattatattccccatgccactcctcaataagtcccaataactgtgtattcagcacctgatgagttattgtcagatctctataattcatcctctctccttctctccatctctgagtctctttctcttcatctctgtatatctctgtctccccttctgtctctttatctctcttcccccattcattcttctctgtttcttcatttttcattttaaatgttgatcttacaccttcaagttaagagaaatgaggaggaggaggagcaggaggcattgctgagcacttgtgagaagagctccttttttatgcccctccctgactctagcactgctgagaccagctcggctggggagaccctaacccagcggcactagaggaattaaagacacacacacagaaatatagaggtgtgaagtgggaaatcagaggtctcacagccttcagagctgagagccccgaacagagatttacccacttattaacagcaaaccagtcattagcatcgtttctatagatgttaaattaactaaaagtatcccttatgggaaacgaagggatggaccgaattaaaggaataggttgggctagttaactgcagcaggaacatgtccttaaggcacagattgctcatgctattgtttgtggcttaagaatgcctttaagcagttttccccaccctgggtggaccaggtgttccttgccctcattcctgtaaacccacaaccttccagcttgggtgttagggccattatgaacatgttatggtgctgcagagattttgtttatggccagttttggggccagtttatggccagattttgggggtcttgctcccaacatagcactatctctcttcacctgccaccctcccatatgtcaagtgcctaatcaacctatattctcaatttgcaaggatcataagttttcttgtgcctctctgcctttgcacaaactcttcacctcactgagtatgccctcatattagtctgttctcacatttctgataaagacatacctgagactggtaatttataaagaaaaagacatttaattgactcacacacagttccatgtggctggggaggcctcacaatcatgatggaaggtgaaaggcatgtcttacatggtggcaggcaagagagaataagacccaagtgaaagagaaaccccttataaaaccatcagatctgatgagacttattcactaccacgagaacagtatggaggaaactgcccccatgattcagttatctcccactgggtccctcctacaacatgtgggaattatcggagctacaattcaagatgtgatttggatggggatccagtcaaagcatatcactctcccttctcccctgtgttgtttgtttgcctggaatctccctactggtcctttggaccagcgaaatttctctttatttgagttggcatttcaacttatgtccttcctacataagggagaaatagaagtcttcttgatactctattataatgcttatcaattggttcattactggttattttcatatacatgatatttatgtaagtcactgctgatttacatacatgaacctgcccagattttggattttatcttgttcctccttgtgtcttaatagtatgcagtgtacctggtacatcctaaccacaaaataatgactgaaagcacttccactgcaggcagacttcagggacttgactatgtattcagccttgggcttcctttgattcaaaagaaggggactttccttcatgaacaataagcacagacattagtatcaataatttttattttaataattgagttgattatttttaaaatacatcctatttttataagcttgtcatatcttgtaaacaagctagtggctctcatccagactatcatgagagcactgctaattttctttaggtgtgctttgaaagcatttcattaggatggagttatactgctctttcaaaagcaagtattatgaatgtggagtgctgtggagggtcctgttctgaggagtttcagagggccatggtttagtggaatcagattaggctagttttggggcaactgaagttggaatctcagttttgtctttaacctgatgtataacctggtcatgtcccttgaatgtatagttccctcgtttgtataatatactatcttatgccagaattttacaagaaataatttgaaaatgcttaagcataaagcagaatagaaacataagggtttaatattgggaggcggaggttgcagtgagccaagatcatgccactgcactgcagcctgggcaacagagcaagactccgtctcaaaacaaaacaaagaaacataagagtttaataatattgagttacttaaatttatttcactgtattttcctatatatatatatatatacctcttcttattattattgtgatcttatttttgtttcttcttcctatttcttttcaccacctcctcctcttcccttttttctcttcctcttctccttcttctttctctcttcctccttcttctccttgtccttctcttatttctttttctttctttcctcttcttcctacttctcttctccatcttcttttttttctccttttccttctcctcctcctcttcctcctcctcttgtcatttaaggtgatgccttctattgacctgtgctcccttggataggaggtttttgttcgacagctcagtaggatgctccctgcagtgaagaacttcaggaatttttgtttgaatacatttttctctagaaaggaaaaacaaaagatagaaggcaaacagtattgatggggcaactgtacgtcccagacactgttcctgctgctttccacagtgattcattcgattctgtcaatagtccttacggtagacacaaccagtttccttttataggaagttatataaccagccagtgatgggacagggtttcccctatgcctgtaaaaccaatagcctgtgcaaaagactttaatacatgcctttgatacacttaaccatagagaggtactcagagagtagtttgggggtcctagttaaagaaaacaaaataagacagaactcagtctgcacttctaacatctgtacttgggatctataccaatatatgtcctagacgcacccctggctctgctgtataatattgggtcccagtaatttgttctggctctccatgttgccacccctgataagcttagtatttagttaaaagaaaattcctactgagaaaagtattactgacagtgggtctactattttgtgttctttcatttctaatatctttgttttattttgactattttcatgtgaaatattcttctaaagtaaaatatttaatttccttgaagataattctttacaaggaaatgctgttttctttggggccttttttctattactttaccttgctgttgctttgtaatttatttacagttctgttctttgtttgagaacattgctttgccatatgtttatgactttgtttttcctgcagatggcttttttcccttctgtttaatttctctgagacagtcgtgtcctatatattttcacatgcacctcattgttttttcatggcacttcataaaccatgattcatgtcacactgagcagaatcactacatgaattttctaaatctgttacttgcatcacaaatgtgtgtatccacttgggaattctgtggaatgtctgatattgataaggttggttgacacttcaacaacactgcttttcaatttttttccctaaatgtttacaaaaactcataaaaaacaatcatgcatagcataatatatttttatttttctccttaaaaagattgtctcgtctattggatgtgacatgtaccctcgtgagtcagttccctacgtttaggtcttctacagcatttgttttgaaaacaaaatctacagattttcaaagatatttagttgggaaataaagcagagatattgtgaaaatatgaggattttagctattgcagatactcagctacaaagagtagtggttctaaattttaccactttgctgatgccctgtttttctctgacttcaaactttgtccgtgcacctcattcttccctaagggcagtcaataaagtgggcaactttgaaaaagtatttgcttttcagctaggagatgggaaatacacacacatgcacatgcatgcacatatacatatacatgcacatatgcacacacatatccacagatgaatgtgtctgtgtatatacaaacatatatgtaggatggtaatgcatggtttggctgcaacttgactaatttagttgacagtaggatctgtgcagaagcgaagaggaacagaagagcagaaaagtgaagaagcctctatcatcccagtttttggctaatttgagggcaggaccgagcatgaacctagggtgtggggcagtgggtaaaagggctttttggtagccacagtggatagaagttgccattgaagtttagagatttctatcaaggtttaggcagtagaatagaaatcaagtccctctgggaggtgggaagaatgctagcaggatgagtccccatggtttcgttgccagagccatctagcctgaaatttgggcttatttcctatttccaataaggaactaagttggaaagcagaaattaaggcagagcacggcaggaggacccaattgtaagtggcccatagctcagcagtttctgaactttcttgctatcaaggcaatgcatgttcactgagaaaaacacatttctaaacagataatgaaatggaaaataacactcaagtaattatcaagatttacattcaagttttattttttcatttattagagacaagtggacattttctctttggggtaatttatagatgtgccatgtcagaaaatcagggttgtgtaccattgagggagagctacaggatgcggatggactcagaccaggggaccagcgcaacatcagctaaagtgtttggactgggcttgtgagcagcaggagacatgtcacatgcatgaggaaggtggggatgaggagagctgaactggtaaaatgttaattgtgtgtggaggtgtcaaggattgtgtgaagcaaaagtacagggagctgacaagttagctggtagtttgggtcagggagagttaagagcacctgaactagaaaggtgaaggtggacatgaagagaagagaaggatttgagagctctcaggaagtagaatgcaggtaacgtggcacctgatgagagctgttgggtgaagaaggacagacattgcgagaaatgaagttctgtgtcccattgaccaaaatgagtggaagctgacagttctcacatggatttggctgggaggcaatcataggcctcagtgttggacattcaggggaatggagaagacatgggaataggctgtggcaggctaaggaactgacttcattttggaaatggcttcaaggaaggtggcccataatatattcctattgttcatacaggtaccatcatttatttcatttctacctactccttatgatcaaaaatcaaggcacaatgtcaaaataatgacctggttaatgagatctatattttcacagcttttcagattcctttgccatctttcttgggttcagcattcttagagcagtgttcaaaagtctcaggttggtaattccagttcatcagggaaagctgacgttacatccacagtccagtccaagaaagatgctagagttgaaagctattataagagagtcagaaaatgtcaagaggaaaagatcaatgtgcttaagtacaacattaagatacattctgcatggtgtttccaagcagctcttggaagtaacagatggcttctgtaagggaatgatataagaaaagtacctaagtcattttcacctttggcatgcggggatttttgagtcactaaatataaattctgttacactatgacagattataatctctaacatcaagcatgatgctagaagggaatttgaaagaaggtcctccatttcaactcttctatttttaaatcctaactgtaccttttacgacaggatttcaaaggaacttcttaattcaacctggtctgttatacaaggcgcattgagagagtcatcccccggttctgtggggcaatgtagaaaaggggtagatcctgaaataacagtgctcgtttgttgggtgttttatgctcagattacacacaacactaccctgacaactcattcacctcagccttctccgtcttgcattatgtttataatatctttagttaggcaagcgtggtaaatagcctaaatttctaaagtctctgtaggtgaagatgaaaaaattggtaactggttataaagtagattgcaaatataatcaagtacaaaatcattacatcaagtccttatgcttttagcattcaaatataagtgaactagccatcatttttgaagttaattccaataaacattttatgaattttaaaaatggtagaaaaacgggtacaatgatggagataatttgtctcatgcattttccacaagagaaattttttgtaagttaatttttaaatgctttgtgaaagggcataaaattttgaattagaagtcttgtgtttgtattctgggtctaccatttaactctcattcacagaaagttcattttcatgtaggaccttcagctaaatcatctgtaaagaggaactgctaatataaacccttctgttgagccttgcagatagctaatgtgtgtgaaagaatgtagtcagctgcagagctcagtgcaaatttacagatgtcataaaagtatatagtcattgccttaaatagcaatatatatacatttttcttttaaaactttattcatgagaaattaagtactccatgagtagtaattctaactccttgaatagtaaaactgaatgcacttttcctgtaatacgccgtttgatatcaagacaataatgtttaagactttcctaggtttaatggatagtggagattagagctctttttaaaaatgatcaaatttgtcctagaatagaaagacactgcagtcaaatcactattcagtttgcttgtcttattccaactttctaagctatttcctagagaatcattgaatatttgccacctcttttgaaattcacaaatgatatttaggaaagaattttcattttagaaagataaatggtaagcagcattgaatgagtacatctggtgtgcagaatatctagataatgctatatgacaggaggtctgatgtggctgaaaatgagaataatagagaattttcaacactagataatgcgttgacctccccacccaccttcaattaatttgaatcagctgatttatctaaggacctagggacactgggggcaggacaggaagcctcagttagggccaacaattgcaatacatagacacgtgtgtggtggctttcagggcaggagtcaaggagggagaagataccttcaagagccaaatccccacagtgggaggtgtatcccctgaagacacactcatcctacaagaaggaagaactcagcaacactgtaggagttttttaagggaaacacaggtttacccactatcctggcttttagaagaactcagggagtaagagataaaacagctatttctggtgctaacagccagtaggaagcaattgttccttctctcctaggtgatagccagtctgcctgtggtgtgtagaattgtggttgattctcttacgccatgaaagatgaggacgtctctgggccgctgcagttgctacagcctttcccaggcatttcctgttctacaaaattgtaattttcctgactttgaaagcggtttggagttaagatttcttgatatacagtggaaatcgtgctggatgataaaaatccctcttctggaggaagagtcagatattagaagacccagggaaaaatgaccaggatcatttagcattgcttgaatcatttccactgctttctgtattgaaggaaagattgggggatagaggagataggaatcatggcattgcttctctttgcctttcctttggtcagcccctattccttgattctgtctcatgttcccattttaaaggtaagcaatattggttgcctgaggatagtttgtcctatcacaaaccttagataattaataatacatatgcagagagaatccattgcatgaaaggtgagactccagattcctgggaagccataaatcaatgagtaaatgtggcatcttttaccaaaaagctcaaaggaaaaacagagaaatcttactgggatgagaatgttcttctgaatgaatttaatattctcaaaggattttcttggaaggatggctagggaaagcatgccgcattgctggcacatgctcagaggcatggaagagatttaagaatcctaggagaagacaggactggattactgtaacataatactcattctgcaggccaggagctcatgcacatgcatcacgtgaaaaataaagactgtctcaaacacaagataaaacgttgccgagcatcctgggccatcttagaatttgcatgccctgggaatgattccctccagtttccatccagtgctgcgattctctgcttgaacctagcttcggcagaactttttcttacgcccagggtgtcagaattaagctcagggctgtgatgtttgtcttccaggaagtcactggcacatgcccactcttgatttgttttcagatttgtcactcggctgacttgcaagcctgtccatcagccagaaatcaggaagcctacaagtcacaactggatccattggtgaaacaaagctcagctgccagtctcagcagagaaagcatgttctgctcaggagtcacatttaattatgcagaatttatgcgttttatttttttgtaactcttgagtgttaaaccataaatgtgagctaatgaaagataatatatgtgaaatacctagcagggttaggcagagaggagacacaaaatgaaatccgtcttgttcgttcctcttgtacttctctctcccttactttacaagtagagtaataacttgttagaggtggttaattaatataaacttccaaaaaaagtatcaacacaaaatggtgcacatatatttgtgaacgaagatagataggaggatacgattagaaaaatgtaatctactgtcctcaaaaaagccaagatgaatgtccattggtacattttcttttttatttatttgtttatttaattatactttcagttctagggtacatgtgcacaacgtgcaggtttgttacatatgtatacattcgccatgttggtgtactgcacccatcaactcgtcatttacattaggtatatctcctaatgctatccctcccgcctccccccaccccatgacaggccccggtgtgtgatgttccccttcctgtgtccatgtgttctcattgttcaattcccacctatgagtgagaacatgcggtgtttgattttttgtccttgcgatagtttgctgagaatgatggtttccagcttcatccatgtccctacgaaggacatgaactcatccttttttatggctgcatagtattccatggtgtatatgtgccacattttcttaatccagtctatcattgatggacatttgggttggttccaagtctttgctattgtgaatagtgccacaatgaacatacatgtgcatgagtctttatagcagcatgatttataatcctttgggtatatacccagtaatgggatggctgggtcaaatggtatttctagttctagatccttgaagaatcaccacactgtcttccacaatggttgaactagtttacagtcccaccaacagtgtaaaagtgttcctatttctttgcatcctctccagcacctgttgtttcctgactttgtaatgattgccattctaactggtgtgagatggtatctcattgtggttttgatttgcatttctctgatggccagtggtgatgagcattttttcatgtgtcttttgtctgcataaatgtcttcttttgagaagtgtctgttcatatccttcgcccactttttgatgggtttgtttgttttttttcttgtaaatttgtttgagttctttgtagattctggatattagccctttgtgagatgagtagattgcaaaaattttctcccattctgtaggttgcctgttcactctgatgggtagtttcttttgctgtgcagaagctctttagtttaattagatccgatttgtcaattttggcttttgttgccattgcttttggtgttttagacatgaagtccttgcccatgcctatgtcctgaatggtattgcctaggttttcttctagggtttttatggttttaggtctaacatttaaatctttaatccatcttgaattaatttttgtataaggtataaggaagggatccagtttcagctttctacatatggctagccagttttcccagcaccacttattaaatcgggaatcctttccccatttcttgtttttgtcaggtttatcaaagatcagatggttgtagatgtgtggtattatttctgagggctctgttctgttccatcggtctatatctttgttttggtaccagtaccattctgttttggttactgtagccttgtagtatagtttgaagtcagatagcgtgatgcctccagctttgttctttttgcttaggattgtcttggcaatgtgggctcttttttggttccatatgaactttgaagtagttttttccaattctgagaagaaagtcattggtagcttgatggggatggcattgaatctataaattaccttgggcagtatggccattttcacgatattgattcttcctatccatgagcatagagtgttcttccatttgtttgtgtcctcttttatttcgttgagtagtggtttgtagttctccttgaagaggtccttcacatcccttgtaagttggattcctaggtattttattctctttgaagcaattgtgaatgggagttcactcatgatttggctgtttgtctgttattggtgtataagaatgcttgtgatttttgcacattgattttgtaccctgagactttgctgaagcaagtccttagagacctacaaagagacattgactcccacacaataataatgggagactttaacaccccactgtcaacgttagacagatcaacgagacagaaaattaaaaaggatatccaggaattgaactcggctctgcaccaagcggacctaatagacatctacagaactcttcaccccaaatcaacagaatatacattcttctcagcaccacatcacacttattccaaaattgaccacatagttggaagtaaaacactcctcagcaaatgtaaaagaacagaaattataacaaactgtctctcagaccacagtgcaatcaacctagaactcaggattaagaaacccactcaaaaccactcaactacatggaaactgaacaacctgctcctgaatgactactgggtacataatgaaatgaaggcagaaataaagacgttctttgaaaccaatgagaacaaagacacaacataccagaatctctgggacacatttaaagcagtgtgtagagggaaatttatagcactaaatgcccacaagaaaaagcaggaaagatctaaaattgacaccctaacatcacaattaaaagaactagagaagcaagagcaaacacatcggtacattttcatagtgggctaggttaagctatacaaaataacaagagccttctaattataagaatgtaacatgttttatagaagtataactcactgcccccactaatgctatagcaaaatctaacaactaatctcgtttcaaatataattttagaaatagcatctgaagtgcatgcagaacaagtaaggaaactaagatgatgcgttgaacatctaaacagctccacagccagtcggtaggttttggaattcaactctgacaactgcaccaatcctttaatcttcttcccattgtagattttccatgatcttattcagaatgtagaaactgtgctcccattgttagtatagaggaagaaatagataaataaacattataagctaaaaattcacacagtaaacagaagaccaacagaatgggagaaaatagctgcaagctatacctctgataaggaacttgtattagtccattttcatactgctgataaagacatacccaagactgggcagtttacaaaatggctggggaggcctcacaatcatggcagaaggtgaaaggcacatctcacatggctgcagacaagagaagagagcttgtgtagggaaactcccctttttaaaaccaccagatctcatgagacttattcactatcacgagaacagcatgggaaagacctgcccccgtgattcagttacctcccactgggttctacccacaacatgttggaattcaagatgagatttgggtggggacacagccaaaccatattagaactaatacctagagtttatagggaactcaaatccgcaagcaaaaaagcaaataatcccattaaattggacaaactacatgaacagacatttctcaaaagaagatatacaaatggccaagaaacataggaaaaaatgctcaacatcactaatcaccaaggaaatgaaaattaaaactacaatgacataccaccttaccccagccagaatggccgttattaaaaaatcaaaaaacaatagctgttggcatgaatgtggtggaaatgaaacacttatatgctggtggtagcagtgtaaatcagtatagcctctatggaaaacaatatagagatttctcagagaattaaatgtagatctactatttgatccagtgatcccactactaggtatctatacaaaggaaaagaggtcgttatataataaagaacccacatacatatgtttatcgtagcacagtgcacaattataaagatatgtaatcaacctaagtgcccaccaactgatgtgtggctaaagaaagtgtgttttatacacatacacacacacacaccatggaatactactcagccatgaaaaaagaatgaaataataccctttgcagcaacttggatggaattgcaagctattatcctaagtgaagtaactcgggaatggaaaagcaaataccacatgttctcacttacaagtgggggctaagctgtgactatgcaaaaacatacagagtagtacaatagacattggagactcagaagaggagagaatggtaggaggtaatgaaaaattacctgttaggtacaatgtatgctatttgggtgatggatgcactaaaagcctggacctcaccactgtacaattcattcatgtaaccagaaaccacttgtacccccaaagctattgaaatgaaaataaataatggaagcaaaatacagcatgcggcataaatgcacagagcatgtatgtgatgcatttatatgattttagccatatttgtatttatatgaacttttcaattgatggtttggcatatgagattaggaggcctttaaggagaatatacctggattttggagacgtgagttctgtacttcctgtgtactatgaaatttctggactcaaaccttttttgattttgcagtacacagcaaaatagaactgtcttttctgggcacatgacagaaattaaaaggagaaggggctaagttcaaaggaatataattaatgtcctaaaggggttaaaagcgtaaacttaatcattgcatcatcaggtgacctgtcagcatgagaacattgcttaatcttgtacaagttaccttcaggagaaagttggtaattcttccatgattagaattacttgtcaggttcactttaaaaatacgtaaatctgagtttttcccggtgacaaccagcccaatcaaagaaagcatgtgttaaatagaatgaaattgcattgtaagtcaataagcccaaattagaatagcactgtacaacttctctcggtgttgcgatcctaaagatttgttatacaagtgaagttagggacagatcgaaagacagagatcgcacatgttaaagaatggttgtgatggaggttactaaagagctagctatactgataaaatgcatcagattgtttaaacctaaaatatatggaaataaaaatgttggaaacaaacatctcagtgaagctttcttcaatggttttgtgtgactccatttaaacagagattactaaaaccactataaactagaaagtacagaatctctaggtaaaagctgaagaaagcactgaaagggcataattcacataaatcatgatctaggaccatcacttaaagaatgtaacagcattttcttatcacagggattcttgcccattgatgaacactgaagctttctgaagttgtaactgttctttccattctttctacccttttatcttggaatgcagccaaggatacttggcataatgtgttgcacagtgaccattccacaaattgtgaaactgactttacaaaaattatatcaatgagaaaattatgacagtgaaagagatctgagctcatccactccccatcttacctttcccttaattattcctgcattattggacctagctgatccatcaagggcagggtctgcaaaatatctcaagaattgatcttaggttttacaatagtggtgttatctccaggagcaatttggggaggttcagacacttgaagcaagaggttgcatgactcctaaacagtaatttataatcttaaagctactttgttagtcctacaaaggcagactggtccccagacaagaaggggtctatttgggtaagggccattatcaattttgtttcagagttaaatgagaaactaaatttcttcccaaggttagttcggcctatgtccaggaatgaacaaggacagcttaaaggttagaagcaggatggggccagttaggtctgatttctttcactgtcataatttcctcagttataatttttgcaaaagcagtttcaaatccacacttacttttatcagggaattttgtgaagtcttgttctatgatttcaaaatactgtgttagctttcgacagcttgggaacatacccattctataaattatggcaaactgtacttgctacggttttatattttattatatcacatgattatcatgacagtttgtggacttattttcctttcttttgagatttcttgttaggacttgggtcttttggaatgtcaatttcaatgatatttattgactgcttactaagcaggtattatgtagagcaactaaaataagcaagcatctaacttggaaagagcaaaatataaaccaaatgaagaaaatgcaataggaaaagggtgtaaaaatgcactaaatcttttcctgaactctacattcattgtccttatttttctttttcactgtttgtataatacagggtataattaattggaatttttgttttgttttgttttgtccccattccaattctgcccctgaaaccacctttgcaaaattatcactgagacagtgaaagagatctaacttaatcgactccatcttgcttccaaactccaagctgtccttgttcattcctgggctcagggtgaaccaactttgggagaaactcagtttatagtttaaactaaggatgataacaaccctttcccaaaggaggtctccttcttgcctggggtctagattgcctttgtaggactaacattagccacaagattagaaattgtttcttaggagtcatgcagctggaggctacaagattctgagcctccctaaactgctcctaagatcagtgcctgagatattttgcagaccctgcatgtgacagatcagctggcacctcccagatcagtaaactgggtcatctgatcctgtgcccctgacccagtaactgactcagtacaagaggacggcttcaactccctatgatgtcatccctcaccaattagagctcctggctcactggcttcaccccacccaccaagttctccttaaagactctgctcctggagtaataataaaactctgatctcctgcacagctggctctgtgtgaatttctctttctctattgcagttcccatcttgagagatcgactttgtctgggtagcaggcaaggtgaacctattgggagattacaaatttgggtgctcatctgagattgcccttatggctacttctgcccatggtttgataccagccttggtaaggtttcccttttaatgaaaagaagcccccaaataatttcttttctaacagagagcagcctgtaaaattgagctgcagacatagataaccaagctggaagcttacacgggtgaatgccggcagctgtgctaataggaaaaggctacctggaagctaggcatgtccaacatggtggctccatcttcccctttccttgccaaccacatgtgcagtagggagcagacaacatggcactcactagcccactagaaaacccatttgcataataaaaagattagcatggggcagccaggttctttgcgtgctatataaacatcacacctggtccaaccaatctttgagtcctatgtaagttagacaccgcctcctcaagtcagtcgtaaaaccccatgcacttcaccacaaaatcgaagacccacttgggtagcacccctctctctctgcaggaaagagagttattctgtttttctttcgcctattaaacctccactcttaaacttactcctcgggttgtccatgtcctttatttccctggcatgaggcaatgaacctctggtattacccagtgaaggatgccatttcagtatcacagagaagtttatcccttcaatggaaactgtgttatgtggactattagcaataataaatgggttactacctggtgaaaaaatatgttattttataatatcagactgccagtttttttctgtctttgctccatcttgaccttaagatgttcatcaactcatttttttcaagcaaagtacatgactgatggaactgccataataataatatttcactgaaatctggcattacaaaatttaagtgggtatttggaggtccatgcattgattacagtttttaaatttgaaataaataaccagcatcctttgaatatgaaaagctgtttccttttgacatttaatttaccctgtttaaaacgtgagatgtaaagcggtggttagtcagtgaactagaatttttgttgtagagtatccaggacttggaagagtatcatgaaagaattctttttggttggtgaagagtgtcaacttgaaaaataaatcgctgtgttccaaaataaaattgtgtcagagactgtaagtagtgcgtatttaatcttaataactcaagattgatgtaattactggaatattttatttgaagaaatgtgtatcacacttactaaatttcgttttttaaaacagctgcagcaagagtggcagttattcagttgtctctttaacctctgttattctgatgactgaaggaaaaacttgaacctatgttatgtgatataagcataatttgagctacactgaaccacatgacagtgctttgataatcttgtataaatcagtatatctcttctctcattagtctgtttgttaaatgccagaccttgtttctgtcatcttttgaatgaaaccaaggtagttctgtgagaaagcagcaattgcagaattatacacctggtgaattaaattttaacattaaagataatttagttttagatttggcctctgtggatctgtatcagttccaaaaatgtagaaagcacgggcatggtaaagtacatttttctgtaataaaaaaatacaaaacctattttatctgtgcattcttttgtatttattcattaggttaaagaggcaattccaaagaaagtatgacttcaaaaaattatatataatctatggccttaataaaattattaaaagcaccttaacatctgtgttcttgacaaaaaataaacaataaatgattaactgtgatggttaatactgagtgtcaacttgattggattgagggatacaaagtattagtcctgtgtgtgtctgtgtgggtgttgccaaaagagattaacatttgagtcagtgggctggggaaggcacatccacttttaatctggtgggcacaatctaatcagcttccatcgaatgtaaagcaggcagaaaaatgtgaaaaggcgagacaggcctggcctcccagcctacatctttctcctgtgctggatgcttcctgccctcgaacattggactccaagtttctcagttttgagactcggactggctctccttgctcctcagcttggagacagcctattatgggaccttgtgattttgtaagttaatgcttaataaagtcccctttgtgtgtgtgtgtgtgtgtgtgtgtgtgtgtatgtatatatattcacacacacacacatatatgtgaaagagctgaaattgtggaaaaacagacacaagctcttatcacgtgaggggctgaccttcaatgaaagatgcatgcacagcctcgccagatgtctactgttaaagtgagggcattgactggaaaagaatgggaccctgcaacttggaatggggacggtgagggaggaccctgatgaagctggggacactgagtttgtaaactccaatgaacctttttttgccagaaggaacagcttccccatcccctgtaatggcaacatcctttccctgacccatggctgccatcagcctttccacctttgtctgaggagataaaccctgtgctgcctgaggcaacagtgatggcctcccctgaggcagttgccagacaaaataatgttgattctcctcaggagccacccctaacacccctgtttgcttctagatctatcactaaagtcccagcaggcccctagaggtgaggttgagaatgtgacccatgaggaggtgcgctacactcgaaaagaaccatttgagttctataattgatataaacagaaattttggagaacaggcatgggaatagatattaagggtatgggataatggtggaaagaacatagagttggatcaggctgaatttattgatttgggcccactaagtagggactctgcttttaattttgcagctggggagttaaaaaaaggttctaatagtttatttgcttggttagctgaaatatagattcaaagatggtggtaaaggccaaatggaagccattagagctgctcctacctagaaaaatagtgaataaaaacagtatcccatccctggagggattgtggagattagtgtcaccatcaatgcaccttgaaagatgcagggatggtgattcccaccacatccccattcagctctcttatttggcctgtgcagaagacagatggatcttggagaatgacagtggattatcgtaagcttaaccaagtggtgatttcagttgcagctgctgtaccagatgtggtttcattgcttgagcaaattaacacatcttctggtaattggtatgcagccattgacttggcaaatgcctttttttccattcctgtccataaggcccactagaagcaatttgcctttagcagcaatatacctttactctcctaccttaggggtatatcacttctccagctttgtgtcataatctcgtttggagagaccttgattgctttttgcttccacaagacatcacactggtccattgcattgatgatattatgctgattggatccagtgaaaagaagtagcaaacacactggacttattggtgagacatttgcgtgccagaggatgggaaataaatccagcgaaaattaatggaccttctacctcagtaaaatttttagaggtccagtcgtttggggcctgtcaagatatttcttctaaggtaaaggataagttgctgcatttggcccattctacaaccaagaaagaggcacaacgcctagtgggcctatttggattttggaggaaacacatttttcatttgggtgtattattgtggttcatttattgagtgacctgaaaggctgccagttttgagtggggtccagaacaggagaaggctctgcaacaggtccaggctgctgtgcaagctgctctgccacttgggccatatgaccagcagatccaatggtgcttggggtgtcagtggcagatagggatgctgtttggagcctttggcaggcccccataggtgaatcacagtggaggcctctaggattttggagcaagtccctgccatcttctgcagataactactctccttttgagagacagctcttggcctgttactgggctttggtggaaacttaacctttacctatgggtcatcaagtcaccatacagcctgaactgcctttcataaactgggtgctttctgacccacctagccataaagtgcgtcgtgcacagcagcattccatcatcaaatggaagtggtatatacaagatcgggctcaagcaggtcctgaaggcacaagtaagttacctgaggaagtggctcaaatgcccattgtctccactcctgccaccctgccttctctcccccagcctgcaccgatggcctcatggggagttccctatgatcagttgacagaggaagaaaagactagggcccggttcacagatggttctgcacaatatgcaggcaccacccgaaagtagacagctcaagcactacagcccctttctaggacatccctgaaggacagtggtgaagggaaatcttcccagtgggcagaactttgagcagtgcacctggttgtgcactttgcatggacagagaaatggccagatgtgcgattatatactgattcatgggctgtagccagtggtttggctggatggtcagggactttggaagaagcatgattggaaaattggtgactaaaaaatttggggaagaggtatgtggatcgtcctctctgagtggtaaaaaacaagatatttgtatcccatgtgagtgctcaccaacaggtgaagtcagcagaggaggagttcagttgtcaagtaggtaggatgacccattctgtggacaccactcagcctctttcccgagccatccctgtcattgcccaatgggactatgaccataatggccatggtggcagggatggaggttacccatgggctcagcaacatgagcttccactcaccaaggctgacctggctacggccactgctgagtgcccaatttgccagcaacagagaccatcactgagccctcgatgtggcaccattcctcggggtgaccagctagccacctggtgttagattgattatattgtacctcttccatcatggaaagggcagaagtttgtcctcactggaatagacacttactccagatatgggtttgcctatcctgcatgcaatgcttctgccaaggctaccatctgtggactcatggaatgctttatccaccatcatggtgtttcacacagcattgcctttgaccaaggcactcactttgtggctaaagaagtgcagcattgggatcatgctcatggaattcactggtcttaccatgttccccttcatcctgaagcagctggattgatagagtggtggaatggccttttggagtctcaattacaatgccaactaggtgacaatactgcagggctggggcaaagttctccagaaggccgtgtatactctgaatcagcatccaatatatggtactgtttctcccatagccaggattcatgggtccaggaatcaaggagtggaagtggaggtgacaccactcacaatcacccctagtgatccactagcaaaattgttgcttcctcttcctgcgacattatgttctgctggcctagaggtcttagttccagagagaggaatgctgccaccaggagacacaacaacgatcccattaaactggaagttcagattgccaggacactttgggctccttctacctttaagtcaacaggctaagaagggagttacagtgttggctggggtgattgaccctgactattaagatgaaatcagtctactactccacaacggaggtcaggaagagtatgcatggactacaggagatccattagggcatctcttagtattaccatgccctctgattaaggtcaatgggaaacgacaacagcccaatccagacaggactacagatgacccaggcccttcaggaatgaaggtttgggtcactccaccaggaaaaaaactatgacctgctgaggtacttgctgaaggcaaagggaatacggaatgggtagtaaaagaagatagtcatcagtatcagctactaccacgtaaccagctgcagaaacaaggactgtaattgtcgtgagtatttcctcctttttttgttaaaaacatgtttgtatgcatgtgtacacttgttctaagaaaatatcttcattttttcccttttctttatcatgtggcataagatttattgacattatatcagcatttaagtattgttaactttatgtaatagtatttgggttggggattggtgtgtttccggttgtagaaagaatagttgtattatggtaggcataattatgacctcattattgtctttatttgaagattatgtatgatctcaggagatgtgtatgggttcaagttgacaaggggtggacttgtgatgattaatactgagtgtcaccttgattggagtgaaggatacaaagtattgatcttgggtgtgtctgtgtgggtgttgccaaaagagattaacattagagtcagtgggctggggaaagtagatccatccttaatctggtgggcacaatctaatcagcttctagtgaatataaagcaggcagaaaaacgcgaaaaggcaagacaggcctagcctcccagcctacatctttctcccgtgctggatgcttcttgctcttgaacattggactccaagttcttcagttttgggactcggactggctctccttgctcctcagcttgcagatggcctattatggcctcgtgataatgtaagttaatgcttaataagctcccctttgtgtgtgtgtgtgtgtgtgtgtgtgtgtgtgtatacacacacacatatatacgtacatatatatatatgtgtgtgtgtatatatatatatattagttctgtcactctaagagaaccctgactaatacaacaactgagcaggatatattaatatcagtgctgagccactggtttgtgggtatgtcatttccacaaagacatcaaaatgccatttagtttgttttggtccaccattcaataatacctccctttagcattgaatgaaagtattttattaacatttatttatgcttacaattatttcacatctttgtcaaggcaaattatgtagagtgctttgttttttaagtttaatatttgtaaagtatgtggaagtttaagtatacatgcatataaaaacttgaatgatgaattctcctacctttccttttgtaatatgcagtttttgcatgtaacaacatacaaaatgttcatttggaaacactttagtaagtatgaaattcagagtatatttagagtatgaaattcagaatatatttaaagtcagttaaatatattcttttgctgagtttctgaaattccatttatggatggttcaaaacaccatactcccattgggaggagaggagtgactgcctctcatttttccttgttcttttcattttaattggctcctatataccactcttatcttttcaaggttttccacatttaagaaaaaaagcaaattcattcagattctgtttttctgcctgcaatcacttatacaggaataagtgagtccttatggggagcatttaattcctaaagtttgcatttttctaaaggattttccttttacccaaagcatgtgttgatgtgtaagtcttaagtactacttcaagtttctaagaagatccttaattgagatctctttcagtagttacaggggcaaaataagcactgcagaggtccatgtgagagttctattatacatactgggctatatgactatttgttctatagtggaaggacaagaaagaggccataatgtacttagtgatggaacagttgatatttatgccaccccttacctcaagtgagtaactgtgtacttgaagtcactttggcagatattctgaagggaagaaagtttttgcccttaaaagttattaggggtgtgtgtatgtatgtgtttaaatgtgtgtatatgtataaatgtgagtgtgtatgtatgtgtatatgtgcatatacatgtatgtgtgtatacatataacatgcatatatgtatactctatgcatatatgtaatgtgaatatatgcacacacatacatatatatatgactttattttttagaattgtttttagttcacaacaaattgatctgaaggtctagagctttctgatttaccacctgttcttccaccatggcatttcccactatccatatcccccaccagaatggtgcccttcttataccccatgaacttacattgacacatcattatcaccccaagtccatagattatttcagggttcactcttggttcctttttttttttttagtgactatttttctcatgtcacctgtgctagtagtccctgttttatttttcataaagagaacattttatttatacttttttgtgaccgggaaatgttaggtcagaatatcagaaacaagtcacactaaaacaaatgtaaagattcacttttcttctgaaaatggcaagacagataagttttatttacatacatatgcttgaaacattgcagttagtccctttaaattctagaccgaagcacatattttcttttgttccataataaatattccctttaaagaatggctgatatcaagagcatcatgtctcctaatatggtctcactcaacagctgaatgttgaaatgtacagccacaaagcactaaatatatccttagaacaatgatgtactgaacaaaattcagaggtcatatgcaaagacagctcccaaggaagtttgcaagtggcaagtcctttccttcagcaactgaaacccaggagaaacagagtctcttgcctctgcttcttggagaggggttctcctgacaccggagggaaatggcgatctcatctccctgatgttagttaaaatttcatcttggattgataggttcatatctttgtgaagatatctaaattaaggtgatccagccaaatcactaaatactcggctcactccttaggaggagcttaactctgccatgatttctgtgtacacacctcatttattgcactcagagtacaaaagctctgagatgtaaaattgaaccaggcagcacattgcattcttatccaagtgaatcaaggctttctcagtgctactcatccaaagcacattgaaatcaattcttcttatttatttgtaaaacagacagtgatgatggtgtctgtgtcagagggttactgtgagtgtcagaggaaacgatgatggtgagaaggttagacacatggtacatgttgaattaatgttagctattagttaccaataccttcatgatttttattggtatgtaatagttgtaaatataaaagggtaaatgtgatattttgatttgtgaatatgtaaatatcagatcagggtagttggaatattcattatctcaaagttttatcattttttgtgtcgagaacattgcaaatctcatctaggtattttgagatacaggataactgtagttactcgagtgtgctattgaacactagaacttatttcttccctctaactgtatgtttatacccattgtccagcatttctttttccctgacatccctcctaccgtttccagcctctggtaaccaccattctactcactacctccctgagatcaattgtgtccaggaatgaaaagcaaataagtggtaaagatggactagttgatagttaataaccatgactggtctattctttgtctgctacactttctttcctctatgtgtggcaagtgcctacttactcttttaaggcttgtgtcaaagaccaccgaattcttcaccttttctggaatctgttagttctcaaacaaaattgtgcccgttttcttctcttttagtggttctgtacctctcaaaccccgtatcgtggctgtgacttaaacgttacccttgagagtaaaacttttatcatagttttgtttttggaaccttgcacatttctagacatacaggaggtgcacaatatacatgtactaagtaaatgaatgattggtcatttgaaagaataagtgttgaatacacagcaattctccaatctctgtgtttatgcaaacacaagaattaactttgcctaattcaaatattatattgaaatttattcaaacttcccattttccatgaattaagcagacatccgttgttactagattttcactaatcagttaaatctcttttgccttgtatcattttaaaagagcatgtggaacaaaatcaaacagcttaggtagtttacatctcttgagctcactattttaaggagcgaagttcaccctgccacttgcctatctgtctcagtactcacacaacacttgcatcgatgtcctgctaatgtacatcaaatcaaatattcatacctgcttttaagtgtgctcccgtcaacaaacagttcacttggttagtattatcttccatccaggatcaagataaaatatgtgccagagaaagatgccttatagagattctcacaatgtactagttacacataaattaattactggagcagacattcctaccttttagaaagtgaagacttgttcataggagttgagagtgaagaaaatcaattcttgttgaactgataaatgttccttctagatagtttacattgccattaaagcataaagttgccatttttctttatctgtcagctacttattgcacaagctattctggcttttcaaatcatatcttttggtcatttgccaagtgcttggcagttgggtacacatggattagccagtaaaagaatctcagaactttccagctatttttgatcaggtacacctgtaaatcttaaaaagcctataaagaaatacctaactagcacattggatacaagaaacaaaaatctcacgtaggaaaatagtagctgaagttctgaatgttgactcaacttaggaaattgcaggcattagggagaaaaatccttaaagcttaaaattccactaggtggtaaccactgttaacacacacatgcatttccctcttcatatttgggaaattgatggttgtgttttctttttagggtggaagaaggaattctcccttaagggaaggaaaatataggaaaaagaaccactctttgaaggcatctgttgtccaaatcatgaggaagagcttgtagttctgagttgcacaaatgtgctttagttgtttttctgtaggatacttggcgaggtcacctgtttcaccatagctgtgtcctcagacccagtgtaggaaaagggtaaaaaaatgttgattggataaatgtgtgacattgctagttcatacctctctgagcatctcttgaagctgctgcaggtaaaattcctccatcttttcttcattctgtcacttgcatattgggagcctttcctactgcccttgttatgttgctttggtttgtgcgtgaatcttttccattacatatgtttgtacttccaggatctcgcacataactgtgctcaataaatatcaaatgaatgcatgaatgactgaacacatgagtttcagatgtcctttacagccttttctcattgaagtatatgcttgttctttgcctcttaaaaaggggtacaactcaatgaaaatagggttgccaaatgttgcaaaactaagcgtagtcttaacaaaactaaacatagacatgccatacgatgtagaaattacactccctggtaattacccaaatgaaaacttatgtccacacaaaaacttgtatgcaaatgtttagcagctttatctatcattaccaaaatttggaagcaactaagatgtccttcaatgggcgagtgcctaaacaaattgtggcacattcatacaatgcaataccattcagcaattgtaagaaatgatctagcaagccatgaaatgatcagaaggaacctgaaatgcatattgccaaaagaaaaaagccaatctgaaaaggctgcatgctgtatgattcctgctatatagatgacattatggaaaaggcaaaagtatggagacagtaagatgtttaatgtttacaggggctggggacagggaaggatcaattggtggcgcacagagaattttttagggcagcccaaatactgcgcatcatactaaaatgatggatacttgtcatgatgcatttgtcaatataaagagtgaaccctaatggaaactatgaactttaggttataacgatgtatcattattggctcgtcagtgataacaaacctatcagtctgaggtgggatattgaaagtgtgcatgtaggtttgttggggaaggaggtacatgggaaccttacgtacttactgctcaattttgttgtgaatctaaacccatactaaaaaataaagtcaacccaaaaagtacgaggtactcaaataaatgcaaatttcagatacacaacgaatacttttttagtataagtgtgtcccaggcagtctttaggacatgattatacaaaaaatatttcattgtttacctgaaattcatgttaaacagtcctgtattttatctggcagccctacttgagagaagacatctgatcttatagcttcttggtgttcaccacaatgtcaggggagatgttggggacttgggctttgcttcttggagagctgcatgagatgacttcagcagtacttcttccagctcaagaaaccacactactgaaaaaacctggataaactgaacacactttgaggagaataatgagaaagatgactcaaaaccaagtttcaggatgtgtggttgatgacactgaggttatataatctggagaagggatgatccaggagtaatgggaaagttgttgctaaggcatctttttcataaagattaataaagtcattttctaaagctgcaaggggtaacagcagtgccagtgagtgaaggccacagcaaagcctatttcagctggctggtgggattcttttctaatagcaagagtcattcaacaatggaaggggcttctttgaaaggtggtgccttgctctatcctgggtgtatttgtacataagctgggtgatcccatggcaagggtgctgatgtgagcattaccatatgaatgtgtagactgactggtgacacgtgtgtgtgggctcatgcacacaaaagaactttaacatagtactgaccttttcattcatttttattgagatattgcacatagtacaaaatttaccactttaaagtataactattcactagtttttagtatattcacaagggtgtacaggtatcaccatctccactatctaattccagaacatttctgtcatctcaaaaagaaagccattagtaatcaccctccaatcttcccttatcccagcccctggcaaccactaatctttctgtctctatggatttgggactggttaatatttaaggtaaggtccccttgaacttggagattctcttgtctctgtaaggaggcccttgggatccaccacccaaacacaaggaggtcattcccaaggacaaaggaatctcagcacactggaatcagtgttaaactcagaccctcaagaagttagaatgcaccgtctttaaatcccacattcttttttttaaattttttttttaaatcttcatttggattggtttattttattattattatactttaagttttaggttacatgtgcacaatgtgcaggttagttacatatgtatacatgtgccatgctggtgtgctgcacccattaactcgtcatttagcattaggtatatctcctaatgctatccctcccccctcctcccaccccacaacagtccccagagtgtgatgttcaccttcctgtgtccatgtgttctcattgttcagttcccatctatgagtgagaatatgcggtgtttggttctttgttcttgcgatagtttactctccagtggcgcaatcggttagcgcgtggtacttataaatcccacattcttatggcggcactgtctgttcaaataatagttttttttttttttcgttccatataaacatgcactggtgagcctgagacttaaaggaaatgccatgaagtcaaaatagtgaaaactacattttactttgtcaacctaaataacagagagtctctccaaaagaaaagatgtttatttgtgaacagggcattgcaatagaaacacacatgccatagtaaactatacgcctattcagggaggtaaaggaagacaaaagtttttaaagggaaaaatgaggaggatgatgtaactgttttgaaatcattatctttgactacaaaaatcaataacaaaggtgacaccagtccgagtttggtcagggagttgtttggcagatgtccttatagaagtattttttctgtaaggttgcgatgacatttgtgcaaggttgtggtttttgcagccttttgtgatagtttttgttatcagacctacaagcatgtgaaccatctccatggttttccctggctctgtttgccaggattttcttaacactagtcacccccacttcattctcacaactttcacaaattgcagcctcgtttgtgtgtgcaataagccttcatttctattcttttttgaatattttacagatggggtacagttgctctctagggttttttcttttatttcttttcttcattagtaacttgtgattctgaaaagaggaagtaggaaattacaacattgtttgtgctaaaacttgacatagcatgattagaaaaactgtccttgggcacaattgtgatgaagacatgagtgggttctctcttgtttcatcaggacagctggtaaactcccacacttgtgcttctagcctttcttttggcggggcatgaaaagctcagctacaataaatcatcgtctagcctaagacatttatgaatagatatgttttatgagagtagcacattcaggatctgatgaagacatctgctttttattctcagtgtgtcacatctgggttaactactttgcaaaagtgtagaaatgttatcattaaaaatgaatttgggttcaattgtggcaagagccacagctgaaaacaatgacgggttgacagttgcctgagaaagctagggcttttatttatttattttaaagctatggctaggagagggcttagggaccaaaggaaaatactctacagtgagacttgaacactttacttaactgtgatcctgctcccgggtctgctcagggcactttataggtattttgagtcagggggaagttcacatgctgtcaatgtgtaaggaaggctctctttgatgaaatacagtgtggtgttgacttgatgagcccactgttttttcttaaggaaatacctttgtattgactgcatttgaggacaagtagtgactcataaacctggagcaatatgaggatctaataaaatcaacccctttacctcatacattcctagtggatgctccacaagagttctggggctactcagggcaggaagccatcctcacagggttcccaagaattccggacagaaatagagtcatcattcagcattcctcaggctgcacttgcacccacttccttgtaaccacgagccccatagcactagatcctgaccatttgcatctctgttgttcctatcgaaaggatctctgatgttagaatcagaggcttctgtttaagaattgcttcagcagatcctgaattccagtgaaacagctgaggccaaccagtttgaagaccccccacagaggaacccaatcagcgtgagaacacagcttcttcattgccctgtcccatgacttcaccctgcactcttctaccaatcagtgatctccacgcttcggcccactccaaaacccttaaagcccctagccccaaactccttggagagatggattgaaggtttcctctcatctcctcatttggcagccccatgattaaacctctttctctgctgcaacccggtgtctcggggcagtgacttgccacatgcacggggcaatggacttattaggttacaggagaaccttgacgtacagaaatgtggaaaaagtttacaaaccatttaggaacatcaaaagggacttgtggctacatcactgggaggacgtcctatacaatcatatcctcccaagttggcctgacaacagaacatccataccccaatatacaggcactggggtcggttaacagtggaggatgtggaagcaaaggtgaaaccaagccaagtggctgcaccacccctaagcagcactgtggcggcccctgatagcttggtttgccgttgtcccatggatttggctagtaaggagatgatgagccaagatagattctgacagtgtaggacttacacatacatgtgtcttccaaagctcatacgctggaacgtagtccccaaagggaatgtattaagagatggggccattagcaggcgattagtgcccttataaaagggctctggggactaactcgtcccttttggcttctgccatgttgaggacccagtcacaagttgtcattttggaagcagagagcagttcttactagatactgactctgccagtgcctcaatcttggactttccagcctccagaactgtgagaaataattgtctgttgtttataaattaccactctcagctattctgtgatagtatcacaaacagattaagacattcccccctacccacgctgccagttatttgccacagacaaaccatccctttctctcttttgagagggagtgattgcattgttgtcaacacctaggcacttggcagctctcagttacttggggaccaaggtgaaaaagacttaaacttgacaagtgagtgagaaagagggatgaagagataacatctccccaccatctggcttagccagctgaagaataagatagaaggtcttattgcagctgaacatctggttgagctcatggactcacctggagatggatgactctccagcaagacctgcatcaaaactgctctaattgtttttattagttttctctggctcagcttagtgggttgggtttttttttttttataattgggaagctcctgccttaacttctgtgtcagtcatagtgataaaatatgttgagtatgccctacaataatgatgtatacatgcttaagatgcaaattgcatctgtgtgcatgagatggaggtcaaacccaagggtgtcctctcttgaacttccaccgtaaaacatcagacccctagggcttcctcgtgcttgacccctgagggttcaccaaatcatcgcagaagagtctgcttggattttatccttacttagatacttgtagatgctttattattgctattagctatttattaatcattttcttttagcacattattttaataatttttatattgctccattctgttaccatgtcttcaagagataaagagagcatcaaaagatgatttgaatctccacagtgaaaaggcacagtgagtagctatgaacatcaaccttaatcccaaacaataaacactgagatatgctgtggcaatattataagattttaaagaaacaaacaaaaatcctcccctaaagcctccagaaaggaatgcagccccaccaacactttgatttcagtcccgtgaagattgtttttggacttttgaccttcagaactagaagataattaatctgattcgttttcagccactgagtttgtggtcatttggtatagcaggaatgggaaaccaacacagtgtccattttcttttcagttgctttgtgtagttttgtgaaaagatttatagagatttttttaaaacctcaccattgtcatcttgttttgtctaggatgttgttttctaaattacattttatttaagctttagtgcactggactaagttgactgagaattattaaatatattttcctcccccaaactgttattggaagcaatattttataggaacgaacacagggttcatgatactggctcttaaacaaaatgtgtgtttttatagaaaatattctgggcttgctcattgtttatagcaagggaaaaggaaacttgtgttccatttttcactcccttttactgacacattttttatggatattgaagctattgctggtgtcttccctgtaagtgacacatttgtacttttcaaaaaccattttagaggtatcaaagatatgagctagtgaaaaccacctgctcatgagcaagaagaaatgaagcacatttgcctccatttttcgggattgcaatgtatggaccattcattgaaaccatcttaagacgtggataaatttggggacttctggaaaatgtcttttgcaatgtagtgaatgtggatgctcaattgatgatgtaaaaaaatagactcatataatacagtgaaatgagctaattaaatctgtgacatttattgtggcacagatgtaatagataaaatcttttttttcatattcttcttaacttcttttcttatggttaagccagttttgcttaaggcttaaaaatcaacacctctaaaacctctggcctgtcttcttatttgctgtaataggacactgtcttcactacaccctgtcaaagttctggtgccttagagaattttggggcaaggatggcctgctctccctgaccttcccttgtgactctcatgaaaagcatgtggctgacagtgatgtgtgacccataggaatagtcatctggaactgggaagtcttctgcacaattcatgtcacttttctaattgtgatagaaatctcatatgtgcatcagaaaaataactttaggacatggtgctgagcctagattctaaaatcataactcaaatcacaccaaatgcagcttggggactagagtacagattaaactcatgccagtagagcaagctttgggcattgggttcaccactgaagattcaatcaccattgaaatgcttactcccgagtctggtgtccaaagtattctcagatctgagacattaacatgaaacatatttctctctccctctctctttcactgcatatgtttttgcagtgctttctaaactcatccaaagactctatcattaatcctttttccatcagtccaatggagtaggcatgcaaaggcatcttattacagtagagattggaggaagaaggtccagaaaggattcagagttatattgtagtcaatatattgtgatatatgcattctctctctctctctctctctctctctctctgtgtgtgtgtgtgtgtgtgtgcgtgtgtgtagtagtagtagaagtagtagtaaattagtgatagaatgattgaaggcacgctggactgattcacctcaatcctctgcagaatgatacagccttccttaccgtaaaaaacgtaactttttttttttgccatacatttagggctccatcggtaattattaagcagcaaatagacaattgcctggagagccctccctagagcccaccttcctgccattatttctccctcccttattccattagccgtatgggaaatgatctgagctctcccagctagccttcctggttccagctctgtcctctgtcccaaccactacttgttgctttccctgcacatgccagggtgtgcgggctctgactgcttctctcttcccttagcacaaatcaccctcatccaatgtcttttgagttgagatttcatttgcatggggcaagtccagaaggaagctcattgtaaaatatttgagagtcaggtgtgtgtgtctcatactttggtgcatcctcatggcatatctgttatgatactttgaatctagtagatgtttgaagattattaattggttccttgaattagcacaactaagcaatgaacacaagaggaaacctcatcatttcaaatatcggcattgtggagatctttttgggttttctcttgctactttggcatgcttacagctcacactgcatgcctttggacatgcacaacccctgaaactactcaccaagacataatcaaactggttgtgtgtttaagcacacagctgcctaaatatcatgtggatattattgagattttattatccagatgtaatggggaaatatcctaatggaaaacactttactcattttctgtgaaaggtgtaactgttttgaagattgattgggctgaccaataagcatagaagggattacagaaaggcaaccatttgtagaaacccatactgataagtaccaggtgaacaacatgtttattaatcccacttaaaaaaaaatgtatccagctttggccagaggttttccagtttgtcttcccatctgatgctcaaaaacactgtgtaagatatcattataaaaataattatagtcacactacaactggcaatggtacacagaattgccttgcagaaggtcatgcagttagtaaattgtagaacaagattatcaccaagccttctgactccaaattcggtgtctgttatatatcaccctggctaccaaattccaggacccatggaatctcccagaacctatggatagacattagggaggctgtaaacactcggaaactatatgtgcacatccataattacatctttctcagggaacacaccttgatatttcaaatttcttaaaaggttttatgacgtttacagaccatcagagataaaaagcataggaaatgaaaactataaaacttaaaagaggcagctttccatcttttctgttagaatacatgcttatcactcccacagaatgtaccctcagaaaaaatctctgttttacactagtggcatattgatttctttattgatggcaataggggtagtgataatgaaaggtgatagagtttctttagttatatgcaaatataatatataagttgtgttgcatttccagtagccaaatattagataatgatttgtcctgataaaaatcactaataagattcatttgtctctctccaaacaccagcttctcaatatgaaaaggcatctctgaactactgttattgacttagaaatattgttcactggggatggcgtcatcatactgcaaccagtaagaatggcgtcactcctagaggaactgttcatacagaggaatcctgcacaaagcacacccctggtattgggcagtgcacaattgcacaacttcacacagtgaccctgactctgtgagcaaaaatggaaaacaatatcagggcaggaatctgagagcaggcgagctcaggaataagaagctaaacactggctacgtatcagataaagactggacaatacacaagtgtcaaaggacaagataaatgaatgactgactagacagttgtcaggctgcctgtgaaggtaggatgctctccttcagtgtgtggtctatacattcaaagattgaatatggcaccacgtctccagtgagaagattacatgggtcatgaagcgaagagataaaagtagaaaggtccccactcaccattgttcccagtgacccactgagggaccttgtgcttcctgtccttgcaactcttagttctgcagaattagaggtactactagtcccccaaaggcagcatatatttgccaggggataggaaagaaccctgttaattttataagcaacagaggctgcttgggcacttcaggctcattgtttccaatacgcaagtagaagtgttgccatcttgaccttcattattagaagagatcatgatgctgttacacaatggagcagggaggaagaagggtgtcacctcaggatttactgtgaccaaaatgaacagggacaacgaccctggatttcaaagaacatagtgcctgagctcagtgacccccaggagtgaggacttctgttgcttcaagtcacgaccagcagaaatggtagccaagggtatgggatctagaagcattttgagaggagacaggagatgaatgtctgttgtgatcctgagatgagatgttgcactggggcttcaggtttttctcttaacctgtttgtactgagctttcccctagaaggagaagcctgctgggatcctgaagagaagtgttccccaaacagagatgggtgcctcggatggagtgtggcggactcatgacatgccacccagatcatccttcaaggatggtctaggccggacgctgtggcttacgcctgtaatcccagcactttgggaggcccaggcaggtggatcacgaggttaggagtttgagactagcctgaccaacatggtgaaaccccgtctcttctaaaaatacaaaaattaaccaggcgtggtggtgcatgcctgtaatcccagctacataggaggctgaggcaggagaatcgcttgaacctgggaggcagaggttgcagttagccgagatcgcaccactgcactccagcctgggtgacagagcaagactccgtcacaaaaaaagatggtcttgctggccagccgcaggtatatggttaggcggcagatcctttcgggttcctttggctgcagagagacacgtgtttccctgggtgacccacttccaaagaaggcatcatgtagggatgtaaagcccagtcatttgaatccagcataggacaacactaacagacatttgctccctagctcctgtggttcaaggctgcattgcagctcatcttttccctgtacctcatcctatttccatctcctccttttcacatgtgttgatccataataaataccttcctccaggatccatttcagtatctgcaagaataaataccttgagtgattttcaaagtttatattgtcaattttttaaaaggcatacactgtataattttatttatatgtggtatctcgagtgggcaaactcctagaaacagaaagtggcaccctagggggctactagggtgtggggcaggggaaatttggaattgtttaacgggtacacagtttcatttttgcaagatgaaaaagttgtagaaattggatttacaacaatatgaatatgctaaatactgaactgtatactttttttttttgagacagagtctcgctaattttttgtatttttggtagaggcggggtttcacagtgttggccaggatggtctcaatttcctgaccttgtgatctgcccgcctccacctcccaaaggctgggattacaggcgtgagccaccacatctggcctgaactgtatacttaaagatggttaagagggtaaaaatggtatgttcatttgtgataagattaaatcaatttaacaataaaatagaaacaaatgaatcaataaatcggtctacatattcattgtagagttcctgaaatagaaattatttattattcttatgagacccaaaaccaggtaaaatggattatatatacatataagtgttatatatacatatcattgtaagttttgtatatacatataattgtaagttttgcactaatgtcacagtttccttggaggaatttttaataatgtggtttagtattttcttaagaagaaactaaagatttatttttgcacattacgtgtcacctgaataagtgttgcaaatgtaatatgatttcaacatgaaatagcctaacagacttctcacctgcctattaccttaaaaaataaccaaactgaacacaagaaaattagattgctgaaaaccttcactctgaagtgaagaacctgagttgttcctgcaggtggcactgtccgacaataaaaaagaccaatctatgaactgccctgttaaaaattcaatactagccttcttgacctaatgtttaaacatacattttctatagtataaaaatgaacttttttgtttgtggtaatatctattaacaactgttcttgtcctttattcaaatatggatatttaacttttactattgaacattagattgttatttttagtattttttaaaggtattcagttagtgaaataatatcttagatttctggagtttatatatttatcattattattaattttcaccaaaccaaaaaatcctgaatcatcctgaatgcagctaaattcttcctttctaggtaaagacccttgagtgatacctgaccacacatacttggtcaccctgtgggtgtgtcagaagcaccccagtccttctctttggacaggcactggggcttttcttgagttagataagaggaaattccttggcaaatggttcactttgtagcacctcacaggatttaggagcttaactctatgcctgataccttggcccctgtcctcttggaagaaccaaggtggaaatattgttgccaaatagactattcacttcaaacagaaaaataatgcttgttactttctgtctcctctgttgacattcgtattcaaaaatgacttttcctgttcaattaaagtagggagaatgagttcttaagagttgagagattccataaactcagggaaagccttcattttattgactcttttcaattgtttctcaatgtcttaattcactggatccatgcaagggtgtgtaatgtgcactttcaacaaaaagcagcctgagaagcaggcatctaatggcctggtgctagtgctctgttgcctttttacaactgtgtcaacacaaggcttcctctatgccctccagccttcattctgagcacccaagcctttgtgctgggtggcttcttctttcctgactccagccttcattctgagcacccaagcctttgtgctgggtagcttgttctttcctcactcaacatacatcacaaaaatacttcatgtgtcgaggccacttttaaagtgtttaacttaccctcccaatcctcttctgcaatttatttcaagatacagactcgatgaatttaatgtatagcatgcctcctgaacctcatttaaaactcagtcttttaagggtacttgtgacttggtttgactcttctgagcattagaatcttgccccccattattgagaaggttcatcttttcaggtacctctctctataataatttaaagagcattctataaaatctagctttacaaatacaacaaaatgttgaggataatgaagcccacactctataataaaactcaatagcttgccaaatgaatattcagacacttgtatcaatattttctagatatgcaacagattctataaggtatacaacaacttgaaataagactccaggttccacttactgttgagatggagacaaatcctgccaagcaacaaaagtttgtgcttgcactgcttcctgtttggttgtgaattaatattggttgggagcaaacattggagcacctatttgcactgcatgaagacctcgtagggaaacacctttaaaattcctctagaaatactagctctactttaatcaatttatgctttttcaatttgcattcagtgccctctggcttataaaggcaaatactcaacagccacgcctgtcattttctaaatcatttccatgtagaggctttggaagggatcaacccaccctcatttataacatgcaagaaggaagtgtacctcatataccttcttgactatatctttatggacccacaaaaaggccttcattgacccagaaatggaaaaaaaaaatcaaactaatagccatatgtgagtgcttcatttcagactctaataatgtgaacttctagaaccatgtagcatgaagtgggaagtggggcatgggttaaggattagaaaggaaatagagtctcagaaataaagcactgttatagtctgaatgtttatgtcttctaaaatttctgtgttgaaatccttattcccagtatgatggtttcaagaggtgaggcctttgagggttgattaggtataagggtggggccctcatgaatgggattagtgccctcatataagagatcccagagagttcccttgccccttccaccatgtgaggacacagcaagaaggtgctgtcaatgaaccaggaagtaggtactcaccaaacactgaatctgccaagtctcgatcttggacttccagcctccagaactgtgagcaataaatgtcttttgtttacaagccacccaggctacagtattttcttatagcagacctactgactaaaataggaccttccataattttttttttccaggacagcagatggaaaaaaaaaagcctatcaaagaaatccaaaagattagagattatgtaatagtctgtgaagacacttctgaaagcatggtctgcatatggctgaggtgcagtgagctaagtttttaacatgactctgactgccctctctagattgcattgaccctgggccacctggaaccaggggacttcttccgctaccctctagcagggagctgcatgcaaactcagctgcccatgacaggagggcctgtaacaaccccttgggttccagagtctctaggtgcccagcagctataaatggctgctgaccagttccaggtgaccagacagccaagaagtttgtgtgtcatttcactgataaggttgcccacatgcttgtcctatacacaaaggagagcaatcaggtggccgggtgtccagcctagaccctcatggtgtgtccagccatgctgtcctctgcacacctctctgaaggatgaggatggacagaaacagtggtttctcttctctcattgaccttggcttttgaatgtaccccagtctccaatgaaagctatcccttcacccatgctgtgtcattgttggatttcttgtaaatgctgatgcagcagagagactgaccatgcagtcactcatcctgccccagttacctaagttagaagcaaccagagctcttctaaaagcacaaatttctaatgctcaggcacaacctattgaatcaggatgagcctgaatttttaaacaggttctcaggtgagttctaccacaaaatgactttgaaaactagtgatccaagacattgtttctcaaaccattagatgacctttgaaaggcttgtgaaacagattgctggggcccagactcagagtttctgattccgttgatctggggtggagttctgtaatttgcattttatccaagctttggggtgatgcttttactgctgatcctgggaactaaatttagataaccactagcctaagtcttagactctaagagaaaaacagtgctaatgtagtcacagtaacctttgaggaagctaagaattttttctggtgtctacattcctaacataagagaagaaaaaaatgaaaatacatattctgaagcaacatacttctggcttccttaccaatatatctggaaaatgggggaaaagagacaaagatagaatggcacagtaaacatttttttgggagaatgtgacaatatgataccatgatcactacaactgaaagttttgtacatgtggcataaaccaagaacaaagcagtatttagtagatttccaaatatttcatacatcgggaatgtgtaagtgctataaaactgcaatataaaggcacaagttatttaacagagtacactacatttcccctcttcaataaagatctaaatacaaatgtaaatgtcagagttatgtaatccatgtacataattccttttccatttattcactcatatttaatgaaccttgagatgcataacttttaaaaacatggataatgatacaaaaattagccaggcatggtggcagacacctgtaaacccagctactcaggaagctgaggcaggataatctcttgaacctgggaggcagaggttgcagtgagccgagattgtaccattgcactcccagcctgggtgacagagcaagactccatctccaaaaaaaaaaaaaaaaaccacaaacaagccacacctggataatgacataggaagagttatttaatagccacttaccatgtctgttcctacttgtatttaagttcagtgacattcagtggtaagatatttgctcagtaaatgaacaaatgattaacagtgtacattatgtagtttacaaaaattgaaggaataagggggaagaaaaggagtacccatctctcttttcttcaaatggttttattgtgatagagtgtgtatgccacttaattcactcatttaaattgcacaattctgtagtttttggtattgtgttagtctgttttcacactgctataaagaaatatccaagactgggtaatttataaaggaaagaggtttaattgactcacagttctgcatgactgggaagcccttaggaaacttacaattatggcagaagatgaaggggaactgagtaccttcttcacatggcagcaggagagaaaagagtgagtgaaggaggaacttgccaaacacttataaaaccatcagatcttgtgataactcactatcatgagaccagcatgggggaaaccatcaccgtgatccaatcacctcccactatgttcccccctcaacacctgggatttataattcaagatgagatttgggtggggacacaaagcctaaccatatcaggtatattcacagacattgtgaatattaccacggtcaactgtagaatatttttatcatgtcagaaagaaatctcatctcttttagccatcatcctcagtgatcctagccttctcccagcccctggcaaccactaatttactttgtttctattggtttctctattcaagatatttcatatgaatgtaataatatactatgtggcatttttatgccttgcttctattagtcaggaaaatggttttaggtccatccatgttatagcatctatcagtagttcattcttttgtggctgaaaagtgatgattatgtagttacatgacattttgttaatgggcatttgggttgttttcaatcattagctgttatgaagtacctcccttattcagtggtaagatatttttattgtaataattttaaatgaaaatattttctattactttctaaactctatagtgtgggtaaattgaacatcattttttcttgagtcatgcggttttattggggttgacttggtacccccttaaaaatatatatgcataactttgaaacaataatttataggtatacatatgtaattttgaaatgtcatactattcatacattattttgaagcagtcaccaacttacaaaaaatttgagtatagaatacaaagagctttcttttttcctaaaacatctgagggtaagtttccactctgatgcttcatatcctgaatattttagcatgcatttccctagaagaggattattatacacagacacagtcaagacctaaaaatcaggaaatgggcactgatgtatttctaccttctaatggtcagactgcctttaaatgctttgaggcaggaggagccagttagaattatgcattgccatgagttttcacgtctcttagtctccttcagtctgatttctcatctttctttgactttcctggtcgtagtgtgtccggaattggtgggttcttggtctcactgacttcaagaatgaagccgtggaccctcgcagtgagtctcacagttcttaagggcagcgtggccggagtttgttccttctgatgttcggatgtgttcggagtttcttccttctgatgggttcgtggtctcgctagctcagaagtgaagctgcagaccttcacagtgagtgttatagctcttaaggcggtgcatctggagttgttcattcctcctgtccgaagttgttcattcctcccggtgggttcgtggtcttgctggcctcaagagagaaactgcagaccttcatggtgagtgttatagctcataaaggcagtgtggacccaaaaagtgagcagcagcaagatttattgcaaagagcgaaagaacaaagcttccacagtgcggtaggggacctgagcgggttgccgctgctgggtcaggcagcctgcttttattctcttatctggccccacccacatcctgctggttggtccattttacagagcgccaattggtctgttttacagagagctgattggtccattttgacagggtgctgactgatgcatttacaatccctgagctagacaaaaaagttctccacgtccccactagattaactagctacagagtgccaattggtgcattcacaaaccctgagctagacacagggtgctgattggtgtgtttacaaaccttaagctagatacagagtgctgattggtgtatttacaatcccttagctagacataaaggttctccaagtccccaccagattaactagatacagagtgtcgattggtgtatttacaaaccctgagctagacacagggtgctgattggtgtgtttacaaaccttgagctagatacagggtgctgacataaagattctccaagtccccaccagactcaggagcccagctggcttcacctagtggatcccacactggggccgcacatggggctgcctgccagtcccatgccgtgcgcccacactccttagcccttgggcggttgatgggactgggcaccgtggagcagggggcagtgctcgtcggggagactcagtcatggcgggctgcaggtcctgagccctgacctgtggggaggcagctaaggcctggtgagaaatcgagcgccggtgggccagcactgctgggggaccctgcacatcctccgcagctgctgtcccaggtgctaagcccctcgctgcctggggctggcagggccggccgctccgagagcggggcccgccaagcccacgcccacccagaactctagctggcccgcaagcgccactcgcagccccagttcccacctgtgcctctccctccacacctcctcacaagccaagggaggcggctctggccttggccagaccagagaatgggcaccgaggccgaggaggcaccgagagtgagcgagggctgcgagggctgccagcacgctgtcacctctcagtagcacaattaaaatgtagcagccagttatttcacagaatgtccctccatttgagtttgtctgctatttcctcctgattgtatctggactgcacatattttccagaattagtgcaaaagtgaggccctgttcttttcttcacattctgccacattctaagcaaatgattttcaatttgtcctattattgatgaggatttgattaaaatgttccccaattttaacactcttaaaccatatgaaatctttacttgatgctagctcaattagcagctaagactagattctataataaaataattctgtcaaaattttagacatgagaaacatcagttcctcttttaacatatgacaagtactcctaatgtctagaatgtagaatgaccacttattcgtctgtcatgtagattccactattaattttgaaatccatacggcattttataggaaattgaataaaactcaaatgtttctgattaaattttgcttacctcttgaatcttttctttcctgaaaactcatcaaactgaaatgcctttgtaagaacttcttgattgtgtcttttggaaaatagaaagccacattctgtaaaaagatataaacaacattactttctcaaaaactctaattcaatatataaatagtataccttcacattcatgaatcctactgtgttcaaagtttactagttttctagttattcctttattcatatttatgtagaatatttcagaataagtaatatttaattttaaagaatatgtttcacaaggtattttctgatgttttaaacttgttttatcaacagaagatacatgctcagagtaaattgtgtgttttcaacctcagcgctactgaaatgtgtgttggattgtttttgttgcgagagggctgtcctctgcatcacaggatgtttagcagaatctctggcatctacccactaaatgccagtctcacccccaccctcaatcctgacaaacaaaaatatctccaaacattgtcaaatgtccccttctgggttatgtgggtggggtgtgtgtgtgtaaaattgccactggttgagaacaactgaagcaaattttagaatatttatgtaattttaaagacttccaatttagtaactatagaagtaattatagattataacagatttctagtggagtagaattgtcaacatttacattattagaagtttgagttgttataaatttcaaagaaaagaccagatagggttacattttaaatatttctgaaggtgtgtttttacagcataatatatattaaaatagatgatataggactaagtgttattgttaaattcaatcatagtttggacaaaatgtagtcctttttcatgtcagttaagcaagttgacttatctatgcatagattttgataggatttcttgtcaaatgaaagaatgaatcctggaacagcagtcatcaagattgcagttgttataactggtcaaaaaagcactcattcctgataaggatttttttgtgggaatatatatatttttttactctagccagtttacagtcaaatcaagacctgctacagctatattttaatgtgccaagttcatatatttttttcaatccttttctattagattgccactgtgcatattgaattgtaagtaactgcaaataatttgatatgggtttatattaactacaaatatcctccttctggcaaacaaaatatttttactaaattttctgtaggtggtagggagaattgggaaacaatttcacacaatatctactgggttcttggttaggtcaaaaattcagcataagcaacaccaggtgcttagaaaggattgcaaaaaaacatatttgatgtgtttttttgtccattttgcaggtatttgttttattactgctattgaaatgcttttagaaatattttctggcaaagcaaacatttattttggaaacatttacttggcttctaaggttgctattattcaattgtttgcttaatcaaggggaaaaatgtttgggaggtacctgatggttcttttatttcctctgagaacaaatctgtggtgttatgtgagtgttaaaatggttcaggaatcaaataaatatctgaaggagttagaataagccaatctgtttgacacaggaaggagacaggtcctggcagagggttaagaatttaaaaaaaaaaaaaaaagaataaaaagaaaacaaaaaacttgaaggtgaaaattgggtgacaaccacagacagagactaaaggaaattagcagcagaaggagcttcaagggaatatggaatttccctttgttctaggtttctgttttctgcatttttttttcctctggccgaccttactgtcagaagctatcatgaaaagtcagaagctaagagtgtgatgtaggtcatggttaggcatgaatctaagtttctgctaaaccggatttatgaataaaggagaatttgtcttacagacaagaaaaaaatcaacttaatagattctatggcatgtctagagaaaagaaaatttagcaattgctatctatcaatatatggcaagctgagcataaaagccaggaggtaaggggtagtgaattgaaacccatgagcaagatataagtgttggtagtccctgaaggacaaggaaaacagcgtgatgaattctgagtgacaaagactgggagggttttccatttggggttggatttcttgtttctgctgctacgtaaatcaacacatatggagtgacaaaactcagtacagcaaaggccaggagaaaaagacatattccatctagagacatattgtagagatgtggggaaaaatacaaagttttattttgttaataatctttattgctcatgcagttgacacacacacacaaaaaaatcaccttctacccacagcatctcggcatcaatttgtggagtctgacaaggaaacccaggttatatacaagtatgggtcttaatacctatatattttattagctttactcagaaaattaacaaaacttccactttgagaagcttccatcttatgacctggagagacataaatataattagtaaacttttgtttccaaagcaagattggttgtgctgcccttccctccatcctttgaaagaacaatctgtttccccccattttgctgttttccttttaatttccctgctcttctctggatgtctctaaacctgcgttcatctctgttctcttctgatccagctggatgtcttggtttcagggccttcttatacttttgaccttgtttacagccctcacttggctggatgtaattagcttctcacctgtgtccaggattattttttaacccttttcctggtcaattgccattttgttagttctttttcctttgaccaggatcacaaatgcatggctgtgtttaagggagagctgcaggagagagaagaggtgacctgaagtcacgttctgttcattgtaggaaaagtaatatgactgggatggttaggtcacatgatgtttgagaacctaatgttcctcattagcatcaattggatgttgaccttggttcaagctccttcttgtttccaatcacataaccactgccccgagctaaagacaacattggtaggatacagatgctgtgtgaaaagccacatgctggaacaaggttctgaatctttcagctgatgtgagtaattaatccagcttttcattggaccataaaacatgattttccaggaatacaggagaaagctcttctttgctccttttgttcctttattctgttgatcaacctgcctcttctgtggctcatagaattattttattttacagtcattgtcagtgccttgtgtttttcagaagtattatgacaagcctaggggaaggtaccaatcaaatgtggccatgatcatgaatacaaagaagtgatttcttctcttctttcttatgcaactcagcagaagtaccctcagcttacctttgaaagatctctcctttttttctgcctgatgagtgaaaatactttgatgactcctcatgaatagcaatgtgcatgatcatttcacatccatttttgtgtttccagagcctttgtgcagtatgcacagggatagatagtgctaaaatgataatgattgaaatgaaacgaagctgagattaaattgctctccatgaagctcatggtatagctaaaattcaggctctgagagaatgggtggcatctgtcatcatggagattagtatatctaataaagtttaaattcttgagggatttgtcttcattccaagccttctattaggacttattcataggttgggagaagttgagaagtcttgtcaacaccacatgaggagggacacagatgggtcctttctaccctgaaatgttatacatgggcccagcaataataaatggccgttgctttctaatagcatttgaaaccccaggttaagaaggagctatgcaatacaggactgatacaatcagaattttattacagaatttccatcctggcaatactatcacctcaagcaagtaatgcaatagtcacctgtttcttagatgaatgagaagttcattcatatgaatagctcagtgctttatgtccgtggaacacaaaaagctaatgctttaagtttaacttttctcatatgatgattgaatattctggcaatttctggtatctggaattattaaataatgtattatgacacaagattattttaaaatgtcattgttatctttaccatttcacattcaataaacaatatatctgagcctaacatttcacatttctttacactttcaccagctaaatttcctttaattctcaccaaatccatcaaactaaatgcgtgttaacttggctaataaaaatgtcatgatatttcttaagaaaatgtagctatgtgtgtgtagatgaaaatggagttcgtttgtaaatattgacccatacaaaggtaaacacaggtgtagatgaaggatttatatgggaggaaataaaagctgagagtgtgaacaggttgtgtttcagatggtacaaataaaggagaaagaaagatcaaaagaaatagcaacattctaaaatagtgttcaaggacctgggaaggagtcaaaggagaaccagtggttctcaaacggggcttcagggctccctaagtggtatttatattggggtgggggcatgcttggttgtcacaattagagggggattgcacaggcaatggatgggagggttctgttctacagagaagtatccatgtcacacataagttttgaatgacccccaggaaatagttgtgtgtcattctccaacactaaaaacaaacttcagtttacatagaaaccccaggcattctatatattgttttaaaatatactgcatattctagcagtgcaacgagcaagtagcctgaagaaatttgtttgattgcttgtgcactcctgctctgtgacccaggctggagtgcactggcacaatcatagattgctgcagcctcgaactcttaagctaaagtgatcctcccaccttagcctaccaagtagtagctgggactacaggcaggcatgtgccaccaggcctggctaatgtttctaaaaaaaaatttatacagatgggctctcagtatgttgctcaggctggtcttgaactcctggtctcaagtgatcccccccaccttggcctctcaaagtgctgggattgcaggtgtgagccatcatccccagcctattttgttggtttttgagatggggtcttgctctattgcctaggctgggtgcacaatcatagcttattgcatcctttgactcctaggctcaagtgatcccccaatctcagcctcccaagtagctaggactacaggcacacatcatcatgcctggctaatatttttttattttttatagagatggggtctcactgtgttgctcagtctagtattgaactcctggtgtcaagtgattctcccatcttgtcctcccgaagtgctaggattacagacatgaaccactgcacctggccttgaggaaatatatttcactttattttattcagtatgtcattaagagtgtttttctgcttgagaaaatcatatcacttttgacagtgcctcttgttgtttgaattgttggtctatattcatacgtcaggctgcaggtgaagtttatgtatttatggcacatttacaactatgcacaaatacacttttgttttcaaaatatccattttaaaaaaaaacatattattcatttgaagagattgttcttattaataggagcaagcatataacaaccttattctgcattcgagtgccattgtgccctaacatttacatattttaaaatgtaacataaatcatattgtctttatttctgctttatattgcaatgggccttatttcctgtaatgtttataataatacgtgtaggtcatctatgctccctctcgattccatttcaagagttaaaaaggaatgaggaaatatttttggtaaggagtaaaagagccactgataaaaaggcctacaggacttgggaggaactgcagggagtggaaaagtcagatcattagcggagctctagaaaaagcattggcgcttaggcttcttaaaagattcacatgctggtgtggagaggagggcctactaaccaaggcctgagagaaagaagcaggctccaggaaagcataggaatggggcttctctgagagggactgttagcaaaatgttaagataaatttgaaacaaacaaaagagataaggactttttctaaacctgaaccgcaattacttttgcaccaacctaataaaaatcacctatgacgtaccaagctgtttttttgcctcagatccaaagatgaccaagacagatccctccaagaagggtgtatatcctagtgtgagtgaactacacaaacatgacacaggaaaagacaactggttcccaaggttaagagtgcaattcacttttgtgaaaaacatgcctgagagtgttgctagaggttctcattctgtttttttaaatatttttaaaaaatccatgtttaaattgacaaataaaaattgtatgtatgttatcatgtacaacatgttgttttgaaatatgtatacaatgtggaatggctaactcaagctaattaagatatgtatgatctcacatacttatttttttgtggtaagaacacttaaaatctattctctcagtgattttcaagtatgcagtacattgttatatagtgagcatgatgtacagtaggtctcttattcctcctgcctaactgaaattttgaatcctttgaccaacatctccccaacccaaaccctatcttccccttaaccactaataatgaccactctactctctacttctatgagttcaactttttaaagattccatacataagtgaaaccattcagtatttgtccttttgtgcttggctaatttcacttagcaaaatgccctccagattcatccatattgttgcacattacagacatttcctctttttttaaggctgaatcagaatttcattacagaattaccccattgtgtatatatacacaatatatacacaacatattgtagatatatacacaatatatacacaacatattgtatatatatacacaatatatgcacaacatattgtatatatacacaatactccattgagaaaaatcacatcacatccattgtgtatgtataccacattttccttatatgttcatttactgatagacacataagttgattctatatcttggctattgtgaaaaacgtggaaatgaacatgggagggcagatatttctttgacatactgattttacctcctttcaatatacatccactagtgggattgatggttaagtttctaattctcaaaagattaagataacctttataaatgtctggaaaagtttacatatatttataattacatataaatatatgggataattatatataagtatataattatgacagaaaatgaatctttttctcctatttaaatgcttaaaaatcattcacctcaagaagatcagatacttatctatttttttctcctatgggtcatagttttaattaaattctctaaacaattttgggcttaaaatttgtgtttgatatgatataaaactctaaatctgtttattttacccaaaattttaaccaagtttcctggtaacgtctattgcaaaattctttctctctcgactagggtagtttaattaatccccacctcctacactgagttatatttaatgtatacttccagtttcacagagcctaaactttattcttaatgagaatcagtgattaacctagtatgatcctaccaagtaagttagaatattatgttgcctgcctgaaatacattttttatattgaacacagaataatagatttatgctatttgcctaaaaagtattttctctgcttccatttaataaatagtggacagatatttagataacatatttcgaaggtacaccaaattattagattaccatgatagccacatgatttcacttggctttaggttgattgcactgttttttgttttttctttttaaaacctccatcatccttattgcgagttgaaattcttcttgcctgccctgagaattggagtggtcaaatcaaaaagcttttatgaaagaggttttagtggtggtgtgagattttgtctttcttatttttcagagacattttggtaggagataagaaattgctggaatcatttccaagcctggctacattctttagtagctctgtaattttgggcacattgctttctcaaacttgtttccacatatgtaaataggaaatagtgatatctacattacatggttattagcacagtttctagcatttgtaaccactcagtgaatagtaggagctattggtatttacaaagtaggggaaagttgaatacaaagttagtatccaaaagtatattggatactaaaagccagatgttctcttctgcaagaattctctcacagatgacttcaataagttactattaaatgaatgataaatggataaatgagtggataccttcataaacaaacacagataacacatggcaaggcatggatggatcagaactgtctacttccttctggccaatccaacttttttatgtgccttgcaacttcttgcctatacaggtgaatttcaaatgtgctgtcttgttgtcatcagttaccctagatgattcctcctctccaccaattctcttcctttaaccccttctcaggggttaaactttctgatccaaagttccctgccttgaacctgcattgggtcttcaggtttggaatttttacgttagagtctgtattctaacctttattttccatgaaggtcctggccttagcttaatcctggttgttctccatgatctgaaatacaataaatcattcagcagaaatatttgagatccaatttgtctcgagggaacagtatttctgagttagatactgtaaattttggcagataagctatgatatttagtgcagaattatagtcttgtaagcaatatgtgtttttttttcctcttccgagatggagttttgctcttttgcccatgctagagtgcagtggcacaatctcgattcactgcagtctccacctccaagcttcaagtgattctcctgcctcagcctcctgagtagctgagattacaggtgcacaccaccgggcctggctaatttttgtatttttagtagagaagggattttgccatgttggccaggctggtctcgaacttctgacctcagctgatctgcctgtgtcggcctcccaagtgctgggagtacaggtgtgagccaccatgcccggccaaatatgtgaatttttaaagtggctgtgcatccaaaagctattattttgtacatgtttaagatagaaattaaataatggcaatacaatttattagttcatatcaagtaaaaacagttggggttgcctgaagatgggaaaattaacacattataataaaatccttactatttattgagaaataaacaatgaactaattgtatttataaattgtccctaaattagaatttacaacccaagtgcctttcccaaacctatcaaaacagaaccaccttgcaataataatatccaagaaattatcatttacccagaaatctcagctgatttgcagatggaagtagcaaagtctctcgtcctcaggattggttgtcacaggtttacactaccaaagtgtcttggaaaattccatcattgttttatgccttattttactgccttcttttcaaatgttctctccctgcctcgaaatgacttctggttcatgaaatgtatggcgttttctcagcctgagagacctggagatcagcatcactctgttcatagattgtagattgtgcagttgtggtggctctggcagccaaaatcccaaagatcatgttgtcagtcactgtgcgcagtccagaaaattaactttccgtcattataattctgtggtttttgaaagtatatcaaaaataatatccttttagaatacttctgtagtattctgattttttaacggaattctttattctcctttgagtcacttggaatctacttctaatccagtcacttggaccataggatccagcacagtgggacctgcccatgctaaccctaccccaaagtgggtggtttgcacaaggaccaaggtcagttgccctcagctgcagcactactgacatttggagctggatccatcctctgtggtggggttgccctgtgccttgtggatgtttcgcagcatcctggcctccacccacttgatgccaggaacatcaccctcagtggtgacaactaaaaatgcctccagacattgcctaatgtaccctgggggacagtgtcacccctgggtgggaaccactgagctggattaataccctcctcatatcaaagcttgcactaactcttcagtgtgggagacttggcaaattatatcacaacagtgtgttgaacctgtgcatagaacaatcactctaacataacttttattgcccagttaaaaattcctccaggggttgctacagatacgtatctaggctgtttgaactctacctgattaggcactcaaaattaatgtgcctcaagatgttatgatcaaaccaactcgtgtactgatcattgatgtaaagctatttggacttgaataatatgtgttccatacacatgcatgtcaatattttaaaatctccttaatcagattaaacaatctcactccgaaaaaatattttaaagaagataattgtccgtgcaatatagctatttatccttgcctttttaaaaataatgtaaagaaaacaagagtagtttttcctgtaagaaaatatttcttcattcacactccttaacaaattcaatttctttaaatagcgagtatttttttttctgcagacataaaggtttacttatttcctaagttattcctagtgactgtgaatgtgtattttcaccaatttattaacaaaatatttctaattattcaaaactgattaatccctgtataatacattttttaaaattttgaaatattcttaatcttaagaataatttcaaaaaaatccaagaacttttatttttcctaagctatttgaagacagttgttgaaatacttgtgtgtgtattttctacaaagaagtacattctcttatataatcagagtacagccaccaaaatcaggaactgcagcttggcatgtagctgccacatatccccttcaaagtttgccagttgtcctcataatgtccctcacagtggaaagattcaatacagaatcatgcattgtgtttagtttcatgtgtgtggttttttttttttttttgtcggggagggggcggtctctttcaatctgaaatcatccctcagcctttcttggactattgtttttggaccttgatgtttttgaaggtttcatgccagttagtttgcctattggttttgtcttatgtttgctcatgattacatttggattatgcatttgtagtaggaacactacaaatgtgactctgtgtttttctccctgcatcccatccggtggtcgatttttctcctggcttgttaaccttgatcacttggttaaggcagagtattccaagtttctctgttgtaatcaataagacttttgtacagaggtactttggtactatgtaaatatcccattcctcatcaaatttgtacccactgttttaagcattcattgatatttctttttctttcttttcttttctttttttttaaagacaggaacttgctctcttgcccaggctgaagtatagtggtgcagtcatagcttattgcagcctccaactcctaggatcaagtgatcctcctacctcagcatcccaagtagctggggctacaggcacagccatcatgcccagctaattttaaactgtttttgcagagaccaggtcttgctgtgtttctcaggctcatcttgaactcctcgcttcaagcaattctcccgcctcagcctccaaaagtgctgggcattaatatttcttggatgaattattacagttatcattatgaaatagtaatattctaattccaccatttcttctacattctatcaattgacagtatacagtaaagaagagctttatcgtatctccatttatcttaacctggactcagattcattttttattaaacagattataatctatttctgtcattatttttatttgatgcttatttcctgctgaatccatccaacaatgtattcatccatcatttcaggcattcactctttttttaggcagtgcctctcttagatttttcctgtcactttttggccttcacttgtcttttctagattttaaacttgtgtaccttgcaagattaatgcagtgcatctcttctaattctgtgagccttcctttattcagtgggtgaataaatgacccatgctccccctgggttcttctgagcaatgtggtgctgccttcagagctgtttcatgacctggccaccccagcttcagcgtgtcacaaaagttccaagacatgaaggaatcatatcacacgaaagttctcaccttgccatattctgattttttctgccacttaagcaacacaatggtcactgccaagaggcatccagtgttctgagaaatcaccccagccaggccaaccttggactgcgttaattgtcatgctgttaacgcaaagataaacgggtgatagctgcccttcttttaacctagaggtgtgcttaaattctctgtgtttttctttaaatggttggaggattatctaaagcaaatacattcccatgcagctgctatatctatgattaaactttttttttgatgacaagcttttgaataaaagtgctgctaagtttcatgaaaacagttacggtaacagagttggacatttattcacattatttccaaatgtgcaaaagagaagagtaactaatttatttatctatccccctgcctctctttgtagcagaggaattcacacttgtgtaccagtaatagctcatcatcctccctgctacactgttgtattcacttaacttgcattgtattcgtagactggttttaaaaatatgactttttagttttctgccgagaatcaaatcttctctgtaaacagcacacaatagctaggaaacctgatttccaatttaaaatatttcagtctcttgctaagcaagtgcctttcagtttaggtatctggtgtagtaaagtggaattgcttattacacccgttttaaacaatcacttatgggcacctcagaccctttgggtagatgctcagctgatgagagccttactcaccttcttcttccccaagatggtggataagttcatgagggcattactttgtacaatgggatggcgaccctgggctcttgctggtccctgcatgtgcatggctcacttccactgggtggagtttgtctagatccagccacaaaatctccaccatttgatatgcagttttgcccctggaatatttcctggtctggtctcttccagcttgttggaggcctgctggtctttcctatggactttgccccacctcagctcttgctgctactagatgtctggtggggactcctcttccattcctagccccagcattctgctctgcctcctgttgctagcgggcacctcagcctgcagcaaccccgtgggaagtccgccagcctgtactgccttccatctgtactcctccccagggatccagggagtggaatcttctgctaactcagacatacatgctgcctccacaggtggccaccctggttgctgtgggacacctgtctcctcctgccgtccaaaagagcaagaagcactaaactctgtcttcggtcagcatgactctcagcccatgtaagctcaccttggctgtaccccgaggagggagatcaaagtatatgttcctactgtcagctttactcacatccacatcttctccctgcatgtccttgggttggaaggaacagcttattttttgtcctacatcagtggttcttaaactttactgtaccaagaaagcttttaaaaaatgctgatgattggggcctgcagattctcagtcactgatctggatatgtcctgcatgtaagagtgttttgcaaatcgtttctaatgtgcaaccaggattacaaaacgttatcttgtatcctgagttctctctactcttggcataaaattaaaatctgttatatcttgtgtatgtgtgtgtctgtgtatgtgcatgtagagaaagagatagaaactgcaagggtagcctcgtaatatgttaaatggtaactatttcattttgggaaattttgacttaaagaatccttttgtccccctcaacgaagtatgctctgtacagctattgccttgaaagaaagaaaaatcccctgtgcttgtcagtagctcaacatggcctctttatatccctttgcactttgctcggtagctcaacattttgcattttgcagcaatagttcaaaagcccccctctctgccttaggcccctggatccctcagaatgcttcaggatgcctagcgagaaggatatgttcacagaaaggcaaaaatggaaagcacattagtagagtttgcaaaatataacctttgcatcactgctattatccaccccacagcgaatgaggcacgtctaggtgaagggtacatttatttgagccacataaaccaagagttataaagttatgaaatatggaaccaatagggaaataaatttatttttagaaagacaaagggacttgcccaaggtagcatgattatgtaaggttttaaccaaaggcaccatttccgtggaagccaggaagagtagggcgggagtagggcaggagtagggccaggagggtgaaatccaagtggcttaaaggtgacgtatgagctttcaacagaatatagaaagaatgaagagcggggcctgttttctctccttcttgatacttccatgaagcctattatttcaccagccttctgcagcttaatgatgcagggggcataagaacaagggatggagtttctgccagtaggttcacctgtgttgtcattatttagttattattcaccaaagcgctgttgataactatcttttgcagcaatggctcaacaaacaactaaagcagcctgggcgaggtcgctcatgcctataatcccagtgccttgagaggctgaggttggaggatcacttgagatcaggagttcaagatcagtgtgggcaacatagtgagacctcatctcttaaaaaaaagaaggccaggtatggtggcacgtctcagctacttctcaagaggccaaggtgggaggattgcttgaacccacaaattcaaggctgcagtgggtcatgattgcaccactgcactccagcctgggtgacagagcacgatctgtctctaaacaaaaaacaaaaaacaaaaaaaaaaaagaagaaaaagaatgcaaatatagacatttataagtataaatgctaatgataaactgactttttaatattttgtttcacatgagcggtattttcacagccactggattgcttatctattagtggttctaaaccagaggtgattttgcccttccagggggcatttagcagtacctggagcctttctacattttatagtacttttcatgtttcctaaaacttttgaaaaactgaccttcttaattgattacttatgatgctttcaagattcaaattgttccatggtaattcagccttctctatttcattgtttattttctcttctttgacattcacgattttgacaaagttaaaaacttacgttgggtcacagactactatgatagaggcctgagcctaattattatcagcttaagttgtagaaacagctcttgtattgacactagctggatttattttatttaattgttttggaatgtgtaaatattatgcagttgatgtgcctcagaggccattttctttcactttttaaagtacaactagaagttgatatttttagcattcagtattctacactttgtggacagatgaacttcataatgaagtatgaagagcaactgtaccttaaagaaaaaaatagctacatcaaaactaggtaagaatgccctatgatggaatattttatgctgctcattatattttacaagtcatagcagggcattatgtggagagatgtatcttgctggaaatgcactttatgacttattttgttattccaagaggatattcgtacttgattatcttctactcaattgtgaaaacatttatgctttcgggtatggtttcacccatcatgtgggctgggctggtttcaaaaatattcatatggcggttgctaattataggatctcaggaactattaaaaataaacacaggcacctaaattcgagaaataaagaagctgattaggaatagaagcacattgagaccttagcacagttgtaaaatccatgagtttgagctgattaatagagcgtattattacagaatggtgatttcctgttttttggcttcccactgtgcaccaattaataatgtgtatcttatccacaggcagcagaggtccccccctgaactattagcttcagcaacctgctcttctgttctttttttttttttgagacagagtctcactcttgtcacccaggctggaatgcaatggcgtgatctcggctcactgcaaccactgcctccagggttccagtgattttcctacctcagcctcctgagcagctgggattataggcacctgtcaccatgcctggctaatttttttttgaatttttagtagagatggggtttcaccatgttggccaggctggtctcgaattcctgacctcaagtgattcacctgccttggcctcccaaaatgctgggattacaggcgtgagccaccgtaccccaccaacaacttactctcctgttcttgtttaaacacttgccataacttgatcttgaattccttcctgcagacatttagaacaaaaatcagtgtgaaatatttgtcaattacatctgaccttgtcaatcttgagcagctcaacaaatctcatgccagggtcctggctgatatttgaagatgtttgaggttccagtcatagactatgaaagaacatggtgcccgttaatgcttagttttccaaatacgtaaacagttctttgtatttgcatacattgctttacattttataaaatatgctgtaccacctcattggcttcttcaaataaccacagtgcattacagttataattttaaacatggataaaatagggtgcagccatattaaatccagtagttggaagtggccttttccagaatgttgcctaacatgtagggcatacttaataactattttttgaatggatacatattagtgcttggaagtaagaaacattgtattgttgttgttttaataatggttgtttttgcttatgacatagacaggtaggcaagatatattaactaggtttcaaaagagatttaaatcccaattctgttgttaacaacattgtgaccctgaaattctcttaactttttggcacacactttacttatttttggaaaaacaatctcggggaggaagtttgagtagatactgtgtaggatcattttcttttctaagtgtcctggatcttacatttcactgagtagaacgaagctttaattcaaacagttttgataaagatatagaaagacaatgcagtttgttttttgtttgtttgtttgttttgagactggatctctctctgttgcccaggctggagtgcagtggcaccatcacagctcactgcgacttccacctcttggacaggttcatgtcatcctcccgcctcagcctcctgggttgcttggactacaggtgcacaccaccacaaccggctaatttttttgtagagatggggtttcgccacgttgcccaggctggtcttgagttcctgagctcaagtgatccacctgcctcagcctcccaaagtgctgggattacaggtgtgagccacacaatgcaattttttattgggtttataaattaggctttcttgttcttcactaaactgtttacctaacaatatcacctggctgtggagcagttattcttagtgaaattaaaaatatttattgttcatctaaagctcccaggattacaatgctctgtcctggtatatgaaatatgtcagataatacagataatacagctttattgggaactcccatttatgttatttttgggagttctgctcatgggctttgtatttaaagtgcaacatattcacttaggtcttactgaaggagttaattatggaagagcaaatgagaatcttatcatttgattcacagttactcaaaattttatttatattatctattagacctcccttgagtgcctactatagacctgacactacatgaggccctcggaccttagagacaagctagacatggcccttgacctcaaggagttgcagtgaagaagtcacttctacatggtgcttgagatgatgtttaggaaaaccttcacagcagaaatgatatttgaactgtgtcttaacagatagataagggtattctaggcagcaaggaaaaaagtaattttggtacaagttgcagtgtgaacacagacatggatgcatgaaataattgtgaattttggcaaatggaaattgtccgtatgtcacatgcactagtgaataatgatgcatcgcaaagggaggaggtggtgaaagctggtggggaaaaacagtagaaggctgtgaaaaccgtgttttgttctttgtcaagtagacacttgggagccattgaagaatttgacttcaggagacacatggacagtgctaaattttggaaaacctctattggcaatgtagtgtggttgagagataatatttaggggatggtagacaaggagattttgagaagctgaacaaacatggtaaccctaggattggattaaagagatgatggaggcacatgttaaggaaagtcagtggaacccatttgttaattggaggtgaggtttaaggaaaagaaagtgtgatggtttattgtatgtgtcaacttgattagattaaggaatgtccatattgctgggaaaacattgtttctggatgtgtctatgagggtttctatgtaagagactaacgtttgaatcagtggactgagtaaaaaactgccctccccatgtgagtgggcatcctccaatccattgactgcctgcaaaaagggagaggaaggaaaagttctctctctctcttcttgagctgggacatccctctcttgtccttggacattggagcccctgctcctcaggcctttggacttacaccagggttccacaccctactgccccgcccctcctacccagttctcaggctttcagcctcatactgagaattacaccatggactcccttggttctgtttctcaggcatttggactcaagactgaattacacctcaggctttcctggtcctccagcttgcagatggcatattgtggcacttctcaacttctgtaatcacatgagtcaattcctataatcagtctcatctatctatctatctatctatctatctatctatctatctatctatctatctatcatctatctacctatctccatctatctatcgtctatctatctatctatctatctgtctgtctgtctgtctgtctgtctatccatccatcctattggttctggttctgtggagaaccctgaccagtataggaagagaaatggccaagattgtgatttgagtcactgggaaaagaggaggagaaggatgtcacatggaggaagttaatagttttagtgtcatacctcagttttgggttttccaggacatttcttcgggtagatctcatgggtagttgaacacaaaatttgcacagcacatagaaacttccagctcttcatattgatggaaccatactgagattctaaaaccttattatggaggaattaagaaggcaccaaggatagagtgttggactggacaggattgcaggagtacacaaagggaattgagtttactatttagagcccagactctcacgctatcagggaacatcttgggataaagtagtacctggaactaaaattcctgctttccagctaagtaaattcaatacagtttagaaaaggaaacggctgaaagatagaaaagaatatggtggaaagaccgaccttgattccagaactgctttggttttcttccttctgatctagaagtgggctgtggcttcccgctagccacaaagttactactttctgcattcatgtctctgtcctagtgatatcttacttcctgagggagtaagggcttgccttatctcaatcttgcttctggctccataagtgtacccagttattccataaagtctattccacactgtcctaaagccaggttcctctcagcttgcaagtggtcatggtttagaccactggctgacctgcctgatgttgcatgacttcccatgggttcacttctgctagtgtgaatttactggattatttcttacacctctcttttcggtctgggcctccttgggttggtttgtccatttctaactttatacccatggctctgcattctttagtcctataacactcataatctgcatagcttcttagtatttatcatatacgttattatgctattcttttttaaaaagcttttgccttttttcaaacacctattgtattagtccattttcacactgctgataaatacatacctgagactgggcaatttacaaaagaaagaattttaatagactcacagttccacatggctggagagtcctcacaatcatgacagaaggtgaaaggcatgtcttacatggcagcagatgagaagagagcttgtgcagggacccccctcccttataaaaccatcagatctcatgagacttattcactatcacaagaatagcacaggaaagacccgctgccatgattcaagtatctcccacagggtccctcccacaacatgtgggaattatgggagctacaattcaagttgaggatttgggttggggacatagccaaaccatatcagctgtgaagtcagagatgaggtattgcaattctgttatcactctcttccccagtcccctgcatatatagtatttgccaagtactagtgaaggtggagctgatctaagtgcagatctagggggataatttatttgtggtcccatctgaaacaggagtagtagcaagattcacttctgtattgattcatcaggtgcttttgagctcctaacatatgaacaggagagtgctgggcactgtggaagattcaaaactcgatcacataggaacacctgccttaaagaaagctgtggccaaacccatggattattagggctagaagtcatctgagaacatgataaaatttcacattattctcttatttttttaatttagtttcaaattaaaaccaaatttgtgttcatccttagtttagatgtgtaattaaagcaataactataggcttcaaacaacagttgcaagaaaaccccaaaaataaaaggacacatgtgtacacttgtgcttggagatggtaagcactcagccagtgacttacattttatcatgttgacatggcagaggtcagtagttacacaatgttataacacattaaagataagcctatctttactctgaatttcatcatcacaaagttgtaagtctgactaaaagagccaaggtaacattgaaagatatttttcagcatttccaaagatcattaagtcataaccttgattctagaatatgcttgttattggcaatgacatcttttagaatatttgctttagaaagctatttttgtttactaagattttgaaacacatttgctataggaggtgcagttgcctactaacctgagagataattaatttttgataaccttactgatctagttacactcacagtaaacatttttttggtaaaaaaaaaaaatacttttttttttttttaaataagtgactctgaaaaagtaacttggaaataaaatgcattttatttatttcttcttctttctttctttcttttttcttttttttgagacagagtttccctcttgttgcccaggctggagtgcaatggcagggtctcagcccactgcaacctccgtctcccaggttcaaaggattctcctgcatcagcctcccaaatagctgggattacaggcacccaccaccacgcccagctaatttttgtatttttaatagagacggggtttcaccatgttggccaggctggtctcgaactcctgacctcaggtgatctgcccgccttggcctcccaaagtgctgggattacaggcatgagtcactgtgcctggcccaggttcttcattttttttaagtcaagtcccaaaacaaatatgaaaaattacataaaagggagtttcctggccagagataaagtcaaagttgcatacaattaggtgtccattcattgattggtttatccatccatacattcattcatttatccgtctatccagttgtccttccatccatgtaccaacccactcattcctccatccatccatccatccatccatccatccacccacctactcatctttccatctacccactcactcatccttccattcatccacccacccacccactcatccttccacccatccatccacccagccacttatccttctatccctccatccacccactcatccatccatccatctgttcacccacccactcatccttccttccaccatccatgcatctacccacccatctatccatccatccatctatctatccacccacccactcatctttccatctacccactcactcatccttccaaccatccacctactcatccttccacccatccatccaccaacccacttatccttctatccacccacccacccactcatccatccatccatccatctattcactcattcatcctttcatctatcaactcatccatgcatccatccatctactcatccattcgtctctccatttatccatccattcgcccacccattcttccatctatccattcatccacccactcatccatccatccatctgtccacccacccactcatccttccatccatgcatccatgcctccacccacccacccactcatccatccatccgtccatccatttatccaccagcccactcatccttccttccttccacccatctacccacccactcgtccatccatccatccatccgtccatccgtccgtccgtccatccatccatccattctttcattagtgaatgaaaattctcggccaagagcagatattataacagagtgtcaggaattgtgttagtttctggaaataggaaagatgcttttttggatcaattgttctacaggtgggctttcagaggagtttctgtatatagcataaagagttcctcagtagaatttttgagacttgccatgtaattccacagaggcatttactaaatcttcctaaagtatctggattgcaagggttaatccactcactcgtttaagagtgtaactgaagatggtaactgcaaaaggcataaaatgagcctttttatgtcctactctaacaattttcacccctggtcagaggcatctgacccagtgaagccagaggctcctaagtaactgttggaatgatgtgttaacagtccatagctgccaaataggagacccatataaaaggccaagcttgaggtttggggctccctaagccaaacatgtgacacgagtaatgaggtgtttagcatttgaaagggactggcagccctcttctgggtaagtggaaggagaggcactggatcccattctttaggagctgtgcttctgtaaaacagaagttggaatccaaagccagtgaaatatgaattaaagaagatgagagctgcagaaattttatggagaacaaagataatttaatatttgaagtgagtggtggcttttgggaaaatgatgaaaattcattaaattgatagttcattaaattaacagatttgaatgtgtactggtatttgcccttttatttatttatttttagagatggagtcttgctctgttgcccagattggagtgcagtggtgcaatcacagcttgctgcagcttcaaactgctaggttcaagtaattgacccacctcagccttccaagtagctgggactataggtacacaccaccatgcccagctattttgttttaatttttatattttatagtgatagggtcctgctatgttacccaggctcatttatccttttaagatgagacatctatgtctatatttctgttccttttacaactttcaagaaagatacaagacgccctgtatcttccaaatgtgacagcaaatatgtcctaatataaggactaaataagatgataacttttagaaaattcagttttcagagtaaactttttacggatttgtaaaatcttcttgctcagcagtgtcggttctcacatgggtggttgggaaatactgttgactgatttccataggtatttttagggctgctggggtgagtttataaacttattcaactcgtcttattggaaactctcttttgattgctctcaaatgttttaaggaaacatttcatgatttttaaaaaatagatttaaggggtagaagtatagctttgttccatggatatattgattagtggtgaagtctgagctgttagtgtaaccatcacctgaatagagtacattgtacccaaaaggtaatttctcatccctcacccccctcccatcctcctacccttctgagtctccagtgtttattattctgttctctgtctatgtatactcattgttcagctcccacttataagtgagaacatgcagtattgtactttctgtttctgagtttttcgtttaaggtaatgacctccagttccatccatgttgctgcaaaagatatgacctcattcttttttatggccaagtacttttccgggtgtgtgtgtgtgtgtgtgtgtgtgtatcattttctttatccatcaatggatattttctttatccattgatggacacttaagttgattctatgactttgctattgtgaatagtgctgcgataaacttaagagtacagatgtctttttgatataatgatttgtttccctttgggtagatatccagtagtgggatttctggatagaatagcagttttaattttagattttttttatattgaaaattaaattaggccaggtgcggtggctcatgcctgtaatcccagcactttgggaggcctaggtgggcagatcacgtgaggtcaggagttctagaccagcctggccaacatggtgaaaccctatctctactaaaaaataaaaaaataaaaaatagccgggcatggtgacgggtgcctgcaatcccagatactctggaggctgaggcaggagaatcacttgaaccccggaggcagaggttgcagtgagctgacatctcaccattgcactccagcctgggcgacagagcgagactccgtctcaaaaaaaaaaaaaaaaaaaaaaaaaagaaaattaaattaactggttagttcaccatatctactagactttctttgtccagaatgatatttagttgcatcagaaagttaaatccaccgtaaaagattaaagggacaccattgatcatagtttttaaaatgtccttcagatgtaaggacactgaaggaggagagaatgcaaaaatgatggaagtaggggcagcgttattaaataagtaaaacgttaaagatgactacttggatggctgtgacggtactcaatgtgtaagattcagcgtgtttgccaaaaaaaatgatctgcctctttccttagagacacatattgtaaatgatttaatgtcttgggttgttttgatgtcatgctagggacataaacaacagcttttaagaggcaacaccctcactgcccatttgccaagattctaatctcagcctttcccattcctaaggtgctcaccaaactaccttgaacagcaccatgcactttcatgccattatcaattggggaacatcttccccagtcctacgccattatcagctgggagaaaacctacaatcagtgcttaaagaaaaaaatgcaaacatttgccagactggagaaatgtccatttaaatgttaccgaactaaactaattatggaatgttctaaccatcggatgctgacattccctacctcagcattatacaaataaagattatggttgtttaatatggtgccttgcagccaggtgtttagtattgcatttggtttcttggtatttggaatttttatggtcgtcattacagtaggaagtttcaagggaatcattttatggtatatattttacttcttactcattccttggcttccaactctacaagactcacttacctttacctttgtgaattacgtgcaaatattttcaaacccttctttgtgttctaattgtttttggcttccatatgctacagcagagccaagcagaatagaaaagtaagttttaaataaaaatcagaaactattggatttgccaaacgctttctccttcatttatttgggaaatagtcttgtattttgccaacatttgaaacaaaattctaatgacctttaatacatctccttttcatcacttggctaagtgttcaacatttttcatgtgcattcaaagagagggaaatgttttcattataaaagtggagttacttacatactctggtttctacactttcaaagagctgtaataacagattatggaattctgtaagtagaaaagccatggattctcctggtccattcagccagggtattcactgtgcacagactaaagtggggctaagatattcactgtgcacagactaaagtgggagagaggtggtgaaaagacggaaagagaacaacacaaaaatttaatttttaatctttggaaatttggatctcatagaagcaaagattgcagactatcatacttagaaacgatgtaatttttccaattcagccatctgccccattcacagacactctcaccaacagagtccttcattcaagaatacaggaactcactaccttctgagatggccacttccattttttaacagttttaacgttcctgtttgttctgaaataagatgcctctctggaattcttcttctctgtttcttgtgctgacctttccagcaatactgaatatttttaaaaggtttctgaatgaaacagcttctgatgttttgggtttatcattgtgcctccactctaggtttttcctccatttttccaaattcctctctgagtagagtgcttcccattctctcacaattaggtttatcttttggaacacctaccccgcttgccaatactcatgccaagaggcccagaactggatccagcaccctaggagaagtctaaagatgtagagtggattgggcgtacttttttcccttgatgttcatagttccataaggaagtcagaattgcagtagcttttgagacaatcattctactgttgaattatattgaacttacagtgatgtgtcttttcaggtaattttatataccactaccccatatctaggatttatggatttttttaaaccataaatttaagactttatatattttgctattatgttaaaaatatctatggaaaataccatgtttataaaaatctggtaaaaaaaaaaatagccagacttggtggctcacacctgtaatctgagcactttgggatgctgagtgggaggatcacttgaggccaggagttctagaccagccagggcaacatagatcccatctctaaaataaattttttaaaacatagccaggtgtggtggtgcatgcctatagtgccagctatgctggaggctgaggcaggaggattgattgcttgatcctgggagttcaaggctgtagtgagctgtgattctgccacacttcagcctgggtgacagagcaagaccctgactctcaaaaaaaaaaaaaaaggagaaacaaatagcataaaaaatagtatggtgttggccgggcacggctcatgcctgtaatcctagcactttgggaagctgaggcgggtggatcacgaggtcaggagttcaagatcagcctggccaagatggtgaaaccccgtctctactaaaaatacaaaaaaattagctgggcgtggtggtgggcgcctgtaatcccagctactcgggaggctgaggcagataattgcttaaaccctggaggcggaggatgcagtgagcggagattgcgccactgcactccagcctgggtgacagagtgaaactctgtctcaaaaaaataaacaaataaataaataaaatagtatggtgttggaggatggggataggcttctttatccttttgttgttatttttgggtctcttaatgttgatataatagttatgccctcacagtaagccttgaagccttgaagtcctcggcttattgcaatgcctattctagctgccaatattccagggagctcctgatttcatattcttgttagtcttcacctgatttcccctgtttcaggctctccctgcgttgtcttttcccttctgtttttcctcagtcggcacctgcaggtttttgcttctctgaggttcccattctcacaccaggtgttctctgcaaatataacccatctactgccaggagtgacttcagctacctcccacctgtggccagtgggactcatgtgtctagcagagcttcttctgggataaaacttaatgatggtctacttcacctgacttctgtgtgttctctccgtgtgaattagtaacctgagacaagaattccagtacaagtagtttatttgggatgggttcctggggaagagtggtgggggagtgggaactgagacactaaagagggtgcccaggagagtgtttggtattcagcaagttatccttctgggtaactagaggggaatcttccctgggaattctggaaggcagagtggaagataccccagaattagtctacctgagggcacaggggatggagcatttctgcagactcagcttgcatcagtcaccagctgagagctcttctgggtacactcattcctcagcaggtccactcaggtgttacgggcgctgacacggaactagcaacaagcagagaaattcagtgctggctgttcggtgaagctgagaaggaatgaatgggttctcacagcttgacctcctttcccatgtttatttatatctctttccaaatgtaatgaccttttgaaatatgtttatatgtgaggtctaagtttcctttcccctgtggatcctctagaaatttctggaaaattctgaagcttggggttagggcatgaattaaattccaaagacgtttctggaaagttctgcatcttggggatttgaattggattccaagaaaacttctgaaaatgtctgtgagtccagggtctgaatcttgtgcatgcacacattttgttttgtttcttaatctggtaattttgatgtgctagggaacttgacatgagtttctctgcccctggatggtgagcatttcgcgtcttctttgcttttaaattttgaattcattctctttcccatcacacacacacacacccacacccacacacagacacagacacacacacacacacacacacagcacagcacacccaacacttctcatgtgttggaaaaccttccctcctcctctctgattctgctgctctccctgcctcctttccatttcagtttccctacttcacagtatgtccttggacacatcctggggttagtggaaatgagaatgaagggaatgttgagcctggggagtttgagacactgtaagacagcaaggggtcaggaccagaagagcaggcagcgtgggctggacgcagcttctctgaatgaaaaccagcgagaactgcatcaacaacctggtggtggggacattgcagctgtttgctctggactccaccgcagcatcagagctcgaataatcatgaagctcaggtctgtacccagcccagcacaagctctgacgccagttgttcttttcagctttaacaaatccctatggacccctcctgtgaagacccatcctacagaacctcccatcacaaccctctttgcttgccattcatagtgtcccgcattctccaaacttgggcttcaatccttacgattccatttgaatggttttgtatggggagttaactagaacttctccataacaacatttaaatctttcctttctaatatatatagatatatatatcagaaaagatttaagatatatatatatatattctaagtgaacattgtcactttggggacttagattttatatatatattaacgtattaatataataaatatataattgtattactataataaatatataattatatttatatatgtatatattaatataagttaatacagtgtattaatatataaattaatacatgattaatataaatatataattatatatgtgtatgtatatatattatctaagtgaacattgtcacattgggggatactgcatggactcagtataaacaaccagagttgaatggtttgttgaaaaggaatgagctatgctttctccttcacactgtagcactacattcccacatctatcttaatctattcattatcaccacacatgcaaagtttaatgggaaacatttggagacatttggaggcaataagtataacagatatatatgagctaatagcatatgcaaaatgtccttcactacccaaactcttgttaattgaatacttgctatttcagctcatgaaacagaatatttgagataggattatttggagatataggattatatatatctatatgcctatctctctatacatatcagaaagaaaagatttaaatatatatcaggaaggaaagatttcaattttgttatgcagaagttctagtatacataagtttacatataaacttacgtatatgtaaacatgtatattttacatgtgttcatatacgtaagtttacatgtaaatgcttacttatagttagttaatttttatttattttattttatttcatttttagagacagggtctttctctgtcgcccaggctggagtgcattggtgcgattgtaggtcactgaagcttcgacctcctggtctcaagtgatcctcccacctcagcctctcatgcagctaggactacgggtatgtgccaccacacctgcctagtttttaaaattttttgtaggaatggagcctctctatgttgcccaggctggtgtcggacccaggccttaagcaatcctcccaccttggcctcccgaagtactgggattacaggtgtgagccatcacacctggcctatatttgtatattgatataaattatacatacataaaatatacatgtatatgtaagatacaaagatacaaatatcaaatataaatacatatattttatataaaaatatctgtttaaactactgaataaaagaatgctgcagggactcagtataaacaactagaattgaatggtttgttgaaaaggaatgagctgttgtttctccttcacactgtagcactgcattcgcacacctatcttaatctattcattatcaccacacatgcaaagtttaatggaaaacatttggagacattgcagtaagtataacagatatatataaacagcacatataaaatgtccctcactacccaagctcttattaactgaatacttgctatctaaactcatgaaacagaagttttgagataggattatttggagagtattttcaaatatattttcccttgcttaaataaaaactgagtatctgaccccaggaaccaagcagatttggaaaaaacaattctttcagcgtactttagagatggactttgggcataaacagtcatttcagaatataactttgtaaaactgtaagactttatcaaaggtaccagaacacaggtaatttgctacatagtgctgaagtgaaccagtttggtggaaagttataaagaatgcaacttcttcccatggacaagtacatataattgggttccatgaatagaacttcagtaccaaaggccccaagcatctgtaacataagccagcttctatctaataatgcagcatagtcacactcaataaaaggtgtttctgagatttaagaatcttgagaactgttactatacatttttatgaatactcacaagagagattctgccagaaaatgtttctaggagagaatttagcacatgatcgatgttggtttggcacaagcttttgtaggttatcgcaagtgtcttttacagatgttcctcctttctttgtctttaaatttgtatttggttttcaatgatttaggaagaattacattaattaggttataacaatcacagtcaagaggccactcactttaaaagcatccatttgatgccagtggcacttcaggggggaaatgttatttatattcttaaccgaccgtctttttgtttctgacaattgagcattgcctatcattgcactttcaggtgttttggttttacctccaacaaccagaacaacagacgcctacattataaggctttactcattttccttaattgaaaaaataggacactgttttaatccagtgaaaccatgaggattttatcccctacaatgagaagcacacctcagaatcgctatgctagtggctatggaagtgtgaacaaaatgctgttgcttctgactttggagtcgaataacgaagtgtctacaaatgaaaaccattgctgtttaaatacttggataacataagcctactgctggctctaaaaacgttaagtggattctattcttggggcaagcaaacagataggagagtggttaaccatctgtggactgatgattagtacagtgtgatttagaactagcatgggcattcctcttgtttgtgagccacagtttaaatccagttttgtttcatttcactgacctaaatggctacatctttttcagataaaatttcatcaagttttaaaagtgtcagctcagaaaacattcctacaatgtacaaatggagacatataaatgttaaatacagtatttttctttttcttgtattaaattaggcacctgaggaggcacattaatatttttggtcattagaagactatttacactgcaataaaaaaggggggagggaagcaagcatctttgttcatcccagtttattcagcatcataggaaaagtaactgaggcttcccacatgtgtgaattttaaaatgtgtagttattaaagtgtattcatccattttggcagaaaaaatatgtatacaatatataacccatctccttgcccctgcagtagaacctgtaaactttatttgcatgttggtcaattctatttaagcctataatacagaggtcatcctcaaggtagactgggctgcatacgactatttgcctttgtattaatggtcctcaaataccttgtttgttgattactggttttattttatggttttcctgtttcctgtttcactttcagtcttgagactgctatgttcttgcagctgatggaagctgcaagcccctgtgagttgccaacattgtttgtttcactatgtaactgatattgaatttaatcgggaatcttgcagcgtatctgggaacgtcaccacacccatttttaggaaatctttggtttaaaaggtagaaaccttgcttcctcaataaatcccaaagtaacagtcagaattgggacgtgagagggtctcaccaaggttcctgtgctggcacggagaaggcagagggttcctgtgttctccaagctgtgaacaccaggaggagtgattcctccaagtttgaagggtcatgaggacatgacttgcttttctaaatacccctgggtggacccaagtctgaatcccaaggctactgagtcaattagcattatgcaacaggaagacacagatagcagcagcttgaacaagtaaaagttcatctgaactcataaagtctggaggaggcagtatagggaagatacggtggcctcattaactcatcaaggagccgggcttcttccgggtctccactccactgtatcccatgtgctaagaggggctgttgtagcactaaccttcacatacacactcagcaaagcagaatagaaagagaaaaagcaggaggaggccatccctcctaaccctctcacgctactatccagaagtaacacttgctttcacccattgaccagaacttaatcagacagccactctgtttgcaagggaggctatgaaatattatgtgcatatagggattccgttactaaaatttagggcaaaattactagaagcctttgccatgtgggtctctgtaatggctttcgtgaagggcggaggcaccaagaattgatatgggtttcagtctgtccttgcaggctccagcccctgatctctcccatgtcatgttcctcttcccttcctgaatttctgccctctggatgtctagcttcagcatcaaacacaaaaacaacatcaaagccttacagagactgctcaaccagctccacaagtgtgcaaatcagagctctgtcataaagacctctaactgtatgtataagtatctaataactgtgaatagatataaataggtagatgtatatctgatattgattaatcaatttgtctacctctaggcatatatgcatatatttatgtgtactatattggataagaaaatatatatgcttgtgtctgtgtgtgttcatatgtgtgtgtgtatgtgatgtagatatagactatatagaagacatatagatagattgatatgtcttatatatatgagatatataaaatactgatatctatatatcatatatttctgtgaatctatatatctatatacctgtagatatgtagatatatttacatgatatatatactcaatcagtatactattgatataaatagcatatatataatcatatctatctatccatctatctatatctcctgtagatctagatttaaatatagatataggtatcaatactgtatattcagtattgatattgtagtggtatgtttctatggtggaaccctgactgataaactctccctctaacagctatctgacacccactttttttgttactatgtaagtcccagaatgtaagctctagaaacttaagagaaccttgggaaaataggatgaatgtacccccactaccctcctgcacacaaaaaattgaagctaacccattctatcacctccatgaaatataggaataaatatgaaattaaattatgtaaaataatggtgattcaattacctacacccttgtgtttgtgaattaagatatatctttgcaataatatttccatcttctctccaatgtcagatctttccttttttttttttttgtggggggggacagggtctcactctgtcacccaggctggagtgcagtggcgagatatcagctcactacaagctccgcctcccgggttcaagcgattctcctgcctccacctcctgagtagctgggattacaggcatgtgtgccaccatgcctgactaatttttgtatttttagtagagatggagttttgctatgtttgccaggctggtctctaatgcctgacctcaggtgatccgcccgccttggcctctcaaagtgctaggattacaggcctgagccaccatgcccagcctcgtgtcaaatcttagtagctcagtagaatagtaaggtaagatcaattcttcacatcaatacttaaatacttctcagattaaggactgtgtcttagaatttgagacctcaaaaataccttgtaataactatttctaaaagtccctaaattgtccaggttaagtgttgttttataaaaatatgtgtttgaaagaaaaaaaaagggatttctaatcttttaaaattttcatacagaagaaaaggtgaattcaaggtacatatgttatcaggttttttaaaaaattaaaaaataaaaataatttgtgtttgaggcaaaataatggattgagaaacagtaaaatgtcttaaagaatcatttacaaaattaagactaaattgagggagctttaatgattatggggaatcacataaaagttttcaaaatgtacatgaagctttggaaatgatgtttattgaattaaattgactataggaaaaggaaacctagagataacattctggaaatatgttctgcaatttctgtatttcataaatgaattaactctaaggcaattatgaggaagatgagataaatagtatttttcctctctttatctctttcatccttttttccttctctaagttatagcacctcaagcagagcctcttaaagacaaaggcttcccaaatgctgaaatacttataaagtctgatgggtttgtcttctgacgtttgggatttctttttattttgctttctatagaaaactcaacagtccaaaggccagaataggacgtcttctatcaaactctcaggttttcctgtcttccctcagtatcaaggcatagctttcactaacatttgcaaaagacatccatttaactaaggctgttgattacccaagtgtggcagttgtcagaaaatacttactacataacactagaatcactggaaaccgaattggagttaaataaggtggattaacatagctaatgtgttcaaagaaacatagaattttactctactgcttagacaccaaatttatctgtgaattttgtaaatagacttaattttttataaaatgacctaaactctatacatagtatgtgaataatgggagtttgttatttaatatttaaatgtctactatgaagacagcttttggatgttagccccttaaacaccctaaatagtcccttgttaaaagtaaaaatctgagtctcagacaagtttagacactttcaaagaccaagttggatgctttatgaagacaggaagggatgtcagctaatcagagtgcgagtaaacaagtgaaactatggctaagctattcccgagtgagaactccccatgagaggaaattaaggaattcccctgcttctatgtgaaatgctgctatgtagtgcacggcacaccagtatgccataagatttgttaaagcccattgttgtgctggggaattgtggggccacttacatatgtggcagggtaattagtaatagctaatttattactgatgccagtcagttaatctgggattaattcagaaccatacattttaattattctttgttaaaagtgtatagttatgagtaataacttgggttttaattttctaccccctttctgcaaataaaacctgatgatttgaacacagatatctttcttcagttttcacattattatcctgtcttaatcaagcttaacttgattaaatcaagtattatttgaaatacacacacacacacacacacatatgtacacaatgcaatggaagatacttaaattgtataggctgtggtttgtgataattctaatgatttcatttatgactaagttgatggtatttcagtgcagaggtcagcacgcatcccattgttgttgagtgtgtttggtctatgtgtgtgtgtgtttgtgtgtatgtttctgagtttctcttgagtttgcagtccaatatatggatccatgctgcaaatgcatgagcccattctctcctttgtctgctttctcctgtcaaacctaagaagtctccagggtggttgtgaagccattcactgagcgccagtcatgggccactgcacccattgagccggttgcctgctcagcaggcaccactctggctcagaatacggggtgacaggtgtgtggttgagcaggcttcctcattaggtcctgcaaggacagtgcccctttatcgacagcccttatcagagagggatcagtaaacaggcagatcccgtggctgagctgggcagcattaaaggctccattgggagaggaccgatgacacctgccctcttctacaaagagctcttcttgcgaaggtgacaaaaggattgcatttcaggggaatgaaggcctatagggatgtctttcatccctcccaagcattctctcctgacacattcagcagttcttgactattgagaggaaaccattgaaaatcatgaaagagcaaagggccccaaggcctccttctgtcctgtcctgcctttactgatgagaccttctaagtttccactgctgactcacttgcagtacccatgttctccttaggaggctgcattgaggagaggaaaagtggaaaagggttagttcacagcccattgaaggaacaataaacccatccacagacaactagattgagccctgcacataatatgatacctgctctaatttggtacacagtgagtacagtcccttatcccaaactagaaagagcagaatcagaaagggcgcagggccaagtcataaggtgaaaagaatgtaatacacaggttaaaatgaataagtctaactagattgccaaaaacaatctggaccacttaagcttctgcgtttgataatgatatatggttaatctggcagttttgtccacatattgtggcaaaatgtgcaattcctatagtgaagctaagtgagatggttaacttaatgactgtcactattcagaggtgtcatttattagcttctgaactcttagatgttggagaacacaatttgcaaaacaagatattgagttgatggatgaaagtgaacctgaagaaaatagtctagaaaggctatattcatttagtttctttttacttttgattttcataagttctcatagttgaggatggaaaattaaaaacacatgacattggtaacaatacacagttgttgtacagcaccaaaatattgtagcataccagctgtaacagcagtatgaagccagagctgcttcaaggagtagggctttgatagattatttttcttagattatttttcttctcacataacaagaactcgggatgtaggtagcctgaggctgctttgctgatcatgacttagggccttagaactttcctactctgccactgggaattcttgcatgatgactcctgtacctccgagcttaggtataagatgtaggcaggtagaaactgggtctcaagaaaaaagacacacatctgcaggtctgccttcatcttcctatggctacccccagctgcaaggaaatctgggaagctgcatattttaattggatacattgtcatcctcaacgtcatggttgtgaaataaggaggaaggggagggtggctgttgggtggcatactaaattcaagtgcattcaagtactatagagggtagtgccataggatttcaataggaggacaggagagtgttcacctaatcagaaatgacaccctcatggaggtggaacttaaagggctttgaaatatgtttagagcttctggaaacaaaacgatttttcagagcagatgtaatggggactaacgtgagagacaggaaattgccttataccaaaggcatgaggcaacctgtcttcccagtataaaaaggaaggattggcattataatgaggagaaagctgtcactggaatggaaggtacattaagggaatcacagggaaattataagagcccttgaaagacaagcagaggttcagggctggagagaagaggaaatgaaataagttctcattcaagcttccggcatgagtaggtggggtaaggcggcagcatctctagacacaggaaaaatgaatagtctgttcagaaaaattggaaagaatcaatcaaagggatattagaatatcttgcaccttactagataatagagcaagtttgtgctcacggaagaaaaaggaaatagaactatcaaagatagtcacacattctacgtttcctagcagcccagcagaattgtagtgtggccaagaatgttggaaagaagcagcacatttttaggaaagaggatggttccatttgcgatgcactcaagtagacagagtcaagcagcctaggaactgaggatctaggagcagcacacaggggaggcctgaggtctgcaggtatttggatgggatttattactattattatcattgtaggttgttttctgattacctagacatttttatttgtttatttgtgatacataatgtacatatttatggggtgtatgtgttattttgatacatgcatagaatgtgtaataatcaaatcagggtatttaggatattcgtcaccttggaaatttgtcattttttaatgctgcaaacatttcagatctgctcttctagctattttgacacacacagtagattattgttacctatacttaccctgctatggaggttgctgtcgcagaagggactggatttatttgtaaagggatgaagatggagaaccatagagaaaaccagaaacagagcctcatagacactcagcattaaggaataaggtagtgaggagagagagccatgatgccaggtcagcaacacacagcaagaatgtgctaccagaggtgctgtcttcgtctgttttcacattgctgataaagacatacccaagactgggtaatttataaagaaaacgaggtttaatggactcacagttccatgtggctgggggctggggaggcttcacaatcatggcagaaggtgaaaggcatgtcttacatggtggcaggcaagagagagcatgtgccggggaactcccctttataaaaccatcagctcttgtgagacttattcactatcatgagaacagaatgcgaaaaacccgcctccatgattcaattacattccactgggtccctcccattacatgtgggaactgtgggagttacaattcaagataagatttggatggggacacagccaaaccgtatcagatgccaagaaagcgaaagcacagggtgggcggccaacagagctgaaagagaatgaagaggaaatggcaggaacaggctgctagatctgagcatggagcttatcctcagccctggggaactggtgccagtgggtaagagatggagccatgctgcaggcgtctgaagagggaggtgtgggagggaaggagaggtaacaggctcaggacaagaaaacagaaaacgtgcagcccagctgggagaagtggtaaggcggcagttctttttgttttgcttttcccttaaggcaaaggtgatctgaacacacctgaagacagacaaaaagacctgcacagagaaactgaatagacatttagagaaatgtacaatttctccacatttcctaccagccaggcagatgggtgatgttttgcatgtatgaattatagtgccagccctatggagcagacagttcttactgcacttttttaaaaagtaaagatgattttccccctaaagacaggacactatatatttttcagaaatatgtttttgatattaaaaaaattcttactgaagattttcatggtttttcctgtgtgcataaattaggagtaataccttgtaaactagaaatatggcatcatttaaaaatgtgagcaattcatgaatacgtatttaagcgaggcaaaactcactgtgagcatgcccattcctttttacccccagttgcatgcatgagtatcatagtgcaattagttttcccactgagaaatgcaattcttcatagatactgtctaatgccatggaggcaggtcaggaatgggcagtatttgagggtgtttagcagcacaagcatgtccagcagggtgtatttgtgtgaagtgtttctacatacagagaacgaagcaagtactttatcattttcagaagctttatttttgcttattagttttattgagacagggtcttgctctgttggccagggtagagtgtagtggtgtgatcacagttcattgtagcctcaacttcctaggctcaggtgactctcccacctcagcctcctgagtagctgggactgcaggtgcatgccaccatgcccagctaactttttgtattttttgtagaaatggggctttaccatgttgctcaggctcattttcagaagcattgtgaagggaaagggaacatgtgaaatgggagaagttaccttatcccctttgcagggcgtgggacagaggtgtagcttgcttcttcagtgccccgactctcaaaccccttgggagagcatgcagacaggcaggtccagaggtcatggggagcatttttgggctccgaccccatggcagcatctaggggtgagtgtttacaacttctgaagcccaagtgggtgtgtgttacagtgtgctctttcaacattgccatctgcaggcggcttgtgttaatcaactcaattagaccccctgccttattgcaagggcagagggctttctctgtcctggatttttgccctagtgtaccgaaaaaaattggatcactggtgggcttggaggatgagtgcaaggtgttattgagtggtggatgtggctctcagcaagatggatggggagccagaaaggggatggagtgggaaggtggtcttcccctggagtcgagctgcccattagctggactctcccctgactgcccccagctgatttccccttggcatccatgtccttccaccatccctggcctaccagtgtctgctagtgtgtttttctgctcctctcgatgtccagctgcttgtgtatgtgcctgctaaggtctcttgggtttatatgggtataggatgggggacatggcgggccagagcggtcttggaaaatgccacatttgggcgtgaaaactggagtacctgttcccacttaggcctgagggcacagacctgaggatggagccatcaccagggacactgccttctctacccagcacttccctgccccctcccatattagatgtacccaaatattcatgtttttaaatatttttagctcttaagcatgtatactgtggttcaccattaccaattaaatggaaaagaataactgaatcacttaattgttctgtttaattggggccaaatcatacttctggattttttttgttgttgaagcatccttcatgttgactttgcaagcagcatttttatttcacagaactgtaacacataaacttgactgtgaagtggcatcaaacctagatgagaatataagatgtatagaggtctagactagaacaaacaaacaaacaaacaaacaagcaacaacaacaaatcccaagctccaagactgtaattcaaatgaaaacaaataaaagctgaagaggatctaaacttcatcagaaaaaagaatcaggacctgaaacatacatttgagtttctgcttcatcactaaaggaatttagattttaggatttcatgtatcttctggggacccttagtgctttttatctgtaaaataatgagctggaggagatgatctataaaatcacttcgaagcagccctagaattatgtgatgctatgaaaataaagccatcacttgttgaatgctgcctttggcaagctgtgtagacataagagaaagatgtcagtctgatggatgagaatattaactggtagatctgcagccttgatctctgtgaaacaagttcatatatgtaagcaactagaacattatttctggtttcaacttagaaccatcacacagctgactggacacagaacatttgggaatcaaaatctctgcccattttccagctatcttaatgagcagttacatttgatcccattgagcctataaattgcttcgatttggtcatagtcctaaaaactcaaactagatatatctaaatgtttaattcactcacaattcaaatatattgacattgccttctgtaatgaaaggccatgttgtttgatagtataaacttatgaaagaaacttacctaatagcaaggcatgtttgtgtaaattcagaaaaaggaaagttaaggggtgaccgtgctgtcattttacatgaagatgtatcttgttcccgggtcaggagagaccaataccacgtttgctccttcaaatagaaatgaggcctgtttggcaacttgatgtgagtgctcttcttaacctggttgttgtgttcttgctgtttgtatctcagcagcagtgggcagctggagcctcctgggagaggatttctccttagcaatctctgaagttatacttgggacactttaaaataggcatgaggttaacaaaggaaaatagctataatgttctggtaactagctgaagcatatgtgtttatgtccacatgcagcttatgttgagcaaaagtctcttgcacatttttaaggaatttacaaatggctcagccaggtttgatttgcagaatattctgcttgttgtacaccacactctgaattctatggtgactatttttttcactgtgatatttcagttcttaaccatgtgtctagcacattagacctgtggtaagtatcaataaaagggaaaggggaagagagaaagaataccactttcatgtgtctagtcctctatatagccaaccccttttctgggacctatacatgtccacgtcccaccatgaccattccatttctccctttgttatttcaggcagatgtaataatttctgagaagtatccatctccattgctgttcaggccctacagtccagactcttccctcattgcatatccatggctctgttgtattctgattagcacctgcacaaaaatatgcaatgcagaacgtaaacaggggtgaccatccatgtgtgcagaatcagaaactccagctacctgctgcagcaagggagtagcttcttctctctgtgctctgttagaaggtggaagcagaggctgagattagggagatgaaggatttatagagcacccttcctgttcaatgggaagaagcaacatagaggttgaatgcctcctgaaaaagcatttcctcatcatatttaaaaaatatatatgttacagcgttgtttgtgatgtcatcccattgcaaattgtcctctcttttcaaccccagtgggttttatgagcagcaaccagggacacctttgttgttatttttgaagaaaaaatgtagggagtggattttcagtgctcagatgatgcatggtttgcattcttaatagatattagagcttttaacattcaaatgcactgaagaatggaggcaaagaccttatcagaataatatatgtcttatgtgcttttaaacatgacaagttttttttttatcatggggagaagaaaaaaaagatgtatttcttaaacaagataataggtgccatgtggttcatttcctccttagcttcgcaagtctccagtaatgatggacaggtagcttgtcaaaaaaagcctaatcagtttaatgtaaccaaggcagtctaccctacaggatgacctctgctgcgtccatgaagaatataaatttctttggggttgggagaaaataaaaatacaaataaccatagcaaggcttagaatatcttatgagagtcaccctttcgtgaagcaattgctttctcttgtactggaaattgacatgaaatttagggctaagtgcaaatgcctgtggtgtgcagatctctgcaaatataagcctgaccggaaggacaaattagatattttttaaggtagcagctgaagctggtggatcagagcaatgcacacagacaggtagggacgggtaaaacttaagaacctacagctaagacaggggtacgctgtgtttattttgactgcagctgttgaccaccatacacacattcagaagtactgccaactccttaaaaagtctgggaatgtggccaaagactattcctgtcttggcacagataggtgattgcttgggaaaatatcagaaaaagtcacctccaacatgtaccctgttgggggccttgtgatatacaggagagctggagggggggccatgctcctgatgggtgctaaccgatggatactgtgctggtgccaggaagctcctcccaatctgggactcacctaatttatatccatcaggaacagagtaggacaaatgccctataacgcagaactccaaaccacacactttattttcctttcctgtatagcgtttacccatgagggcttcttttgagcctgtcttgaaaaaaaataaaaattcaagataaatgtatatttatttttaaaaatatctaaaatgccattctaaggcctactcttaatattttggaagaaggctttctctgtgctagtccatgtaatagactcttttaaatcctgattattcttgaattttgagaacatcagacaccaactttatgtggcagtgaagtctttccaaaatatatctctatatatctacacacacacgtgtgtgtgcatgtgtgtatgtgtgtgtataatggtagcaatgttaatatagaaggaaaagaaggagaaaaaccacatggttatcttggtgtatatttaaaaagcataagataaaattcaacatacatcatgatagcaactttttgttaattataaatgtcagaggcttgttttattaattgaaaattgtttgttgatgtctcttatcaatttattgagacatcataaaaaatagaaggaacccacagttctaaactatttctactaaatatattctaaaagaacatgatagcttgtaaacccagtgttgtaggaaacaagaaagaatatgcatatgtgagtctaacagacctgggaaaaatagaatatatacaaaagcgttgagacttaacaatgttcaataaacactcatttaccttatctatctctattcctatctatctatctacctacctacctacctacctatctagctacttatactgtaatgagccacataaccagattttggtcaatgatggaccacatatttgatagtggtcccataaggttataatgaagctgaaaaattccattttcaatgtccattgcttggtgacattgtggctgtcttagtgctgtagcacagtgtattcttcatgtgtttgtagtgatgcaaacaaacctattgcatgtaaacaaactgaatggtataaacaaacctactgcattgccagtcatgtaaaagtatagaacatattattatgtacaggccataatatttgataatactatgttattggttttgtattcattatactctgcttttaatctttatttgatagaatattccatacacttttctgaaagttaactgtaaaacagcctctggcgggtccttcaggaagtatccagaagaaggcattattatcataggggatggcagttccatgcgtgattattgccccagaagaccttccagtggaataagatgtgaagttggaagacagtgatattggtgatcccagccccatgtagagctagcctaaagtgtgtgtttgtgtcttcatttttaattaaaaagtttaaaagtagtatatattacactgtaccatctgggtttgtgtaagtacactctgtaattttcacacaaggacaaaattgcctagggacatatttctcagaatgtatccccgtcattaagtgatgcatgactctttgtggcatttctgaagatacaatatgttgttaaaaccaaccctcaaaacagaggcagtgtcatattttatttaatttttaattttttaatttttaatttttgagggtgcatactcagtatatatatttatggggtacgtgagatgttttgatataggcatgcaatgtgtaatactcacatcatggagaatgtagtatcatcccctcaagcatttgtcctttgtgtgatgaacaatccagttatattcttttacttattttaaatgtacagttcagttattattgactacagtcaacctgttgtgctatcaaatagtaggtcttattcatttttctattcttttgtacccattatccatccccgcttccccctgaccccgcacagtcatattttaatgtcagctggaagttatccttgaattccacaactatttaaggagtatctatttgaacaaagctcatagcagaggttaccaaatattacccccaattatcaaagaattacagtgcacacatttcctaaagttatgcatccagaaagcaacccagattttgtcattgtttttccttgttttgtttttttttttttacataaatgtagtttcttttttaatgaacaattgaacaaactagactgaattaaggcaagtataagtgttacataaaagatggtatcattgttttggaggaaaatccatgccctaatcagtctcaaacgtgagtcaaatcactatggttttcaataaagacagagtcaggatttttttctcactgaatatgtttgtttgttttgtgttagtgttctatttcacctgtgttgagcagcatgctgtatttttccccacgtggcatgatactcctgctgtgtgtaaagacatccaagagaacaacataactctaagtgtttctgtctccagaggggcaaaggtttcagctaaattaatctcttaaaggttgctttgggaaagtgagcatgcctttttaatctgcatgccctgaactctgagttaaggacttccaaacagcttctttgtgacagtcaagagggagtgtagctttgattcctcactggagtagagagcgaagggagagacccgaggaggcttgttacaagctgctgtgaggtgagggtcagctgggtctccctaacaaggtgactgccacgtttccaacaggggtccatcaatgccaaagtccaatcagagctgctcagccttttaggaatgccttttagattttttattttaaaaagaacttttgtattaaagggacttgacattccccaggtagcttataattcaagacagtttgatccgtgagatcattgtgcgttctttaatggagttcagtgaagcataacctgggagaaaagatgataaaaatcacagctggctttactcaaattcagggctggcatgactactttcaggagagtgcaaaaaaaatttttttaatttaattttgaaaattggcctggtgagatgtttatttcattgaataagttgtgttccagaaagtaccatgaagggatcaaatattaacttactgcaatacagtaattatctcctattaacagaaagcattctgaggaaatgtgcaacagtttgttctctgtatatgcccctccttctgcacctgggctcgggaaacgatggcctgtgggccacatctagcatgccgcctgtttatgtgaataaagctttattggaacccagccatggccattcatagacaagctgtctagaacctcttttggatcacaaccgcagagttaagtaatagtgagagagactctggtccacaaagcctgaagcatttattaccgagttctttatagaaaagtttgctgacatctgaaggaccttcatactagccaggatcccgattgagttgtctcttctgttgagttccttcttggcagaatcccgcctggtatctctttcccaaaataccttttattagcctcatgtggctatggagtccttgaaatgtggctaacattactaaagaatggagttttaaaattctatttagttttaaataatttaaatgtaaataggtacatgtggttagtggcaaccatattgagttaatgaaattgtgctttggttgcaccacaaaccaaggaacaaagaagtctggcagtctctgatcacatcgtgattatttgttttctaaatgttttattgtgaaataaaatacacacacactacacaatgtacagaaacacaattataccatttttattcaatgtgtatcagattatttaagatttctattttttgaatttgtcttaatgtttttaaagaaatgtgtataatttaaattttgaaatttttgacgtaatgtagtcacgttccccagtttatttctagtgtcaattatgtgagctctgttttttctttattgctgaatccccttttctgatgcttatcaattttatctctctttgaaaataatcagtgtttagttctcttctgctctattttatttctttgttctctctttgagtcatttccttgagtttattctatttctttaactggttggtttgaattcatagcacaaaaatctttaatgatttttccctaatatatgcattttagactgaaatttctgcttctttttctttgatattatcagcttaactagcatgtaatgtggctttcttttaattatccagcttgaaataggttgatctctctgattctatcaatttatcagtttcataaacctggaaaattctcaaccattttatctttgaatattgtgtgttgtgcattctctttttaaaaatctccttatatttcattcaaatatattttgcactttctcattcaatagattaaatatcaaacgtttctctaatttttctacatttttgttgctctatagttattcagtgttatttctacatatctatattataaaccactaatatcctctaaggctatcttaatctacctttaaacattccattgatttttacatatcaattatctttttttttccattttaaaagttcatgctggtactctttcgaaaatttgcctggtcatttttttggtatattgcttcttactcatgtctcaaattccctctatcgttgtttagacatttaataatacttattttatattctgtatctgatgattctagtgcatgatagctttgttcatttctaatgactatcacacatggcaggtagaagtcgtgcgttttgtaactttttcatggtattttgttttccatttggatctatctctctggaattactaggaggcttggattgggccaatttcccccagggacagttatgtttgctgcagataccttggaacatttcagagttgacacccctttcaacacaatttcttcttgatgcttctgtggccattcggagagttttctggccactcccccttggggcctgcttgtcagttgctttccaggcaaagcatgatgtttatttgttcaaaatcctgtgtgattgctgtgtcccagactcaggcactgtgggcacacagactccagggaaagcagcttggggccagagctggagtttcttctgctcattgtcactcctgtcacttagtggcagagtaacttggggtaacccttggagtctcatttccctcttctgtaaaaataaagaaatgattcctacgttatcataatgtggcgatatcaaaatagaataatttgcaaaaatgctttcgtggtgttataataagtacgcaagacatgataatgtctcccagtgtttatgtgaatattggcatgatttttatgtcagtgattatgactgttatcattaaaagacatggcagttgtctgtggagatgacagaatggggaagaatatattaaaaagaaaataaaattcaatagcatattagatgaagcttttgtactatgtactggggtagacagcaaagggattaatttatgacattggaacccattaaacatcttctttcctcccagcagaaacattttgttatcacccaactttgacatgtgttaatccataacttgctcatcctcagtaactaaataatttagtaaactaggttgatcaagctatttaaccttgtgtttcaaagagatattaaaaagttaatgacatagaagaggaaagacaaaacggtttattaacagaataattaagcatgctaaaattcttatgtaaaaatgcatgagaaaatacccaaatttgtcttttgcgtgtaccaaataatatagcatcaaaaactgattaaaaaatcaagagtaaacaaatgacataaatagtttgaacacacatgtgtaaaaacaatcagatcaccccacctctctcgcatgctctctctgtctctctctcacacacacacacatacacacacacagtcttacactgtctttgatataacatgaactcaaagagacatatgcaccaaagttcaatgtttatttttttcactttttttgtgaaggggaaaaaaataaacagaaaaaaacctcaaattcctattaatggataagtggtaaacttgacgtgtgttcattgttacaatatagcagtcgaaagcatatgaaaaaaagctcaacattactaatcattagagaaatacaaatcaaaaccacaatgagataccatctcacactagtcagaatggctattgttaaaaagtaaaaaaatagcagatgctggcaagattgtggagaaaaaggaacacgtatacacttctgatgggagtgtaaattatttaattcaaccattgtgaaaagcagtgtggtaattcctcaaaacccaaaaacagaataccatttgacccagcaatctcattaactgggtatatacccaaaggaatataaattgttctcttataaacacacatgcacacatatgttcattgcagcactatgcacaacagcaaagacatggaatcaacttaaatgcccatcagtggaagattgaattaaaaaaatgtggcatacatacaccatgggatactatgcagccataaaaaagaatgagatcatgttctttgcagggacgtgaatggagctagaggccattatccttagcaaactaacagaggagcagaaagccaagtaccacatgttctcacttataagtgggagctgaatgatgagaacacatggacacataaaggggaacaacacacacactaggacctttcagagggtggagggtgggaggagggagagtatcaggaaaaataactaatagacaccaggcttaatacctgggtgatgaaataatctatacaacaaatcctcatgacacacgtttacctatgtaacagacctgcacatgtacccctgaacttaaaattaaactaaaaaacaaacaaaaaaccagtataacagttgaaatgaggaaagacctgaagagcatcacgtagagggataaaatgcaagttgcaagacagtatctgctgtctaccggttatgaggtatattcaaaactgcagagagcattatagtgttcctggcaattattatttaagaaaacattacttcaaagaagtgattggttatatattacacgtttgatagtagtcacaactggagaaagagaagtagtaatgagacatgagatgttatcacaaatgacttcatctttacatgtttaatggtgttttaaaatatccaaaacaaacgtgactgtgctgttgttattttggggtaacatgtacatgaacttttgtcttaatgtgttttatacttttatgttttcttttatttaaaaatcataaagcagatgaacaataaatttagaatagactcctagagctaggtgcagtggctaccagtgcatctgtagtaccagctacttgggaggctgaggtgggagaacttggtgagcccaggaggtcaaggctgcagtcagctataatcacacgactgtactccagcttgggtgacagaacgagatcctgtctcaaaaataaattaaataaaataaaaggtagaattaacttagatttcaattaatgcatttctgtttatttttttgccttattttgtaaatgtctataaatacaaaaatgagagctgggtgttgtggctaatacctgtaatcccagcaactcaggaggctgaggcgggaggattgcttgaggccatgagttcaagaccaggctgggcaatatagcaggacccccatctctaaaaaaaaggaaattagaaaaaaataaataacctccagaagataatgttatttagaggaacagccccattgttctatgagagaaaatcgtttcaatttgtttagacaatttggctttctttctctttctttctttctctctgtctgtctttctttctctctgtctgtctgtctctctctctctctctctccctccttttcttttctttcttttcttttcttcacagggccttgctctgttgcccaggctgaagtgcagtgttgccaatcacagctcactgcaacctccacctccccagctgaagcaatcctcctacctcagcctctcaaatagctgagactgtaggcatgcaccaccatgcttggctaatttttgtattttttggagagatgggtttcaccatgttgcccaggctggccttgaactcatggactcaagtgagctgcctgctgtggcctcccaaagtgctgggattacaggcgcaagttactgcgcccagcctagactgactgattgactttctttccttccttccttccttccttccttccttccttccttccttccttccttccttccttccttccttccttttctttctttcattcttttctttctttctttcttctttctttcgagatggagtctcgctctgtcgcccaggctggagcgcagtggtgtgatctcggctcactgcaagctctgcctcctaggttcatgccattctcctgcctcagcctcccgagtagctgggactacaggcgcccaccaccacgcccggctaattttttgtatttttagtagagacagggtttcaccgtgttagccaggatggcctcaatctcctgacctcgtgatccgcctgcctcggcctcccaaagtgctgggattacaggcatgagccaccacgcccagcctagactttatttttaataatctagagagaatatatatcttctcattcccataccatgtaaatataatcaaagcacaactaattgaattgtacaggtgactttttttgctgtaaaggaattgaaccatcagaaattttccggcatatagattagcagcatgggaccctgagtgtggttccagactagcaggctctagcagcattcgcagagtcgcaggcatctgctcaatgcgctttgttcctatggcctgccgtgatgtgcatgcagtcagaaaggaatgggcacctgggaatacaattctccatccctctttacaacgaataatcactcagaattttcaccaaaaagtaggcagtgttattctaatataaaatatctcttcagagcaataggacttgaatattaagaaaggagtagaactttaacaacattagtatcatgaaaaacttaaactgggccaggcactatggctcacgcctataatcccaggactttggtaggccaaggtgggtggatcactttagctcatcagtttgaggccagcctgggcaacatgatgaaaccttgtctctgcaaaaaatacaaaaattagccagacatggtggtgcatgcctgtaattgcagctagttgagaggctgaagtgggaagattgcttgaccccaggaggaggaggttccagtaagctgagattgcaccattgcactccggcctgggcaacagagccagaccttgtctccaaaaaaaaaaaaaaaaagaaagaaagaaagaaagaaaaagaaaaatttcaactgaaaaaaaagtttaaattagctttgttttgagatattgcaaattgtcatatgatgatgatattgtgtccaggataatcccttgattttcttagttctctttttattaggaagaatgatcaccagcaacatataatgtacaaaataaagtacactcctttagtcatttacacatttatttcattgcagttgacatttaatgcataaggctatttcattccttggggtcttgctcctgaacctccatctgcctagagcgatttaaccacatgttgtctatttactcaagagtcatctcctctctgctgagttcaggtgccctactccacccccagttacaatggaccactgagtcctaccattgactatgagaaaggaaacttcatacttagtcacacgcatctgctggaatatgcgcttgtgtgcaggcctgtgtgtacctgtgcagccattatctgcttggggacaggagtcatgttgtattgcttattctatccacagcacttaggacagtgacaaacccatgacagataatcagtgtgaaattctaacatgctggaacaacacaattagtgtcatatacaaaacttgacagtggaaatgggcaacatcaaccaggaaaagttcaacttgttgactcaagacataaaagcatgactgaatttaggtacaggagatacaaaaggttagtaaaaaggatgtgcttgatatttgaaaaggttattattatggtgaaaatatttaaagacatacaaaagtaagaaaatagtgtaataaactttctatcgccaggcttcaaaacagaaagttactaatggccaattttatttcatctatacctttcctcctgctacagtttaaatgattgtgttccttccaaaattcattctgtaacctaatctcaatgggatggtattagggggcggagctttggggaggtgatgagctcatgagggtagaaccctcctggataggattagtgcccttacaaaagggacaccagagagctcccttgcctcttccaccacatgaggacacagagagaaggttctgcctatgaagcagtaagcagatcctcaccagccactgaatctgccatgccttgattttggacttccagcctccggaattatgagcaataattgtctgttgttcataagccacccaggtgatggtatttttgttacaacacaccaagcagactgactccttttccccctttggattattttgataccagctgtggagctcaccttatgttttctgtaaatatttcagtatttatctctagaatgtaggaatgctttgttaagagtcatgtgaatgtgtgactttggagagcacactagggcttttgagcctttatttgagaagggcacagcataacatggtcaacagacagcaaagatggctcttgaaaagtataccttgagtggaaaggttgatcagaggaaagcagtatatttgcattaattagcagaacacgaagtgcattgcttactctgtattcccttgaaaggcttcttcccttctggagataactttcttaatgacaccagacttagcttgcaggcgtggtggctcatgcctataatcccagcattttgggaggctgaggcaggtggatcacctcaggtcaggagtttgagaccggcctggccaacatggtgaaaccctgtctctattaaaaatacaaaaattatctgggcgtggtggcacacacctgtaatcccagatacttgggaggctgagtcaggagaatcgcttgagcccaggaggtagaggttgcagtgagccaaggccgtcccactgcattccagcctgggcaacagagcaagactccatctcaaaaaaaagaaagaaagaacttttatttttctattatttcatcatttctgcctcacttcaagaaacagatatttagtagatgcttagtaaaaatacttctagatgacacactcacttaacttttgggaacatataactgcgaagtattttgagtttctttcaattcccatcatggtgcattgagtttatcacatcaatgtatgatttagctcgaaaggttttatatttatatattcagatctctctatatgtctgtagacatttatatatatatctatatatttcatatatgtatttcaggaatttatagaccacacattcatatatagatacagatatatatatgtgtgtgtgtgtatatacacatatatatttatacgtatatacgtatatacatatacacacatatatacgtatatatgtaaacgtatatatacacgtaaataaatatatttatatatacgtatatacgtatacacatatatacgtatatatgtatatatacgtatatatgtatgtatatatgtatgtatatatacgtatacacacacacacacacacacacacacacacacacacacacacacagagatacacaaagagatacaaagagtctagggacatttattccaggaacactcatggaaaaggaaaaataccagccttgtcagatattagtattaaaaaaaggaaaacatgttaatatggaattttgttatgggaatttttaaaacacagtcaaatattttctgtcactatctctgtacaaatacccaccaaaaaagaaagcaatgaaagcaaagtccagcttatatgcaaaatatggtaaaaatcctctataccagaggtccccaacccagaggtccccaaccctcaatccatctgtggcctgttaggaaccagcccacacaccaggaggtgagcagcgggcaagcgaatgaagcttcatctgtatttacaaccactccccatccctctaattacagcctgagctccgcctcctgtcagatgagcagccacattagattctcataggagcacaaaccctattgtgaactgcgcatgtgagggatctaggttgcatgctccttatgagaatctaatgcctgatctgtcactttctcccatcacccccagatgagactgtccagttgcaggaaaacaagctcagggctcccactgattctacatgatggtgagttgtataattattttattatatattacaatggaataataatacaaataaagtacacaataaatgtaatgtgcttgaatcatcccaaaaccacccccacacccccttgtccacggaaaaattgtctttcacaaaactagtccctggtgccaagaaggttggggaccactgctctataccccaataggcaacattttcattcttctgtgctatgtacattctaagagcttgctctgtaatcacagtggcctgtgcctagattttttttttctttttgagtaagaactagtaagacaatggctaatacagtggaagactgtgatgaattttgtgtttaataaagcaacagatggttggaattcattttaattccttagcaagaatgagtaaaacccaggaaattgttagtattcacctctttaatggaaagtcataaaattagtcttcttccttctggatttggcctcaattacagagtgtgttggattggtgatgtaaaagttactaaacaccatgggatcgtgtagggtgcttaatcagttatattgcggtcctataaaacagcactctcgtgatagaaattaaggcgataaaatagctcaattagctgtctacgtatgggtgtagtagaatgaaaagtagagagaggattcaggccagacacaaccagtggaccttcttcagtcagaaatggaagtttgggatgctggggggtcttggagtcaagccaattgtttatggttcatgagaggagatggggtgacatgaaaaaatcctcagagcttttggaaaattcttcaaaacagtaaaaattagtgaacgtatctgtaatattttactaagtcaaagatgcattcttagactatgattttaaagtgaaagtgatcaaagatgttgataagtcacatatccttattagaaatagaggagaacaatgctttagggagaaaataatgtgtgtccaaggttatgttgttagttaatgaaacaaggactagaaataatttttttccagattctactgaacattctgtaccacactgcctcttctttttctttttttaaaaataactttataatgttactttaaaaggactaaagaaacagtcacctagtctctgtataatttattgcttttcaaacatccacgtgtgaataaaatatatgttttataagaatagtgtattactttgagtataccagcacacactgtggatctcctcaccatgttggcatggcaaatggtataattcattcaactcaacataatttaatgatgtctttaaacgtctggccctgttccttagagtaagtgtgttgagcagagttaaaaacatacatctcaaatgtttggcagtccctcttttctcacaatcattgaataaatgaagtatttacagatgcacagttttttctactcattttcccccttatccatttcatccaacaattcttgttcattccatgatttaattgtattgcctgaaagtagtgacaactttgaataatcattcacactcatgttgagatgaaaatactatctaggagtgagtttcattaatcacaaatctcttttttagtatacaccactttttctttcctatttctgtgttaggcccataattcacactctcactcaaaagagagtagagcaccttggaaatttctgttgggaggcatggcaggtcgacttctattaatagatggttcctgtgactttctctccccagtattactttcagaactatgttacatttatgtacaaggcaaaagggatttttgcagatgcagttcaggttactactgagtcaaccttaaaatagggagattatcaggctggaactaatccaaccatgtgagccatataaaagcagtgttttctccagctggcgccagaagcagaagtcagaaagatctgaagcatgagaagctttggatgggagggaggctttctgacactaaaggatgtggacggacccaagagcagccactgggagctgagagtgaccccagccaatagccagaaaggatttgagggcctctgccgggcacggtggctctcacctataatcccagcacttaagggggttgaagtgggcggatcatttgaggtcaggagttcgagaccagcctggccaacatggtgaaaccccgtctctactaaaaatacaaaaagtagccaggcatgtaatgcatgcctgtaatcccaggtactcaggaggctgaggcatgagaatggcttgaacccgggaggcggaggttgcagtgagccgagatcgcaccatcgcactccagatagggtgacagagcaagatgccatccccccgcccccaaaaaattggtgggacttcaatcctataaccacaaaaaactggattctgccagcaatcccagtgaatttgagcaagatttttccccaaacctgccagcaccttcattttggccttgtgagattctgaggagagaaatttgctcaagttgtagtaattggttatgcaccaaaagaaaattaatagttttctaggggcagacaagatttttaccatcatttaaaattaaaaaaaaaaaaagatgtggaggagaaagaaagagggagagcgactaaatgaaaatgttctactctgttaagttgtgctattggaaaacactctaatggagatgggggctccaaaaagaaaaacgtgtttgtgagcaggggataaaaaggaagagaaacctttgggaagaaataggagagaacaaagaggcccctgccccctgcccaggccttgctgtaggtcagctctggaagacaagggaggcctacagaggaagccgcgtcatcagggaaaagctaggtttgtgtctgggggagaaagtgaagagaatgttcagagaaggtttcagggggcagaggagtttgctgaggacacaaaggaagccggagcaaaaaatccctgaagggttttagaagggagaacaggggaggggaatggaggcaggttaatggtatgtacgagtggtataaaggtataaatgatgtaagtaaagacgtgacctggcaggcgcactcctgctggtgcctgagagcacttgtcctgatggccctttatgatacagtgaaggaagagggattctgagaacaccttagtccctgcagcttctgacagttgggctataaagtgcagttctcttagacaatcacgagttcaacaccgcccccctcccactccagtgtcaactccatgcaggcagatcacagaacaatgtctgggatatcacgggtgcccaggaggtattagttgagtgaacttcaggaagactttcttttctatgtcctaatattaacagtgcctgcagagagaggagtttagaaactgcttctaggcatgttgagtatgaactaaatcaaattaccaagaaagcctcaaaagccctgaatcctgatgcttagataaaacagacatttgggtatatatttttatttttctttctttatagagagcaactgttcatctatgagaatattttatttccattccttccccatccctagcccccaaaaagaatctcgaccctcccacatccttctgcatttgatcaaatgccattttttttccagttgttcaaaccagatagcttggatctttttttagctctctgtgtcccttacactgtataactcctgaacatattttctaggctctgtctttcaactatatccacaggaagccactatttaacacctctacgtttaccccccccatatcaagttagcaaacacacatcataatgcattgtgtgggctatgaagtctaactggtctacctgttcctaccctagtctccccatatagcagccacagtggttctattaaagtgtaagtcacgacagggccctgcattgctttccttctcaatccgaatgaaatccagtccatgtcagcatctactacatgatcttgctcccgctctcttccaggtgtcttttcccatctctttacctgttgttaagagagagagccagccatgctgtcctccaagtatgactgtgctggagggggtttccacttcctgtttctcctgcatggaatattctaccaccagatattttcagggctcacttttttactcccacaaccagagagatttttgttttcttctgattgctctattcaaaatcccaaccacctcatcactctttattcttaaacatggcatgcttttcttcctagctctcattatcacctgccatattatatatatttatctctttggtagttttttgtctctccactttagcgtgtaagttccatgagggcagaggctttttccattgtgttcgttggtatttttccagcttctgaaactccgcctgttatttagtaggtatttaacaaatagtaaatgaatgaatggctttatttcttccaataaataatggccattagaaacctggtttaaagatacagtcacacagtaaagagtggagattttattcatgaacaggaccaataaaatggagaagaaacaaagtgaccatgaaataaccaaatgataggatgggtaaaaagtcactgactatggagctgatgtagaccttcaagatgcaactccttagtctgaagatgatgacagtgagaccaaaggatgtctcatttatgccctttcaagctcaaacaactacattaccacctggccatgacaagaacagtctttgaattgtccaacacagaagattatctctaaaaattagaaggagaagagacatggaggaaaatgaagagtagaactctttattgattggctatttgccagtcacacagttatgcattaggtctttaagtgtgcttatgcaagagaaggtagacacaaatatagagaatagagcagattatcagtcctttcttatggttttcataactgttaaaatatctttctttgtttttaacaaggaatccagggtttgttaatagctaaatttgaagaggaaaaatacattaatgttttcatagcatagttttaaaggaataaacataaatattaaaaataacttaaaatagtagcataacattagggagaaaggtttatttattacaaaaaaaaagagctgaaacactggatatacagtggctaattactgcaccagcacggataatacttcatgaagaaagttttaagtaaagctgaagcaaacaaaaatactttaagacttacatcataaagcagtatagaaagagattagtcaagccaccatttcagctaagccagccgcacttatgctcacatcggatgacatatttacatttgctggtctgaagcaaggtgatttataggggtgagtcatacttggcatctcctgacaatatattgcctcagattaaaatataaacacttttcactgtaattttgaggtgtcttgagcttcatctaaaaacatatttggtgctgagcgaatgaaatccctacacgttctatttaaacaatgttttaaaaatatatcatgttcaatgcattcccctggatctaattgtcagattggataagctaaactaacttttggggcttggccagatcaaagctaagtcttctatacattagaaagatgtgtagctcccattaccactgacattttggacagctactcgctgttccaaacctgccttatctctatttctgtctccacactgcacgagctttaaatggccactggctggtcagtgtctccccatgttgtctactttttctttttcgagtttgaagtagttactttgctacttgcccctctcagaacctcagaattctctcagttctcctctctcttactcccaatgccttccagtggcaaaatcctgctaattatatctcttagatacatgtaaggtatctaaagagataaccttgcttccacttttccaagtcgctgcccgtgatggttaatattaggtgtcaacttaattggattgaaggatgcctagatggctggtaaagtattgtttctgggtgtgtctgtgagagtgttgccagaggagattgacatttgagttggtggactgggaaaggaagacccaccctcaatgtggatgagcacaatctaatttgctgcctgcatggctagaagaaagcaggctggagaaggtgggataaccttgcttgctgagtcttctggctctctttcttcctcccacactggacccttgcttccactcctcctgcccttggacaccagactccaggttcttctgcctttcgactctgggacttgtaccagtggtttccagggggttctggggccttcagccacagactgaaggctgcactcttggcttccctacttttgaggctgttggacttggactgagacactgttggcttctttcttccccatcttgcagatggcctatcgtgggactttgccttgtgatcatgggagccaactatccctaatgaactcccttttatatatacagagatactattggtcctgtccctctggagaaccctagtatactgtgcacactttataacttctctctagagtagtcacgtcagttttctggctgttgtctccactgcagtctttccccactctaatccaccttgaatagaacccaaagagtgaccttcagagagctcagccctttcattgtttctcattgcctggagagcaagactcaaaagttcaagttggcattgattctgcagaccagccttagtctgtactttagcctcattctgcatcctcctgtcccatccccagcataccagccctacagaaatctgtccactctccaattatacctaacaggttcctacttaggagacttccttccagtagggcaacatcttttcagggcctgctcaagccccatttctatgtacagtcatcagtcaatcacagctcttcctcactttttgctttttttttttttttctcagatggagtctcactctgtcgcccaggctggagtgctgtggcactatcccagttcactgcaatctccgcctcgtgggttcaagtgatcctcctgcctcagcctctcaagtagctgggtttacaggcacccaccaccacgcctggctaatttttgtatttttagtagagatagggtttcaccatgttgaccaggctggtctcgaactcctgacctcaagtgatctgcccgcttcggcctcccaaagtgctggcattacaggtgtgagctaccacacctggccaccttttgcctttaactgaattacagcatcatcaaaatcttccctgtaccctgtccgattatgtgttcacccacatctgcagagggctactctgtaaagtgtgcgtgctgtattattcatcattgcagtctacctggtatctaacaaaatgccttgcacaaatgagctgctcaataaaaatatgctgtttctttttgatccagtggctgaggtttatcccagaaaacaaaatgccatatgtctctgttctgtctgatggtattgtggctttaactaatgactggtttaatttgggactagccactcagagaaaccattcattctaaactcaacatctgataatgaatttgtatattctctctcaaatgggttagttccattctagttggtatttttactaaattaattcaataagttgccagtgaaaatatcaggcactgagactgggtgatgatgagaaatttgcggtctgggatactttttgaaaccaccaagccacatcacgtaggtggtttccataggtcgggatagccatgagtgactgacagttttccacttttcattctctttgcttcatgctctgaaaaaatgtatatattggtcacttctctgacccaggtatacccaaggagaggcatatctaaaactcgcacagatcttaagcacagttttgaatacacagtgggttcttcttgattaatcaatttttgactgacataatcccagttaatctttgggatcaaagaccagtcttagtctttgacgaggctggtctttgacaagttaatttacgaatcttcataatcagtaatgccctgttttcatgaacccagggaccacagattttcccttggttttaaaagtcttcccagtaaggtacaatgtgacgttttgacatatgtaagcaatgtgaaatggttaaatcaagctacttaacatatctatcacctcttttaatgctttttgaggtgagacatttaaaatttactcccttagttatttggaatatataatacattagtactgactatagtcaccctgtgatgccttagatctcaagatgtattcctcatgtctttctgaaacattgtaccctttgactaacaactccccattccctctctgcttatccccccacaccatcatctggtacccacaattctactctccctttctatgagttcaacttttatagcttccacatatgagatcatgcagtaattgtcttcctgtgcctgccttaatattaataaaaataaaaatttaaaaagtcttccaaatgcactaaaacctatcacctactttgagctttcttatagcaccttttgtagaaagcccatgtattagttcattttcacactactataaagataccacctgagaccaggtaatttataaaggaaaggggtttaattgactcacaattccacatggctggagaggcctcgggaaacttataatcatgttggaagggaaagcaggcccatcttacatggcagcaggtgagagagggagtgtgtgtaggaggaaatgtcaaacacttataaaaccatcagatttcatgagaactcattcactgtcatgagaacagcttggaggaaactgccttcgtgatccaatcacctcctaccaggtccctcccttgacgtggggattatgaggattacaattctagatgagattcgggcggggacacagagccaaactatatcagcccatatcctctgaagccaaaatttcaacattttactaaatggcagcaaactgaagactatttacaagtcagtatcctagagatgggttaacactttttcctccttgtcatgagcacatggatgtgcaatttccaggaagcctcttttagaagagatcctgagcgcttcccaagcctgcagacgtgtgattcactttctttccctgaacttgaccccacaagaacccaccgtaaattggaactgttctttgaaattgcgtttaacactaaaaggacacgttggaattagacatcatgattcatctttcctgtttgtttcaatgtcaaaataatgataaaatgtttttaacattgaataaagaaaaatacacctcttatagctgtggctcctgtgaatactgtggctccttgggcttctttcttcactgtctctcacaccaaggggtatttttattagagtttgagaagtggtgtcccattgctttgataggaaagttgcagggaagatgtatagtggccctgaggacactttccaccaagtcctttctctcattctaggttatatgtctatggcctccttgctgtgatatgtagccaccgagaactttgttctctctaatggaatgtgtgatggagtgtatatgtgtatatagatacacactacctttagccccagctcatagacctacattttctctttctctttttttttttttttgagacggaatctcactctgtcacccaggctggaagtagcacgatctcggctcgctgcaacctctgcctcctgggttcaagtgattcttttgcctcagcctcccaagtagctgggattacaggcgtgcaccactatgcccggctaattttttgtatttttagtagagacagggtttcaccatgttggttaggctggtctcaaactcctgacctcaggtgatctgccaatgttggcctcccaaagtgttggggttacaggcgtgagccaccgcgcccggcccatttcctctttcttgttcatttattttctgttcataaaagagagaaccgtgagatcccagagaatgagtaatctacacaggaggacagtcattagtgtgggaccctaactgaacacagttttccactgtgtctgaataaggtcccccaaccagtgaatacattaccttatacagcataaagggatttggcagatgtcataaactaaggattttgagattgggacattatcctggattatttaggtgagtccaatgtaatcacaagggtatttataatgaaaagaaggaggctgggggttcagagggcagagaaggccatcagacaatggaagcagagattgaaaggatgtgctttgaaggtggaggaaggggccagaaacggaggaatgttggaagccatgagaatctgaaaaacccaaggaaacggattctccctgcagaggctccagagaaactagattttctagcaccttaactttatttgggtgaactttatttagaccttctggtcttgtgtcttgtttttagccactgtgtttgttgtgattcgtcatactatcaataggaaagaaatacgcctgccaacttgatttcctgcctggggcttttccatgaggaggaaataaacaactgtatttgagccatgcaattttagggggtcacatgttattgttgctcgctctatactactaatagagaacttgcgttcctcttcaactgatactctggagacagtaagctacttacccatctgggagttggagagagagagagattttgatagggtctatcttataagtgtcaactatgtagaatcggagaaaaaaaaagaataataaaaaatgaattcaacctctgagtgagaagacaatcatcaatgaattacaacctcatgagagataaagtataactacttagtggcatgagtaccttgacaaagtaacttagtggcacgagtaccttggtaaagtaacttagtggcatgtgtacctttgataaagtaacttagtgtcaggagtacctttctcttcttatctcctgcctcctgactcttcctggcaactgtatttgtttaagatggtaaatacataattgaataaaaatgtttaaaatattgatgttggtagaaaatattccccatatatatgaaataaaataaaatatttaaattacatctgccttgataaatacctttatcatgattcagtaatccaataccctataattagtggttgctttatgtttaagaaactcaactgcagaaattcaagataagggattggtcactacattgagattctaggtccaaagatttaattatcaagagtagatttggggacagcatttaaactctgcacaatttcccatctccaaacttagacaaaaaatgtattagaaaaaaagtattagtttatcaaatttttattcatataattcagagagaaaaaaagtggttaattttagataactgttttaccaaacatatttttttctttgtaacaaaaatgtaagggaaatttattctaaaattatcttgtattagttttctataccacataacagattgtcacaaacttactggttgaaaacagcacatgtgtgtcatctcatagctcttgtgatctgagaatatgggcgtggcttagggtccactgcacacttttacttgctgtaatcaaggtgtcacctgggctctattctcaccttcgaggcttgactggaggaatcaagtttaggttgttggcagaactcatcttcttggggctgagtgaacgagggccctggctttccactggcttttggctggaggccaccttcagaacctagtggctgcctgcagccctctgggacatgcctctctccatctgcagttcacaccatgtaagtttgctgcctccgagactctaagcagtctcagtcactcagctaagtcttacatagtgtaatcaacagagtggtattccatcatctttgacttattctttgggttaaaagcaagtcagagatcctgcccacactcaaggggagaggaatgcacaagtccttacaccatgggggccatcttagaattctgcctaggccaagtatattattaagaaaggtctctctctctctctctctgtgtctttttccatatatatacaactgaccatttaacacatgggtttgaactgcatgagggtccacttatacacagagtttcttccacctctaagaacccctaagaaagcaagaccaaacctttctcttcctcctcctcctcagcctcctcaatgaggatgaggacctttatgatgaagatctttatgatacatcatctttttgatgatccactcccacttaatgaatagcaaatatactttctcttccacatgattttcttaataacattttcttttctctagcttactttattggaggaataataatatgtataatacatataacatacaaatatgtgttaatttatcattcatgttatcagtaaggcttcctgtcaacagtaggctgttagtagttaagtttttgggggaatcaaaagttatatgcacactttcaactgtacaaggggtcagtgtccccaaacacccatgttgttcaagggtcaactgtgtgtatgtgtgtgtgtgtataagattatatatatatataatctgtactttatatatatatataatctgaacttcttatacttatatataatctgtatcatcctcttttaaaatctaataaaaacctagattcttccttgagttttttaacatatttcctttacctgtttcctatatctattacctatacctctgtgtaatgtgtattaccctatcttaaaaaagtgataaaaaatacatctaataaaaaccttgcctcttccttgagtttttcagcacagtaaatgtttccctggccaaatctgttgaaatcaaatttattctcatagtcagtttcatctttggcttttcattccatgagcgagccccacatcaaccctgcatttttgtgtatggactgcatattacaagagcattgtcaaattacctagatgtttaatgacttaacaagacaaaagaaaacttacagaataaaacaaaaatgataacccccctcccaaaaaagagttagtaattcaaactactactgataatttccttatatgacaaaaacatttgtgagagttgagcagaattgattattcatcttgaaatccagacatttcacaggaatgagctgcattaatctaaatgaaaacacaaaggaggtttttggttttaagttgactgcatctagccataacaaacccatggaaagttcttatgtggaatagttcttctcagtcagacactccatttatgggcacaaggttttagatgtgatttggacctgatgagaaatgtgaagtgatgtatatatgtttgccatgggaagataacatgttttttacaatatacacataaaaaagagataggaatgttgtatgtgtcttagctataactcaaaattaagagacattacctccagggctctttgaacactattttcaacatattgggaatttttcaggaacagatttttccccaacttaaaaccaggactcacatctttgatgttacaccacatcttacttctgctacttgcttctggctcctttttctccaccaatcactctttctcactttcttcatagactcctcttcctcctgcacccaaaacattcatccaaaaacactgtctgtattcccctcattcttctgggcagtcttggtttctgcatcatttttgttatgcataatatgctgtggagtttcaaatttgatgtccgagccctcatagctaccccatgtttcagatactgtggtaggcagaataatgacgtcctccccagagatgtccacctgctaattcctggaatctgtgaagatgttactttagatagcaaaggggaaggaaggttaccagtggcattgagactgtaaatcagccaactgcaaaataaggagcttattctggatcattaaaatggacacaatgtaattataaagatctttaaatgtggacgagagggtcagaaagggtctcagagtgatgcagtataagacgaaattgacaagccattgccgctgttgaagagagaagaagggatcgtgagccagggaaggtagacagccttaagaagctggaaaggcaaggaaatgaattctcccttagagcatccctaaaggaacacagccctgctggcaccaccatcctggccccatgaggcccatttggacttttcatttctagacctttgtgttgtgctaagacactaactttgtgatgatttgctgcagctgccatcagaacctagtacagatgtcagctctctgatggacacaggtatctgttgcatttcaggcatccagtgaattcttccattacctaaattaaaggcactctgttgcctttgtgtctgatctagaaaacacagttgttctttcttccctggacctccacatccaatcagccatccattgtggtgctttttacctcttaactgtttcccagatctgatctgactcatagcgcctctcgccctgctttagtataagtcattatcatctttcatctggagggacttaatagactagcgggcttcattgaatatacttttaactgccttaaaaccatgctatatatagtgattagtaacctgtcccaatcagaaatatgaaactcttgtgttggttctcatcaactagagaataaagagcaggcccctagcttgcatctgaggtgtttagtgatgcacagagctccacctgtcttcccttttatccttcttgacgttctccatggctgtctccatgtttcgaagaaaaccagtttttaattctcctcatagaataggctatttgaagtctccattcagtttcccaaatggttccattttctttgaaattcccttctcatccttcctcaactggataatccccatgatccttcaagtagcccaggcactattatcctcagggaaatgctcttaactctaccactctgagctagtatcccttatttgaattctggtggcaccctttgtgtgtcctctcatcacatttgccatttcaaattaaaactattctgagaaagtgaaaaaggtgctgcctttgtggatcagaatttggaatcattaaactaaattcatttgctaataaaactttctgacattttgagaggttagggggcactttaagagcattaatgtattggaataatagcagagcaatatatatgcttttggccagatagcagttgacttcatctaagaagcgtctcttcttgaagttcacagcttccaacaatggttctcaacccttggggaacattagaatcacctgggtagaccaattaaagcaaaataactggagatgagagacccaggtagcagaattatttcaaagtacctagatgaatctcatatgcagccagaattgagaagcactgcaggagggaaatgctcattaagtggtaagagatgaaaggaattccatctaactggatttaacactcaaaatgtagaaggaggttatactgtagccataacgtcttccttccagcttttgtgtgtggtttgcctgtctgagccagtgttctctttgttcctgctatctttttgtaagctagctcattcattctcctcacattaagtgacaattatgacttaatcatgtctgtgtttattgttagaataggtatctcctttgagctcatatctatcttttttgacattttcgcttagatgtgtcccaaatttgtgtcacaaactgatcatttaattttacctaaaacaaaaacaactcttttcacagttttccagatcttaacaaatggtaccgctttccacccaggttctcaagccaagcatttcagagtcatcctgtcatcttcttccttcaacccccaagtgctgtttgctcccatctctcaagtgtatcccagtagacacagttttgttgttgttgttgttatttgtttgtttgtttgagacggagtctctctctgtagcctaggttggagtacagtggcgctatctcagctcactgcaacttcctcctccctggtcccggttcaagcaattctcctgcctcagcctcccaagtagctaggattacaggaacgtgtcaccacgcccagctaatttttgtatttttagtagagacaggatttcaccatgttggccaggatggtctcgaactcctgacctcgtgatttgcccgcctcagcctcccaaagtgctgggattacaggtgtgagccactgcgcctggccaacacagtttttataatctttaccatatctaattcacacctccatcatttattgcctagacccagtgacaacttcctaacctgccccccaatttcctcctgcttccctacaattcattttccaaccagcaggcaaagcagtccctaaaataaataaataactacattggataaaaagctcacctattttaaagcctttgaggactttctttggcccttggaataaattaaggcagtttaacctggcttgcaggactgcaaattccagtgcctgctgagacattcaaacccatcttgagctgcactactcaagtaacttatttttgtatttattgtagatttctctcattggcaggtatactatgagcacaaggaccttgtcttttctaatgttgtacctctttctgggaaatagcgttcaacatgacttgtttttgtgaaaaaggagaagatggctcctagatgcaccatgtgagatctgatgtatttttttagactatgacactggcaaagtagttaatgagctttagaaaagcatggaatctttctaaacatttccatgagggaaaaataacacggtatgaaactctgagaaatacattttgataatttaggaaatatattagaaatgtaaagatgaaggttatctgtcttttgcctaaggatttacataagggataagattcttcaaaaaagaaaagcacaatagctgaaaatacttaagtgttcttaatcaagtcaaaatcaaggcaggcttcagtcacagcaaaaaccgaggctcaggtggaagctgcaggtggcccctccctgagcaaccacctaactggttttgccaaataagatacactggctgaaagttagaactgacatgtgggtaaatgataaggtttattgagaagctgtctataaggaggagctcttcaagaaggagatctggaaatatgtcaatctaggtgatatggtttggctctgtgttcttacccaaatgtcatctcagatagtaatccccatgtatcaggggagagagcaggtaggaggtgattggatcctcggggaagtttcccccatgctgttcccgttatagtgagtgagttctcacgagatctgatagttttatgaggcagtttttcctgcttttgctcactctccctctcccctcccaccatgtaagacgtgcctgctttgccttccaccatgattgcaagtttcttgaggcctacccagtcatgtggaactgtgagtcaattaaacctctttcctttataaattacccagtgccaggaagttattcatagcagcgtgaaaacagactaatatactaggataaaagaagaaatttctgtgtagtgtaactttcctcatctccctatgaaactcagtaaactccatattgttgattttatttgagagaatcctatgaaatgatgaatttgccttaatggaattccttaagggagctctagtattttgaaaaattccatttgggaatagtttctctttctttaaaatacggatttttttttttttttttttttgtaatgtggacttttgaatgagcgcaatggaatggattttgggaatgttatccaacaaactcccagtgggaggcaagtatcaaaccagtaatccagaaatttgaagaggggaaattaaacaaacagaattactaactactgacaaagactactactaagaagagatcaaagaggtctctaaagaataccgtagaactggggaaaaatactgaaggaggaaataaacttggaatggtggccctgccccagggatgggatttagaccttattggagaggctgaggttgcagtctgccaaggaaatgggtggaatgaggggaaggggttaggtttactgggatgtccgagaggagagctggtccacagttagtgggttgaggctggtacacagagatccaaaaaacaaaagctgctggagggggactactgggtgtcccacgcacaccccccttgaagtcatgtcacaggaacaaaggaagaaccagaaccaggagaggaagcccctttcttcctgggaaagccctctcatactgtctgctgacaaaacttgacatgtgcctgatgccaaaggagaaatgtttaaaggtttcagctctgagcatggggaagcagagcacagaagggtgcatttggaattgaaagacaaaaccttgagaactgacacagggagcaacctaccttctgcttccaggtgcagccccttttaatatcaggaagatctcttatgttgtagggagctgcctgaaatacatcctcctgtgttgaggtacttggggtcattgttaaaatgtaaatatttggggagagatagcattagcactttgtacttcatagtcaaaagggaataataattagtgatgcgacacccccatatgatgatttttaaagattcttttcatataacctatctctggttttctgatgatctcaaagatgagcatggggcaaatggtgtaagcataatttaaggattccacactgctatgcaagttataaggtaaaggcaaaagttccctacgctacaattgctttccttttgggattacttgcagcttttctctagtatttttgctgcaataaaccttctgattgaacctactggcatagttttaccccagaaggagggattttggattctaaaacagtatccatatatttatatacttaaaccccataaaattatttgtccaaattatttttaggacacaagtttataaatctgagaagaaccaaatgctcaaaatgaaataaacataagccaaatattggcccatctcaatcatttttgtaatgaagtatttagtcttggaaaggatgcatgagacagtttgctgttgatattgttgtacttacagcttaaccgtagctagctagctagagacatagatacgttttatatgtatatgtatcagcatatgtcaatatttatacatatgtaaccataatatgtaaccattatatatgtgtagctataactgatagaacatattttaatatattttgtatagatgtcaatctctcatttttacatataaaatttagtttggaactagtatggtcaggccaaaacagacttaagtttcttttagtattaaagattaccagctgggcacagtggctcatgcctgtaatcccagcactttgggaggccgaggcgggcagatcacctgaggtcgggagtttgagaccagcctgacctacatggagaaaccctgtctctactagaagtacaaaattagccagatgtggtggcacctgcctataatcccagctactcaggaggctgagtcaggagaattgctcgaacccaggaggtggaggttgtgttgagccaagatcgcgccattgcactccagcctgggcaacaagagcaaaactgtgtctcaaaaaaaaaaaaaaaaaaagattgccgtaacttgtacatattttatttcagatcatatgaaggatcagatttgctggtgaatatttattgaatgcaatcaaattaatattaatgcaaaataatgattatgtcttttaatatagactccaaattcttggacttcagagtcaggaaaaaaagaccttttaaattccaagtttataggaaaaaataacattgcagacacatcaaagattggtaatttgttaacctgagtaaattctttctgcttctcaaggatcaaaaacccatacacttctccaaaaacatgagcttcagcttcaccagtcttgtcagctctttaagcaaagaaatgctgcttccttcctctccagtttcataagggatttaatagctgttcttatgacctgcaccccattctcatatataacattttctaattcaaagattctggtagacgtttctctctacctgcatgttctagaagctcatctatgtgctttgaaaatctacacactctgcccctgtgcttcacattttgcaaacataattatgtagaaagaaaagaggactctttatttttcaggccataagtctccaatataactcacacttaagaggggcttctcagattagaattctctcaaatgggctcttgtcaccaattttacaggacagctaatgaaaacatcctagtaattttcagaacaaataaagaaagcaaatgaataccctgtcaatgttctaattgaatagttccaactgcgcctgtatctctgggccattcagactttcccagttggacttttgtttctgttccccccccccctcccccactcttgtagagattcaatgcccaccacacacagggtttctttgctgtctgcccgtagggtgggtcttcacagtacggactttgatctggcaaggactggaaaataaaagcttctatcaaaggtgactttacctagagtgagcttccttttacagtagaagaataactgccctttgttatgaacaaaactcagaatgaaaaatagctgtcacctccaactctgcacacttggaggctttttctgagaaatgatgttcttcttagtctactcctaaagacagtgacaagcagctgggaaagtgtacattattcatcgttccgccttcctcactggaaggaacgtgggtgtaggataaataacattattcccagtgtctaggccaatttgggatgctttgcatattttattaatcccctgctattgagaaagataattcatttggactcatgagcactgaactatgaaaagccaagattttccttttgttggaaattttctggtatgtcaaagaaacaaagtaatagaactaaagacatcatatatccaggagggttggattcaggtctcaatttatttgaagaaagattagacaagtatcaactacagtattgttgtttttttcagcaaacgtttaaaaataagtgtgcccctttaggctgttggggttctttgggaatgctataatggttcaattcaggaaggagcaactaatgagaccctgtagttctccgcaccccaacccccgccccagttcccgaatatttgcaattagttaatcttccctacaggaaaccaaaagtttaatgattccttacaggtaattcggcatggggcatgagtgaaaaggtgagttgaaatgaagcacaaaatagaaaacagtggattcccagaaaatcccaccacaggcaaggcacacagcagcatcccacatccccaggatgggaggagttaccaggttaatgtgtttctcgggtctatttttgtaacagcagcccgccatactcagcatgcattccacctctgaaatataattaccaggatgtgaaaaatgatagaattcactgaaatgataatatagcatctgttaagataacttttggcagggttcccagcttttcgttacttaagaaaaataatgatgtgttagtcactgtgagaaaaagaaaactctgagaaaatgttaataatgcctacagtggaaaccatcatatgcatctgagaatatccagtgacgaatttttttggcctttatcagttattgcttgttcctctaaggaacaattttacagtggacaaaaaaaaaaaaaaaaaaaaaaaagctttcttgagtacctagtgcctagttcactgttagccagtaaatacctttatggttgattccttatcatgtagggatacaactcagggaaatcaataaaaagaatttaaaaactggcaaaattatatattttaaagtaatgtgtacataaagggcacagtggaattaaactaggggctaagaataggtaggtaaattttcaaaatgttgctgatgtgtggggatctgtctacaccaactcaagatgttaagtttctattatcatgcactgaatgacatggctctttcatcttttcttcgaaaatgtttaggattaccacatacaatgcaggatgcccagtgaaatttgaactccagataaactggacacacatttaccaaagagagatctgtcatttacctgaattttaaattactgtgacattctctgtttttacttgtgaaatctggtaactctggaagtgttgcatatttatacgtatatgaagctttttggtcaataaaaacaaaggaagttgaatgatagcacagcctatcaactgcccaacatgccagaaaacagtacgatgtaatgtttgggagaaaaaaaaaaacatcatataaggttgggaaaccgtgtatactttattctgtccttgatgattccaaattcaacttagtatattaaaatctcttaagaatccctacactgggaaaactttaataagctgtctttagcccagaattgtataacactattttgctagaaactagagaaccaagttcatttgggagagggtgaacagtacttcttctgtgtgtctgtgtgtgtgtacataatatacctctaggaaatattaggaaatatgaatttgaagattataatttctgcacagttaatttcagcatagcattgaaaaatactgcattttatttctatttaaccaagtgtcttctgaaatatcttagcatttattattggtgaaagggaaggaattatttcatctaccttttgagttattctcaggactcatgcaaaataacaatattattttaaaatattttactggtaaatattggacctttactgaagatcatgcacaatatctacagtgagaaatattactattgataaattaggcaaccttgaaggtgattcaaaatagcaagaaagtgtcaacttgaagactcagctcaaccttgcaatttcactagtgccttagactttttggtattatcatctacacctgtatatgtgctgtataattccaagatgttgtaaataagtttgctcaaatagctttctctacttcttcagtggggtttgaagttcaacaattctgagcgtatcctgtctggtttcatttttgatgctatagtagttaaggatttgaattctgattctgacctacattcacaatttggttttgacatgtgtttgctatgtgaccttgagcaacatataagattgctctaacccttcagctcatctgtgaatgagctgtatataataatgatacctcttctcagaggcttctgtgagggttcagtgaaaaaaatacatgtaaagcatttagccttaataaaaagacagtatcattattattgtgttgctaattactactttatttttgcttgtgatgttgctgctgcagttggagctgtagcaattcaaacactctgtgggaacagcactttgggaactgaggcattttttccaagggttgctccaagaattaaatgaggtgatgtaaaaatatgctgtgctttgacatcaaaggtagaattcttccaaagaatgcctttgtcctgtattctctcaagtacaagttgtggaaggcatggagtttagaagagggaggacggatgataatatcatccaaggataaggaaaggaaatgtgaagacccctgaggacagacattttctatgtgattgtgccaagaaacaatcttgcctccatgtaagctttcattttcagaaacccttatgagaaggtgtattagtccattttcatactgctataaaggtactacctgagactgggtaatttataaaggaaagaggtttaattgactcacagttccacatggctgaggaggcctcgggaaacttataatcatggcggaaggtgaaggagaagcaaacttggacctgctcacatggcagcaggagagagagaagtgccaagagaagggggaagagcctcttgtaaaactatcagatctcatgagaactcactatcaggaaaacagcatgggggaaccaccctcgtgattcaattacctctacctagtctctcccttgacacatgggaattatgggtagtatggggattacaattcaagatgagatttgggtggggacacaaagcctaatcatatcagaaggggttgtcaacagtctcagtttagtccacccaacatttcatttacagcatctacccctcagcacctgcctgtctgatacacttcagtatagcaacccatcttgccttaccttgttttatatttttcttcttcagagcatttgtcgctgtgtggttgtagatttccctcacaagactaagtccaattcatgaggttctttgttttgtccctttgctatgccccctttacaatcatagtgacttgtacacagtgggcactcaagaaataattgttgaataaaagagcaaatgaatgaataatgactgttgaacattggactcaatttacacaagtattagtggaataatttaaccaagaatattctgtcatttctgaacgtgcactttcaagtttctagggaaaaagaaattcatctatttgcccatgtatctatcaattatctatctacgtacctacctatgtatctacctatctacctacctgtctatgaatcatctatcatgtatctacctatttatctttcatatctatatccatatttgtatctatacctacttctacctatatatcttatttatatccacatatgatatgtaaaacagaatgaatgcagagcaatttatgggcaatgtccttcaaagagtaccattttaaattacttaggtacttcatatttacctgtaaaatacttaattctgtatggccttgcctgttgtttgggttatgaaataggttgaaacacagccttgagagatacatagagtccaatccaaggtcatttatttggttctaagagtggtagtttctctaacagaaactatctgcaaagatttgagaataaaattaaacagtaaatccatgagtcagattatcctagtgaatcaaccagaaaggggagccgtaaattcaagtcagagttgggagatttgctaatttgtaactcggataaagtaatttgcagactgtgtgatcccaagatgtggagaatatgtacttggtctttaattccaggaaggattaaaaagagaataattgctttgtatatctgtacaccaggtctcagataaaacacctgcttgccgagaagctacactgacttgcttaggaagatcagtccattgtttgagtaagcatgattccttttacagtgggtgtcccttacccagcaaagctgaatatcaagaatatagatgatgaattataagaacccatggtactcagattgattgtgttaattttgctaatcaagcaatgtttaagagaatgatgcatgattaaaagcttagcacattggctctgtcattccaatgtaaaatatattaggttgctgcaaaagtaattgcagtttttgccattacttaatgttgcattaggttgtattagttgtattaggttgatgcaaaagtaattgcagtttttgcgattacttctaatgttgtattaggttgtattaattgtattaggttggtgcaaaagtcattgtggtttttgtcattaatggcaaaatgacttttgcaccaacctaatacaactgggtaatggatttaacatgaaagatataaaagtattttaccaagttcattaaaaaaattgtaatgagggcaaacctgacacttcataggtttataaattctatttaatttattaagacgtttaacttttaagagttttttgttcgtaaggatatcagtaatttgaatgattcaaatattaattttgtaaatgttgaaaatattttggaggtttttgttttttttttttggttcagagaaagctggcccctgagtcctcagattcacatcaacaatccccatccagaccctttttcttttgaaggttatccgaggtcaccatctgcatcttgccaaagccaggacaggaagatgcattcttgcctggttctttcttccccttcagcctttcccaacacacacccattaattatccttcattgtcccacagtaatttctcagggatctagtcccatctctttattcctttactcgttccctgggatataattacagcctgataaccaggctatgactacggacttatcctcttcccattcattcagaagcagagacaggcaaggctttctgaaatacaggttagacagatcataagatccccagtttaagagccctcagcagcttcccatgagaaccccaaagacatccaaatctccaaatgccagcctggcccttctgcagtggaagcctgggtgtgcaacatttgctgtctttcctattccagtaaactgtatgccttttatgggcaggggagggaaaatgtcttgttcacttttataccatctgttctttgcacagtgcctggcccatgaaatgggctcaggaaaagttgaataaattaatgaactactaactaattatttgcctagctgatagatttccaactttgatcttccagttgtttgtttattcaaataggccagtagttttcagctggaggcgattttgcaccccccctagagatatttggcaatatctggaaacgttttgggctgtcatgtctgggaggaggcacgctactgtcatcttctgtgtagaggccaaggatgctgctaaacattttgcaatgcacaggacactcccaacaaagaattatttggtgcaaaataccagtactaccaatggggggaaccctgatacagactaaattgtaaattaaaaacgtatttagtatttagcagattatgttcaatgtttatttccaacaaaatattttattgtgagttgcccaagcctgctccatattttataaaatgattgtttagtaggactttctttgtgtaatgcatttttatgtctggtggtgaatgtagataatataagctttatatcaatgttccaattagctcgcctttaaacactgaaatacaacttgtattctccatttattctctagatttataagcaaaatagatttcatttctttttcatttgtgttgtacattaaaattaaacctgtgcagaaatattgtcatcctcatagtttttctctttgatgaacatatgtatttgaggattgtgagttagcttacaaaggttgaggggagttcagcaataacaccactaaaataagcaaaaaacaacaacaaccaaaaaaacatggtcgctatcaccttggaatgtagtgttcagtataaatccctaaaccaacaggttaatttgaagtaattgttttgctttcagaaatggagttcagcagcttcgatctatttatctggtgcaagtgattgagaatgaatgggcttggagaatgaacaggttcacacgtaccaggggatggatggagaatcagttattattcaaacagcatgtaggtgacttatcccagttgatccaagatgtatgtgtgtgtgtgtatatatatatatatatatatatatatgtgaaccaggaacatctaaccagtagttctcctggaaacagaggcatgccttacaagggtcacccattcaaataaatgggctagagtgtttgatttgggatttcttttctatgagagctaaacaaaacgcaactactttgtgatttgtaaattccaagtacagatttaggcagaacccagttcttgcttagagcagtcactgtcaggagtattaaagtactacttgtgagtagaggacttagtccatgatttaattatttaggcctccattggtataaattgatgcttctggacttttcatggtttcttctctttgactactaaacctctgttaaatccgtagaataatttcagccattagccagtcttatagctaatatcgttacccaagacatgagtaattaacaagttgaaacatttccatggcattgactcataagtgatgagaataccactggttagctcagtgcattgctttatatgcggcaaagtggaattctgtagatagaggcatatataggtgataaggtttggctgtgtccccacccaaatctcatcctgaattgtagctcccataattcccacatgttgtaggaggcacccagtggaggtaattgaatcatgggggtgggtctttcctgtgctgttctcatgatagtgaataagtctcatgagatctaatggttatataaaggggagttcccttacacaagctctctttcctgtggccatgtaggatgtgactttgttcctcctttgccttctagcatgcttatgaggcctccccagcctgtggaactgtgagtcaattaaacgtctttcttttataaattacccagtattgggtatgtctttattagcagcgtgagaacagactaatacaataggtatgcagatacatatttatcgaggaggtggctttacatttcctttctgttgctgatttttgtgaactagcctaaacttgactaatgttttccctgtgttatatacccatatatataaatacacacaaacacacacacacacacacatacacacacacaacagtgttaacctgacctaccaacaaagtaaggcagtctactgttcaggttgtggttttgctgtcactgttcttctagatatattatacttaaaaaaaaataaaagtttcggctgagcgccatcactcctgtgttcattagttttagagaaacgatagatgatcttcattggatcatgtaggttaatgtgcggtgactgtgggtggtagggtaattacaactcatgaacgctgcaccgtttgggaattcgttagacaaaactatgtggatgagatcttttcatgcctaattcctacagctattttggaatttatctaaggaaattgtcttccaactttaggaaaaggtcagaaagaattaagcctctggaagtctcagggtgtggtttatccctgccttttagaagtgagataaatcccactacttctcagatggagtgagagccaaagtaaagcaaaccagaaaacgtggaaccagattatctgaaaggagccgggtgcataccaacttttttttttttttttttttgacatcaccgtatatttttagttgcttgtgagtatcaaagagagttttgggagaaaatcaactgctgagggttaaggactgaatccagattgaagactttatctaatcatcagcaccttggattaccaaatttgtgtgcatcctttggagttgaaagtaccatgaataaaggcaagaaaaaagagggcagtcaaataaatagaaattggagatcatgtagccaaagctcctcaaacctatgtacatttggactttgaattgtcaatgggcacaccaagatttttgaagctttgactgtctataaggcttggtggcctcaccagcatgcctagttgcactgcatgttattgatatacagcagctggggccattctcctaagcatgatacagaagcatacatttgtgtgaagtggttttttaagcaaagcccacacgtgggacatctctccttgtggctttaagcactgatttccctgccacagtcttagtcacagggcacgtcagtgctcatgttgctcatctccatctttatgtgtattaagatcatgtagacatcttcaaatgtagactctgattccagcagtctgctacatttcttggcaactctcaaatgtgctgatggtagtaattttgtaaccaaaatggggtagccaggctctacccagcctgcatagggcttttgatttaacctaggtttagctgttcatctgctatatttcctctttgcctacattctaaaagatctcagatgagaatttctcctacgctcgtcaagactgtcgtttaggttttgccatcagtatttaggtttcccacaccacccacagtcaccccacattggcctacatcgtccaacgaagatcatgtgtacaccctacacatttgctaataattcatttacaaaatgttttgttatataaaaactgggagaaactaaatttacttatagagaccatctggtaatgcagtagttttgtaattctatttctcatagcatgctcaaattaaggattcattttagagcgtttcttgctatcacactgccacatctcactgctaaaggtagagctaccgatttctggaattttactgctatgtttttatttatgttggacagcggaagcagatttccaaagaggttatgataacagataaattggccaccaggatgctcccatgaatgcctggcacctcacgatgcaaagaagcagtgcatttctttcttttgttgtctgtttccctctccttttttacatcacataattaacaatcaattactatgcatctagtgcctgccagtgactatgattgatataaagacaaaaagacatagtaatatcttccatgccctcaaaaaactcactgtttatgagaaattaagacacatataaacaaaagcacaaaagtgatacatcttggtgaggattaggatagatataatattagctgacagatacaaaagagaaaaagggaggaaaaaaaagggagagaaagagaaagacagggcactgattctgttccaggcactgtgtgtcattctttacgtgctgaatgtttttatccttaaaacagccctacacaataggtctgattgctttcagtttttatcacgtttcataaaagagagaacttgcttttatactcacacagcaaaacaacagaaatgccggaattcaaatccaggcctgtctgatttacaagtcatgtttttaattgctcaggaaccttacctcctatcataaaaatcagaactcaaggcaggatgcctgaatctgcttggagatgtcacaaaggttgggtgagggtacagagatcacactaggaggaaaactggttaagctaacaggactccacttggacaggaagggattgttgaaaagcatttcaccttcagagaggagcctgcagtttgctgtggtgcggcgttcattgattctacagtatgatgtgatgtagggtggacagatccaggtatgcttacaggtctacaccagaacattccttaaatcctttgctgaggagcatgaacttagtccctcaggaggacaccttaggaggtttcacaatgagagatgccattgaaagttgagtgtgggagtacagtgaaaggttgaagctgcacagacacgatgcagttaagcagtgaccgccacagccaggcaagtgccggggaggacttgtacaaggagggctctgggtcagatacagcaatgcatggagagacatgaaagcctatatatttgtgacagtgatatcagattacagtagacttaggagttaatgagggtcaatggattgttgtggtcaatacatgaatgagcaaagtgaattagtaaatccttaatttttttcctgttctaaaattgtaaatatatatttagaaaccctaaactaacttgtaaaatgtgggaaaagaagagttgatgaagttgtttacttttatctgcatttagctaaaaagcattaggaataaacaacatgtatttttggagaaaatatctacagaaattaaaatgcagaattttatgaaattgttggaaacattaagattgcattttttttttttttttgagacggagtttcgctcttgttgcccaggctggagtgcaatggcgcgatttcagctcacagcaacctccgcctcctgggtttaagccattctcctgcctcagcctccggagtagctgggattacaggcatgcgccaccacacccggctaattttgtatttttagtagagatggggtttctccatgttggtcaggtgcattttttgttttacatttaatctagacattattatcaggtagatatctcattgatacacagtgttgaacatttttagtagtaaaataaataattttaaaagttgatatatatagtattactgtattttattggtttagagatatttgaatgctgctgtcagtatatctgaataattggtggatggtagtcaacatttgataagacagactatggtcggttgtcatttctaacataaatctgagcccaaagtctgtcatatgtaagttttatagtgctacaaaggagcaacaacaaatgcttgaaagcattttttataatttttgggggaaatatattgacaagaaatgtaaaattaaaataaaaatttatttcgtgatctcagttttgctaagaaaaatggtattagcttcaagtttaggcttaaaagagtttccaaagtgctggaggggttaagaggaggcaggccagttctccagacagccaaattattttttccaaattaaaaaagtcacagttgggggtatttttactcactataacataaagtctagaagtatttctcgtgtatttgtactttaaattacagatgctccttgacttaagatgaggttatgtcccaataaactcattataagttgataatgtcttaagctgaaagaatatataatacacttcacctacagaacatcatagctttgtctagccttccttaaacatgctcagaacacttacagtagcctacggttacggttgggcgaagtcatctgacacagtgcctattttattaaagtgttgaatattgaaaatctcatgtaatttactgaatactgaaagtgaaaaacagaatggtcatatgagtatgcaaagggtttctactgattttgtgtcacattgtaaagtcaaaaattcgtaagttcaatcatcataagtcgggaccatttataattatttagtgctaaaatatttatgagagagccactctgataaataacacacagagtgtctctgtgtgctttctcagcatctcaattcttagaaacagggttgctagaaatgtgtgtgtgtgtgtgtgtgtgtgtgtgtgtgtgtgtgtgctcacatttatattcatagatagcccaaattcattcccaggagttctaccagtttgaggtccaaccaggacagtgtgagagtgtaccagttaagtatacgtgttgctaaacttctaaagatttttgccaatatgatagataagaaatggtgtctaaatgcagttcatgtattttgctcatttcaaaaattcatttatttgcaacttgttttctctgttttcagtgttctttcccctatagagtttttttttaacatgtgaagaatattaaccctttatctttcatgttgcaaataatttcactcagtctgttttttcttgactttacttacggatattcttttaccctgaaaaatatttcttatcaaaaaatgtactgtcaagtttattgacttttcattgcatttgtatattgagtcatacttagaaaccatttccccacaccaagtttagagaagaattaatttcctttttagtatgattgtatgcatatagatatgtgtttatgtatatgtgaatatatgtttatatatctgattcatttggggtttattctcatgtatggtttgaagtatggatctaaattcatcatttttccagatagctacccatttacaccattcattaaaacatccaacgatttcagttgtcacttttatcatatactaaattttcttatgtgtttgaatctatttctagatgttcaattctatttcactagttttactgtgttttcatgcacccataatgcattaggttcttcatcaatgctttactgtgtatttaaaatctaaaacagcttgacccctacctgagttacccaaactctgaggttaagggcacagaccttgagaatgccaagtcttcccaatatttctgacaccagctgcgagtgtgagggtttcctgaaatcatcctcaggtttgatgtttgctagaaaaagtcacagaattctctgagaccttttataatcatggttacatgtagcatgttaaggatacaaattagagccagccaaaggaagagacatgtggggcaaagtctgaggtatgcaaacagagatcctggtaatcctttccctgtggaatcatccaccttgttatctcctcttggccacaatgtgtgacaacacatatagaatactgccatccagggaagcccacaggaacttcgcagtccaggtgtgtgtgtgtgtgtgtgtgtgtgtgtgtgtgtgtgtgtgtgtgtgtgtatatatatttttttttgagacagggtcttatctgtcacccaaacttcagggcagtggtgcaatcacagctcaccgccatctcgacctcccaggctccatcagtccttcaacctcagcctcctgagtagctgggattacaggtgcttgccaccactcagctaatttttgcttttttgttgagattgggttttgccatgatgtacaggctagtatcaagttcctggatgtccaaagtttgtactggagcttattgattaattggccaactggttgaactcagtttccccttctcctcaccttagagatcaggccgattacacatgatatgaagggtccactattaaaaacaaagacactcttatcacttgagaaattccaagtgtttagagtttatgtcccaggagccagaactgtctgaggatgaggttgatttcttccttcacagccccttctagctgtccacacactttctgccaggggtttttattgctcttcttgaacattgattactccatatgaacttcagtcagctaaactaactccctaaaatattctgttagccggctgcagcggctcacacctgcaatcctggcactttgggaggccaaggtgggcagagtcaggagttcgagaccagcctggccaatatggtaaaaccccgtctctactaaaaatacaaaaattagccaggcatggtggcatgtgcctatagttccagctactcaggaggctgaagccaaagaattgcttgaacccaggaggcagaggttgcagtgagccgagagatcatgccactgcactccagtctgggcgacagagcaagactccgtctcaaaaaaaaaaaaaaaaaaaaaggttttgttgagccatcctactcaagaaaggggatactttttcatttcttaaatctgtgtttgtgtctttcaggaggatttttaagtagacccattctaggttttgcacatttcttgttacatttattcttaagtatgttatcttctttggtgttattgtatgtggcactttttctaacattatatacactaaattatttctttaaggatatattaaggctcttgatttctgtatgttctgtatgttattttattttattttattttattttattttatttttgtatttttaatagagacggggtttcgtcatgttggccaggctggtctcgaactcctgacctcaagtgatctgcctgcctcggcctcccaaagtgctgggattacaggcgtgagccactgtgcctggccaattgtatgttaatttcttccagctcctttattgaattattttattgttttaagtaattgtgttatttgctaaggattattgtttctctaaggtttttcagatttcttctacaaaataatggaaatgttatttctctttttaatttttatacctatagttggcttatttgttctgctttcaatagcaaacacttctagtttaagattaaatagcagtggagatattttgcatccatgcttgcatttatggaatgaatcctacttggccatggcatattattttcttaatgtggcgttggattacgtttgatagtattttatttagtatttaatcaccaatatttatagctgatattggtctgaaaaattattttattattcactggcatactttttagttggcatctaaattatttcatacgcctatagatgtattcaattataccttcatatgatagtaacttgaaactgttatccatgtagatgaccaaagtctcctttagcatttggccatttgacattattattctttccttcttgaattaatatttccttttacttttgtcgaagaatgttcattttaatataataaatattttgaaaatgtttttatgatatcaatatccctctgaaatcatatatggatataaaccgaaaattaaattttttctaattcctaaaacaacatgttcttatatgttaacgttttcctgtgacttatttagaattatatatttttaaattatacttagtaaaaacataactatatacataataaatatgtcctgagacatacatttttatggtggaaaattggggacaggaaaataacaggaaactgcataggcctctaaatacccaatattctcatggtccaatcatctattgttttactaatcaattggggaccaatctattgtgtgcctcctggaatcaatgctactatgtcagccagtcacttgatccagaaattccagcactgttaattaatctgcagtagataagtaccatctggtaattgcaactcacaggagttgaagtcatagatgcttttaccgaagtctagttcactcatgcttgcctgggacaaatgagcttacctcatttaagctctgaataacatgctcctaccacacccaattcgtatacttgatttttaaaattctgactgcattatagtgcaattttactcattcccaggaataaatacatatataatgaaatatgttctttatatagaaaaatatagattgttggaatggattttgaagtttcacatatgtgttttatttttctgtgtttgcttatatatgcgtgtaatatacacctaaaaggttacaatatacacctaatataatttaatatacaactgaaattatggatctattaatataaaaagaaagaacattagaggagaaataattgaaggtaaaattaactttgaaattactcttaattgattcaatagataactgttcaaaataataatatcaacagtatattagattatcatagcttatgggtaagtgaaacaaatgatagcaatattataaaggaagggaggaaggaattgcaaatcctcttctgaactacccatgaaatgggataatatgattttcaggtatatttagattagtgtaactctggtataaattcatggtcaaccactgcagttgtttaaaaagaagaataattgggctgggtgcagtggctcacgcctgtaatcccagcactttggaaggccaaggcaggtggatcacctgaggtcgggagatcaagaccagcctgaccaacatggggaaaccctgtctctactgaaaatacaaaattagccgggcgtgggggcacatgcctgtaatcccagctactcaggaggctgagtcaatagaatcccttgaacccggcaggcagaggttgtggtgagccgagatcacaccattgctctccagcctggacaacaagagcaaaactccctctcaaaaaaaaaaaaaagaaaaaagaaaaagaaaaattgatatgttcagagaggagagaaaaatggacatatataaaatgctcagtttaaaccagagaagagagaaaatgagggaggattagaaacaacaacaaaaaacaagtactacagatgcaaaacagttacgaacttggtagattttaatctcactatatccttagttgttttaaatgcaaatggtctagatacagcaattaaattcagacactgtcagaatgggttttaaaaaaagaagatccaaccatatggtgtctacaaaacccattttaaatatagagacagattgaaaataaagggacagagaatgatatgctaatactaatcaaaagaaagcaggagtagctagctatacattaattacagacagaacagatttcagagaaagaaaaattatcagtgatgaagaagaatgttacattaagataaagtggccaattcgtcaaggaggcataacatgtttaatgtatgtggacctgactcacaatacatgagacaaaatctgaaagctgaaaaatatcaaaatatttgcagattaaacaccacactggtaaataacacatggctcaaaaaagaagtctgaagagaaatttaaaaatacttttaagtatacgaaagtgaaagtaaaacatcaaaatttttgatatatagcaaaagcactatttatagggaaaaatcatagcattgaaatacatatattagaccaggcgtggtgactcatgcctgtaatcccagcgctttgggaggctgaagcagacagatcacaaggccaggagtttgagaccagcctggtcaatatggtgaaacctcgtctctactaaaaatacaaaaattagctgggcacagtggtgcgtgcctataatcccagctactcgggaggctgaggcaggagaatcacttgaaccctggaggtggaggttgcggtgagccgcgatcgcgccactgcactccagcctgggcgacagagcaagactctgtctcaaaaaaaaaaaaaaaacaaaaaaaaaacatatattagaaaagaagaaagactcgagtagctgaagctctattttacgaaacttaaaaaaaaagcagaagaaaaaagatcataaaaaatgagagcagaacacaatgaaattaaaatttaagaaaaatagagaaaaccaaatgaaggcaaaagctggttctttgaatggatcaatacaattgataagcttctagctagtctaaccaacgaaaacacaaagaagacacaaattatcaatgtcagaaatgaaaggaaagaattactactaactccacagacattaaaaggataatgaaggaatattatgaacaactctatgcccacaaatttggtaatttggataaaataggccaactccttgaaaggcaaaatctaccaaaacctgtacaaagagaaatagataatttgaataggcttatatatatataaaagtagttgaatcaataataacttccccaaaattactggtttccaagtgttcacagttgaattctactcaacatttaaagaagaaatatttcaattttctacagtctgtttaaaaaaaggcaaacagaagaaatcttcttaactcattctctgaggccaccattatcctgacaccaaaaccaagtaaagacattacaagaaaagaaaaacagatgcctatatttttcaaagacatagatacagaaatttctaaacaaaatattagaaaattgaatccagtattaggaaattgaatccaataatgtattaacagaattatacatcgtgattaccaaatggaacttattccaggtatacaagagtggctcaacatttaaaaattcattaatgaaaagaaaaatatcatatgattatatcaatatatgcacaaaaattgacaaaatccaaaacccatttgggataaatatcctcagcaaactaggaatagaagggaactttctcaagttgataaagggtatcttaaagaaaaacctttagctaacatcatgcttaatggcgagaaaatatatttactcttaagatcaagaagcaagcaagatgcctcctcttctattcaacaatgtaatggaagttctagttaatgcaataatacaaggagaggaaatataacatgtacagattaagggggaagaaataaaactgtctttcttcacaaatgatatgattatttatgtataaaatctcaaaatcaatgtaatcttgtaactaataagttacggcaaggccacagactacaaggttaaaatgcaaaagccagtcagtttcctataggccaacaataattattggaattattgaaatttggaattaaaaacctaattagcaccacaaaagtgaaatatttaggaaaaaaacctaacaaaatatgtataagagctacacaagaaaaatacaaaactctaatgaaaataaaaagtctaaataaatggaatgatattccatattcatggatagaatgactcaatgtcagttcttccaaaattgatctagagattcaacacaatttccttgataattactgagctaattgcttcataagtcaaaggtagtgttggggtgcagagaataataccccaaagtatgaggtgctttggcatgctgaacatttttgaaataaaggaaattggaaggccttagaagctgccttagaaccaaggactttctaaccctcccttgtttctccccacatcctcaagcgcagggaggggttctctctggaagttccttcctctgactgaggaaaacttcttctgaaagaaatgcagttgtcttaagatgccttccctaggaatctcatcaactaactgggaaagtttaatactggagaagagaaaaaactaaatgtagtcaccatgcccagacagacttttcctctgtttttcagagggcagctcgtagagattacctaagaaactttatctgcataataaaacaatctttgttcacagtggatttctaccccacaccttctgtcataacttataggtcccatttagcttccaaagacaatcatttacaaactattttctgctctttgggctcattcaattccccaaaattattatttactactcctcaaaattgcctacacctcccatttctgtctcctcataaataggatatttaagcctcaaccatctggcccttctttgagtcttatattttatatggctcccatgcttatatacattaatacatgtgtatgccttttctcttattaatctgtatattgtcagttgtttagcactttagagggaagggaaaattccttttgcccctacagtagtttcttattgcaaaggatgtgacaaaaaaaaaaaaagatagattcacacaaaatcactgcatcttacaagagtccactggtaagagaaatggaaatgcaaaagacacttgctccattggagaaaaaaattgtcagtttcatctctttgtctacacattttgaatttgttctcatgttgaaataacaatacagtaattattcactctcatatttatgctatcatgttcagtcttttgaatatgccagatgtcagcaattggcagcccgttgccaaattcagtttgattcctgtttttgtaaataaagttttattggatcatatcccaggttattgatttgtgtatcatctgtggctgcttttgtgctagtggcaagttgagtagctccgaccgtgaccacgtggcttgcaaagccaaatacgtttactatctgactctttacggaaaatatttacagatccctggcatttataatttttagaaaaccttcagcacccacaggaaatgtgtagcagaagtacagctggtttgttaagttcaggactgccctaacagggatactgtagctttgttttaagttgtgctaaagaaagtacaaaaagtatatttatggttggctgtgaagaagactcaaagtaaaacatttttatgcaatacatatcaatgtccgtttcacaatggtttaatttatgctgtaacagtgtgtggtgctaaagttgttttataaaaatcattttattgcaattataattctattatacttaatggatggttgtgccagccaaaaaacctactctactaaaaatagagttttaaagatagaatggatcttagacataattggattcttttttcaagagggaaaatcatactatagaaattaagattttttctaatgaccataccgtgattgaatatcactttacctctgaacccgcctgaacatattcttgaaagaaatatgaaagtagttcaatattggacccagtgtcattgaacccaacctgagggtctacaggcaattttttggtatttgactgattgcctactatatttttccttgttatttttcttcttcatttggtggtaatctaataaataatgaagcatgccctgcatcatcaagatggctaactttccatgtgacccattatgaggtctgctacctttgtctgtgtttccaattgtttggtgccaaataatgccctttaattgttgaaggtagtaaaaaaaagaaccatggatgaggggtgccagaatatgccacctcaaaatatgcctctttgatatatggattattttgagctaaagatcattgagaatcagcagacacaggaaaacctttagaaacagggcacaagattttgtttcatatgtaaatttacatgggtaaagaaaatatccatttgtcaaagatatctccttctccaactatcagcaagagaataattcttttttttttttgagatggagtctcactccgtagccaggctggagtgcagtgtcgcacgatcttggctcaatgcaacttctgcctctcaggttcaagctattctcctgcctcagtctcctgagtagctgggagtacaggcgcgtgccaccatgcccagctaatttttgtatttttagtagagatagggttccaccatgttggtcaggatggtctcgatcttttaacctcgcgatctgcccagcctcagtctcccagagtgctgggattacaggtatgagccgctgctcccggccagcaagagaataattctaaacaactgttatttaaatgatttaaatctgcatgagaagccttactaatcaacccttgcttactacactttacctggtcatctttccacaacttgcctcccccactgggaaacccaaagtcctgtttgttttgtttagcctaagatgttatatcagcccaaatccgaccacaccttagagttaatcatccttgtctgctcccatgtatacatgtgtaaactagaaatacaatcctaaatgcgccaccaattgaatgaaccccttttggccaagaggaccccagcaaaaccttaaaaactgaattactggccatgacaggaaggggagtcaacacacctcatcataacccctccattttggagtttaggcacagcaactgaccaggactgatattaaaatagacatcataagactgacaaagcagactcattgtggcagtaagataccaaattataaataagacctatggccaggccagacaatggttaagtcatgcctgtagggcatcaaccttgctacacagcatccttatcttaaagatgcctttctgctgactccaagtttgagacagagccttgctctttaaccaattacaaattaaagaatctctgaatccacctatgatctgtaagccccctctgtaagctatctcaccttttggggctggaacaatgtataccttctatgtactgatttatatttttccctttaatttatgtctccctgaagtgttaggttggtgcaaaagtaattgtacttttcgccattgaaggtaactgcaaaaatcatgattacttttgcatcaacctaatataaaaccaaactgttaccctgcctcccgggtttttctcaggattccttgagactgtgtttccttggactgaattcactcattggtgcagaataaacatctttaaaacatattagtgttttctttttctgttaacgcatgcacaaggcatgtggtaatgaacttttgtttttctcttgttaatctgtcttttgccagttcattttacagggccccacccagagttcctaagatgagtagagaaagaaggtattattttctcccctaccctgtccaggtacataaatgatgcatttatttttgtgaacaccaaatggcctcaacccaggttgcttgggtgaacttcactgcgtgtatgatgagcagaggtggccctgatggttttgtgcatcactctgctgttggctatgccagaatcagaacacttgcatgcggtagctgcttccacaattatgttctgagcaaccatttagtctcagcaaagcagcagcttccatcacgttcaattactgctaatttagattttattgctctgtagttttgtttgcttttaactgacaaaattgctttgatttcattgtcttataaaagctaaagatctatgagttaatcatttgtatttgtatctatatatattatgtatataaatgtatctacatatatacattatgtatgtaaatgcatctacatatatacattatgtatataaatgtatctacatatacattatatagaaatacaaatatatatacattatatagagatacaaatatatacacattatatatagatagatgtagatatatatatttatacatatgtacatatcaagaaggtaatttaagtcaacactagaagtcaaggagactgtttcttttatcattttttgatgtttgatttattttacaaaattgtagaacatatacatgacataaaatctaccattataactatttttaagtgtacagttcagtggtattaagtacattcatattactgtgcaactatcactagcatccatctctagaacttttttcatcttcccaaattgaaactctatacccattaaatactaccttctgattctcccctctctccagccctggcaaatatcattctgctttctgactctgtgaatttaatgtcttgaagtacctaatatgagtggaatcatacaagtacagcatttgtccttttctgacaggtttatttttcttagcatgcctttccctttgcaggacatcaaagcaatgcacatgtttgagaaagtctgtggtctcctataaagcatttacacctggctcttctaagttaacttttgtcacacatgcacaggaatgtgtgactgcctgaggaggtggattgcagatcacgctggctgtaaatagtgggagtatttccatagcctagcaatttgtggggacacatcaactgaagtagccctgccttgctgtttttacttaatttagcaggagaggtggggctgctgaaatttagcccctctcagggtgggctatcaggtcagatttcatatttgtgtcatgtgtctctttgttctataagcctttagttgggtttggctctggaagctcagttgcaggcagactgtctactccagctgccaaaaatgagcaggctcccttgtgttgtagcctgggctccttatagaatcttggtgtgatgtgctgccagggctgtcctgctgagagacagtggtgaatgcttccagggcacgatgtcccataatgttctagactctcatttctgctgaccttttattacatatgataataatgatggtggtgcctacaatagtggttgatattttctagaagaaataatacatgtggattgattcctccagccacagaagcatggtttcctctttttagactattagagttcattcaaacaacatgtgattgggtcatgtattgttcaccagtataaacacagcacctatatactcggattgcctctcttcttttctggttgccttgagacaattgaaagaaactacttggtgtcagggccattgtaaacactggtaatggccaggtactgattgatcatgatggaccttgcataagctgttattacttctataaaccttaattaagaagggggtgtattagtctgttttcatgctgctaataaagacatacctaagactgggtaatttatataggaaaaaggtttaatggacttacagttccacatggctgggaagcctcacaatcatggtggaaggcaaggaggagcaaatcatgtcttacatggatggcagcaggcaaaaagagagagcttgtgcagggaaactcccatttttaaaaccatcagatctcatgacacttactcactatcatgagtacagcatgggaaagacctgtccccatgattcaattacctcccaccaagttcctcccacaacacatgggaactgtgggagttacaattcaagttgagatgtaggtggggacacagccaaaccatattagggggaataaaaagtctcttcttcgttgcaattttttttttctgctctaagctgattttgctttgagcactgtgagacccatcatttatttcccattgatgcacatataatattttggagtaacttctgaccatttttctccttgacctctcttctccacttattcaccaagtccaaaagagtcttcccgctaagtgcatcttgtagtgatcactcttttccttctccttacccataggctaatcttttcattagactttggcagtagcttcctagctcatattgtgttccaccttcacccccctcattatacaacgaatggggttatcttcctagattcaactctgctcaaaacttctgttggtcagatattgtaacaggtaatatttaaggccctataaaatgtggccattatgagaatttctgttacttgccacgagaacacacttacgtgatttttctacttcaaacctctcatagccaaactgtcatcttatgtacatatattgtctgctgattcatagaacctcaaagctctgtgtgaagcagtcctccctgcctccctccttcctcctttccttccttttcaatcttacccctcattctctatgcaccaacaacactatcttcctttgtatctgaatacactaagcctctcactgctcagcatcctttgtagacagtgttccctcttctggcaaacgcttctctaaacctcttcacatggcttcatggctgctgcctttttatctttccatttgcaaatgaaatgtcctttctgtagagaattcatggattctatttcttgcaatgccttggtaaaagcagcctcccagaagtttcatgcaacaattctgtctacagcccacttgtaaacacaagaaccttcaggctttttctgctcatgtatggcaaaaattacatactccacattttttgtctactacatgtgacaaatttaccaaatgtttttaaggtcatcaggtatctagcctaaaatatcagtgtctttgctgcctgctcctaatataagcaatgccacatttttgttgtaattgttattgttatttagcaccatacttctgttatcattttccatagaggttaggacataagctaaattgctgtaaaactgagatccaaaaacatggtagtgcaaacaagataagaatttatttctttctgacccaattcagccccaactctgtatatagttaggctttgttctaggaagccatcgagagatagggttttttggcttgttctcttcctcaccaataggctgcctgctgcagagtgggtattttatttctcattcagcctcatctcacctagtatttgttggtgcttgtccccatccagggagacttttgcatccaacttgacatatcctgcctgcactgatttcaacaagagctcattgttttagcccttcatggaggaccttcagttttggggagctgacctgtgctgacttagctgagacctgcagatgcagataccttctctaggcaccttcctaccacctattgacagttactctgatagcctttcattacacattgcattttgatgttacacatttttcccttcgttttaccaaagatgaaatttgtgtttctgcttcttatttgcctaatttttaaggggtgatttccaaggagctctctggaagtcaggtgaggggggtgtaaataatgtgaagtgcattatttctctgacataaggtaactttaaacattgaactcactggggcactgaggccataatgtataaaaatttaagctaaacaggaacagagtacacatcctaacaaataattttaatttttcttatttctacatatggtgtaaggagcatcaattatgcaccattttagatgtgacctgttatttaatctgctccagatatgaaagacaaaaggaaaaatggtgacttagcaaagttaagtaactgtgatggttaattttatgtgtcaacttgactgagccacagggcatccagacatttggcctaacatgattctgcatatgtctgtgagggtgtttctggatgagattctcatttggatccacagagtgagtaaagcagattgtcctccttgctataggtatggcctcatctggtcagttgaagacctgagtagaacacaagggctgagtaagagggaactccttctgactcactacctgagctggaacgtggatctggaacattggtttctggagttcagactcacagtgaaatattggctgtttggggtcttgaacctgtcaccttgtggactagaaattacaccattggctttctcaattccctggacttgaacttgaactgggctctcctgagcctcaagcttgctgactgcagatcttggaacttctagcctccataattccatgagctaattcctcataataaatgtcttcacgtataggaatgggatagataggggcgtaaaggaatatcttaaggaattgaaatgtccaatatttgtatctgagtgttggctgccctggtagaagcatttgccagaattgattgagttctactgtaagagtcctgtattttgttggattcaaattatgccccagtaaagccttattaacatgtcaagaaaatcacacaactagttaatggcagagattgcattacagcagatttctgtgtaatctccaagtgcatactctgacctccatatcacactaacctgcacagtgggaggtatatgcagtgactaatagtgattaccaatatgctacttagaaacctttcagggttcatgttttctactccagcatttcttattaatttgaattatgagttcgtatttagttagacaggatgatcgattgagattggtgtttttcagtgcattgcatttattacattccatcaaggagtaaggagatggcacacaactgaattctccaggtaacttaaactccagtgtaactttttcattgatcaaataaatgagctgttagactggttgtcatgggaaatcttttaacaagagtgatgtatatcccctccttcagggtataatgattattatggagccctttgcttgactgccaatgttgtgaacttcagctcttcccttctgctgtgtgtcttcgtataggcagacagatagctataccattacaggcttacattcagagtcataaggaggcgaatttctttttgttcccacacaaaatggcaatgagatggctgagttttatttttttttccctctgttttttaactggcagaacatcacttctcagttttcaacactgcccatttttctgacctccctgcttagttctcctttctacccagtttattatctcttatagttgcctgtataatatcaatgcatgccattacggaaaatgctcagcagtcataattagaagacacacactgatggaagtccttgaatggtgagcattcctttctaaatttgtaacagctattttacctgaatgcatcatacgtttttgagaaccagtaggtttgttggagatcataaattttccatgtatatctagtggaaaatggagaagtgcaagcgaattacggcatgcatcagctgaaaaagcttttcgtattttgtgtggcgtgttttattttgtgtgtgtggcatttggtggtttcctatatgactctaagccagattcccattggctttcagaccctttaggcaggcttggtacgcagtggggtcttttccaggaacaaggttgcatgatggactgatctataggaacctcagagaatggaaaaatcagaaagaaattgggaccaattcaaagccatagtctttcaagagagggtagtcctcagtaaattaatgtttcctgattcaaatctgtctccaatccagggaacttggacttatttctttgatttttacttttaattttaattatttcttttcttattttttttagaggttgggtctcacttgttgcccagcctggagtgcaatggggcccctatagctcactgcagcctctaacttcagagctctagcaatcctcccacctcagcctcccaagtagctgagactacctgtgtgcaccaccatgcctggataatttttaaattttttttgtagaaactatgccagccaggctggtctcgagcttctagcctcaagtgatccttttgccttggcctcccaaagtgctgagattacaggcatgagccattgtgcctggcccatgaacttgtttctatggaagagaaagaatacaagtctaaacaaaacagcagcaaagtaaagcaaagcctagcattttgtgtggcatgttttattttgtgtgtgtggcatttggtggtttcctatatgactctaagccagattcccattggctttcagaccctttaggcaggcttggtacgcagtggggtctagtatggaaagaacaaggatcctcgttccatttcagggcagagtgaagctaggcaccccatttcgaagcctcagcgtgtggtgcaagtgctcacttgaacatgctgcatggtagtgcctgagtcagaggtgtccgctatggtgttgggaagaccagtatcacacctttgcaatggaatattttagtgtgtacagcagcatgaaatgccataatgataacccatatttattttttgaagatgatgatgctttctcttggttttactaacttcttacagagttgcatgctgtgatttcaatcaacaccatgaaatctacacatttttgagaaagttattgtaaaatactggactaattgttgggaaaagttgggaaaatcctgctgattccaccaaatactgttgacctttagcaaatagctggttcactttagatttgaaatcatatcctgccagcatagctgaaagtttgctgaaggaggccaatacatttggccaaagaatcagaaaccactagtgtagcagaaacagaatgaaaggcctaagagttaattccaaatgctcggcaacagcgctaccaaagttgtagaatgatggccagagtgtcatgttcttgctctgaggaatggtttaattgaggtatgaggcagaggcacaattttttcaggcacaaggaattgggggtacaatgctccggtttttttttttcctctttcctttcacttattggaggcagcgtgcctagcgagagcatgtgttctagtctgaccctctatgctctaagttttacagggtcacattcccacttaatatgcggggactgggatggtttaacatcgctcttgattgggtgggaaaataaattcttctgggatttggatttattctgtcattgataagacacaatagcaataaaatgtctatgtagaaataactagttcccactgaaatctactgagatccttaggttcctttggggaaaacgggtaatttttttgagtttcttcttctgtaaaagggtgtgggaagagggcttctccctgcataagtttcagatttgttaaactttctttagtggagatgctgtgtacattgtttacttctggttgttgaaatagaaagtaatcatgggcatacgatttccaatgtgaatttcaaataattttaaagatgagtcataaaaggaattttgttactttctggtaactggcgtgatctaacaacaagcaaacattagctaaatgaaaaatgcatccattcattttgcccaatgggaataatttatttatacaataagcaaagatactgcttttcttgtttttaaattttgatattaggctgatttattttttcttctttggtgtctaaaagtctcagaagttgactgtagtatttatttcaaaggtcattatggtggttgtctagccaatttggcatctcttgtttcttgtatattcccagttgagtctatgatgtgaatttgattctatgatgtgaatttatgacttatttatatggttttggacagttttttttaacaatggtaattcaaacttatttttaactgtgcattttggttttggaaatttcccatcctgtcttgacatttggagatggattttaataatttacatgtgtaaacagtagaaaatataacccatttgtgaccaccaagaataattccaggcaccaaggagacattggtgggaatatggagtctcctgtgcactctctttgcatttccacaagaacacctattagcacaaaactcctggtcactctgctttgcactcactagccccccaggtggacagactcctcgtacctactgtgagcttgggacaagcagtttggagtacatagctctttcttccctcttaaccttcacttccgggatgcaggctacccagcaagagcatgtgttctcatctgatcctctgtgatctatgttttacacggtcatatccccatataatgtggggtgggtgggatcacatagcactgcccttatttgggtggggaaatgaaatctccttctcagatttggttttagcccatcattgataagcatcccatgcatatcttctaatctagccttcatcggccataaaggtgatagttaacctttattgccgatgaaggctagattagaagatatagtttagatatatagtttcttagtcatttccccaactgctttgcagaagacaaagaagtgtgatttgagaaggctcaaatactaaattctagcactttatctgtgagccttgaggaatagacatggattggaatttgagaccacaccatgaagaattgagggaggttttgagtaggggttgggctcatggcttcaggccttgggatgaccaagtggcttggctagagttgaacttttttccctttggtgggccactccagttttggtcatactgatcgtagacaaatgttttcacagtgacaggttaccttaggcagaccttccagagaaaaagaagaaagagactagcctgagcatgcatgtatgggattcagcaaagatgcgagtcttgggttgcaggaggaggcagcttcacattggatcacacaggccttaaacatacaaatgtctccacagctactgggaggcttgaagacttctaagacatcatatatgaagaaaggacttgattccaataaattatatatatttttaatatgctgaattctcagatcttacggggtgaaaattggcaatcttgtttgtttgtttttattgaggcaggatcttgctctgttacccaggctggagtgcagtggcatgatcaaggcccactgcaacctcaaccacccaggctcaagtgatcctcctgcctcagcttcctgagtagctgggactacagatgcacaccgccatgctcagtgatttttttttttcttgtacagatggagtttccctatgttgccaaggctggtgtcaagcaattttcccaccttgacctcccaaaatactgggattataggtgtgagcccctgtatctggcctcttttgcctttttttctttaaaaaaataaggtgttttatagtcaggatctcctgtcaggacttgaaattgcattgagttcaattgtgggactgtctgtgtttggaaccacgtaaatatgtgaactttaaggtttcctgaaatttatttttttgtcttgatttcttaatttttttaattgatatatgataattgtacatatttatggggtacgtagtgatatatatgttatgtacatatgtatagtgatcagatcggagtaattagcatatccatcatctcaaacatttatcatttttgttgcgttgggaacattcaatgtcctcctcctggctatttttagaaactattaataacaagcggtcattagcagaagaataaaaaatagctgatcaactctactgcatttgaagttgttaactgcagttacccaagtaaagtatggagggaaagtctcttgaattatttcttcaggttattaaaagcctctcagcaccatatggactaagttagttttaggtttgaatattatttcagcttataaaatgtctctaggtgtcaaaacccaattgtagcatgacctgtggcagagtggtagattttaataagtgaatgcatgaattgaaatgaaatgacatgtcatttctataaaatgactatgttatcatcttgattgaaggaaataagagaaattagtcaacttggtcattgcaaaccagaataaggcaaattaaaggtctttgtctgaacagttctctgggaatcagatttgctcaggaaaccagggagtaactggagagttccagaatgcatgcttctgtggaaactctggaaaactcctcaaaaatacattctagaacaccttagacaggtggaagctgggtcagaaagcacaagagaataaaggaactccagttcagcacttaataatagttccttcttgaaggaagattgatttccatgcaagctgagcttttaaaaactcagccaacttttcagaaaggacatagaaagagtagaggagaataaaacattagaatctcatcccactaatggagaaaaaggtaaagcccaaagaattgctactcatggtttagaacattcaaatgcagaaaaaagtcagttatgagtagaacaagacagaggatgcagttgtccacagactgctagcaaaatagctcaaaaatgattatcactggagcttatttagatttctgctgagggtgattctccagtatgcagtacaagaaacctgagtccaggtttgggtgggctgaactctaaaacttttggagcccacaatatgtaattattacaaatttatttttaatttttttttttttttgagacggagtctcgctgtgtcacccaggctggaatgcagtggcaggatctcggctcactgaagcctccacctcctggattcaagtgattctgctgcgtcagcctccctagtaactgggattacaggcatgcgccaccactcccagctaatttttgtatttttactagatacggggtttcaccatgttggccagcctggtttctaagtcctgatctcaagtgatccacctgcctcaacctcccaaagtgctaggattacaggcataagccactgcgcccggccagaaaatattacaaatttaaatatagaaaatgaagtaagaaaattgcacagctatgtagactcggaaaagaaatcacaacaaaatgcaaattttagaaatctgacaaatatcagaaacatcaaatatccagaaaaaaagagacaataatgtcttaattaactgctaaacttccttgtgtaatactttttcattttattgcttcttcatatgacagaataacatttatagtaccactgttcataaagagacttgaacaaaaattcttgctgctagcatttaataatttatggctgggtgtggtggctcacgcctgtaatcccagcactttgggagactgaggctggtggatcacctgacgtcaggagtttgagaccaggctggccaacatggcaaaatctcatctctactaaaaatacaaaaaaaaaaaaaaaaaaaagttgggtatggtggtgcgtgcctataatcccagctactcaggaggctgaggcaggagaattgcttgaacacaggaggcagaggttgcagtgagccaagatcacgccattgcactccagcctgggtgtcggagtgagactctgtccccccccaaaaaaaattatttatagctttaaatagtttattttatcttcaaaagtcattatgagtaaagttatttaaatttcagagattgtgtcaaatttaggaaaacatgttgcaaatttctttttcaactgtgctataagagtagaagaaacttccacagattaggttcttgttttatccatttcaagtcttgtttcttttgtatttcaaacctacttgctggaaaccatagaacattttcatgtagagttgatgcagcacactttcatgtcatgtccccaagaaagtcagcacagtgggtgacaagaggattcctggaagcctctcctattctagaatgttgctgtggatagaatagtgttcatccccccatatgttcacctgtcctaggcctcagaacctgcaaatatgctaacttccacagcaaaagggcctttgcagatgtgattaggaatcttgaaatggggaggctagtctggattatccaggtgggtccaatataatcataaggtccttataagagggtcagagaaggagacataagggtgaaagatgagattgcaatgatatgggtgcacaagccaaggaatgcaggaagtcactagatggtgaaaaaggcaaggaaacagattctcccctagagcctctagaaggaaggtcagccttgataacccaatttggacttctgacatccagaactgtaagataagaaatttgtgttatttggagtcactacatttgtgttcatttgttacagcagtgtattagttcgttctcatgttgctataaataactacctgagaccgggtaatttatgaggaaaagaggtttaattggctcacagttccacaggttgtatagggagcgtgactgggagtcctcaggaaactttcaatcatggcagaaggtgaaggggaagccaacatgtcttacatggtggaagcaggaagagagagagtaaaggagaggtgctatatacttttaaacaagcagatctcgtgagaactcactcatgagacagcactggggggatggagctaaaccattagaaaccacccccacaatccaaatagctcccaccaggccccacctccaacactggggattacaattcaacatgagatttgggtggggatacagagccaaaccatatcaagccttaataggaaacttatatagctgactagcattaccttaagtatagaaaaaatgttgagatccaagaaaaacgttctactaaatggaaattaaatattatcccaactcattcaactcttaacatgattctcaaaatgtacttggatagtcctccccaacctaatttgaagggtaatacaatgggagagattttgacagcaaagacacatagaggtcttaattgattgcagtgaaagtctcttacttttgtaattattgcagtaatattggccaggtgaactggaccaattattagcgctcctggccaggattccagttaggcatgtgaagtgattcactcaagtgcaaggttcctgtccttacctaacattttaatattttgttcattgtgggactttcttgcattaatttagattttattttattttatttttatttttttctgagacagagtctggctgttgcccctgctggagtgcagtggcacgatcttggctcactgcaacctccatctccagggttcaagagattttcttgcctcagcctcccgagtagctgggattacaggtgcccaccaccatgcccagttaatttttgtatttctagtagagacggggtttcaccatgttggccaggctggtctcgaactcctgacctcagatatgcccacctcggcctcccaaagtgctgggattacaggcgtgagccactgtgcccagccagattgttaaaataatgcattaaaataatacttattcaggttactttccttttgggcatgctcttaaattttgtgctcaaacaagtgcctcctttagttcagttttgccccaactatagaagtgaaaccagagcttcaggtttgcttagctgtaccataaatctgcctgtgcaccagttgaagaaatatgggaagaaagcagaatctgtccataacaggcaggttttgaggcctcggcatagtgagaggcaacaacaaaagattcaactggtggactcgccacacaacgcggggtcccatcacaatacagaacccatcccaaaggcagccatgtcgttccagaaacacagggctcagagggcaaagtgaaaatggaaaggtagtgaacgtgttcacatggaagggcctcatacctgccttgacatctccatcaatttgcaagttttagaaaacagatctcctaagatatgtacccttgagagaaaaagcacatcaagattttgaatatgattagagattcttgcatttgtacatcagtgtgtgttcctgcacccatgtttggattcctggatcttatgaaacacccactcatacatagcacatgtggcacatccttaagggccaagttaaacattttttgttgtttgtttttttagacattggttctcgctctgtcacccaggctgcagtgcagtggtgtgatcatagctcactgcagcttcgacctcccaagctcaaagcatcctcctgcctcagcctcccaaagctttgagattactggtgtgagccaccaccctcaccccaaattaaactcttgatgctgtcactattaggcatactgatcatgggaaagagacaatagtctctcagcctccttgggatctctgaggaggccagacatattgtctcttccctgccacttctctctgacatctccttgtccctgctgtgatacagcatccgtatctgatgagtggtcacacagttgttgtggcacggagtctgagaagaagagtaatgtgcatgctgattactttgaagtagaaaattgggtctgtttagagttttcctttcctccatttttggatgcagcctttttccaagagagcaggcattgtggactcctcttcctcaccatcgtatcgggaggcgttccccacccagagaagctggaagcagaggtctcatgggggtggggggctatgaggatgtccatttttctgcacattgaatctgtatctttcaatcccaatttgccaggcacaaattgtaaattttgatttccagctgcttgacttctctccctatctctcgattgtttccaaattcaggtaagggaaagctgatgttaataggttcccttgagaggtgacagcgtgctggcagccctcgctcgctttcggtgcctccttggccttggtgcccactctggccgcacctgaggagctcttcagcccactgctgcactgtgggagcccctttctgggctggccaaggccggagccggctccctcagcttgcggggaggtgtggagggagaggcgccggcagaaaccggggctgcacgcagggcttgcaggccagcgcgagttccgggtgggcgtggggtcagcgggccccgcactcggagaggctggccggcccgcaagcccctggcagtgaggggcttagcacctgggccagcagctgccgtgctcgatttctcactgggccttagctgcctccccacagggcagggctcaggacctgcagcccgccatgcctgggcctcccccacacccgcctcccctcccccctccccctcccccatcccctcccccctcccccatccccctcagccatcggctcctgcacagctggagcctcccaaacgacgatgagcgctgctccctgctccacaacgcccagtcccatcaaccgcccaagggctgaggagtgtgggcacagggcacgggactggcaggcagctccacctgcggcccagtgccagatccactgggtgaagccagctgggctcctgagtctggtggggacttggagaacctttatgtctagctaagggattgtaaatacaccaatcagcactctgtatctagctcaaggtttgtaaacacaccaatcagcaccctgtgtctagctcagggtttgtgagtgcaccagtcctcactctgtatctagctaatctagtggggacatggagaacttttgtgtctagctcagggattgtaaatgcaccaatcagcaccctgtcaagacaatcggctctctgtaaaatggaccaatcagcaggatgtaggtggggccagataagagaataaaagcaggctgccctggtcagcagtggcaacaccctcagctccctttccacgctgtggaagctttgttctttcactctttgcaataaatcttgctgctgctcactctttgggtctgcactgcctttatgagctgtaacactcactgcgaaggtctgcagcttcactcctgagccagcgagaccacgaatctaacagaaggaagaaactccgaacacatctgaacatcagaaggaacaaactctggacacgccacctttaagaattgtaagagggtgggcggcttcattcttgaagtcagtgagaccaagaacccaccaattccggacacacccttaatctccaatattggaaggtcagtgagtctttgttgaatccataaacagcctcatgtttatgactgccctcccttttatgcatttgggtagtttcaagaaaatatgaatcatttagctaagattaccatagaagagaagactaagattactcactaatcttaagtatattttacatttgaatttgattaactttattttttggtgactgccataaaaccacttatgcatcctatccctgttcttaagaaacataattttcatttaaagcatcccagtgtattttgtgtgtatgtgtgtgttggtaggaggagaagtgtgtgtgtgtgtgtgtgtgtgtgtgtgtgtgtgtaaataagggctttaagcatgtactttagtttgatttgaattcatctgttttaaattcagggtgaaaaataaaatccaagtttgacaaagaaagagaacaaaaagcattataaaagtcaccaattttcaaacacgtccttcatttggaaacaaactctcaaccaacaatgattcaagcagacagatctaaattgattggtttggttttagattccaccagattttccagactgggagctctttgctcatgaagctgcctgtgtgctaagtggccaggatatcagacacgttgaaaaccagaaatgctttcacactgtccagttcaatcagtgtgacagagccatgttccatatgtgtaggtcaatggttttaacctggcatccgtggctaaaatttgaaccgaagaccccagtgttttccatgaatgcatttctagttcagatatatcttcaaagtctctcttctgaggcattcctcggcctctgtccactcccagccagtcccctaaccatttgtctgggtcttatctggcatgtgtgtgtagttctcacttcaacatctttaagggcttcagcatttttaaaaaaacaaggattttttttcttcaaaacattcagaacatttaaacggctgtgaatcatccaaataacaatcacagtttatttgaaaaggtacaattaagatattgaatgttgttataacattcttgtgtgtgctgactggtatgttaaagaccaaagagtgatactgtattcattttagcttagtgcctctttctgccccaattccttggccaggatttgcagaaatttttactaaggacactgtcggtgtggctagcataccatcctgttgtgtacaagcagaaatcagacttgtgacctacccaaatccccaccacccttcttctcaatactcatcaaaaaccccattgccaccatctcctgggtgatactgaggcttctgcaaaacacacaaaaacaaatgcctcttatccaaaaaaaagtgtgtgtgtatgtgtgtgtgtatgtatgtatttttctcatcttaactttctttttctttctttcttttctttttttttttttttttttttttttgagacaaggtctcactctgttgcccaggctggagtgcagtggcacaatcacggctcactgcagcctctgtctcccaggatccagcaattctcccacctcagcctccccagtagctgggatgacaggtgtgtaccaccatgcccagctaatttttgtattttttatagagacgggattttcccatgtcgcccgggctggtcttgaactcctgggctcaagcaatccgcccaccttggcctcccaaagtgctgggattacaggcatgagccaccgtgcctggccagcatcttaattttcactgtagcatttccagcgtttgtttcatcatatcgttcagaatgtttccctctttctctgtgatgtatgagaagttgtgccccacctcatattctcaagtacaacacacgatgaggaatattagaactataacatccttcaggctgaaagataactcattagtgctaaccactgctgttattattcctgctgccattttactattgggaaaactggcaattaatgtcctttcccaatgtgcataatcccttctgagaatgggttttgagaaaaatgagaaggtttgcgtgggatgtgggacgtggaatgaagtggaagccgttattttccagaggcccaggctactggaagcagctatttcaaagagctctaccccatcttccacgtcatggttgtgatgaaaccccaaatgctgccacacttttagtgattttcctttctggtttgaacccagattcatccacatgctcacaaagctctgacggttaactcagtcacagtcagccaaactgtggcctcaaagctcatgaaccttctccctcagaaagacaaacagaagagcaaaacccctccctaaatagcattcttagttctcaaattctttagtaaccaccctcaccctcaaatgcacaatggtatacatttatttgttggtttacatgtatgccctttgtctaccttactggactaaagttgcagaggtggctggcaaacttagccccatttagtctaacagtgctgtaaggagtaagtcagatagcccctgggacaagttgcctgataggatacatgttaacccattgaatttgtatttcagaaaagcaataaatgtgtttttttttttaagtataagcatgtcccatgcaatatttgggatatgcttaaactaaaagtgatttgttatttatttggcattcaaatttaactgggtaacctgtcattttactaagtcaggcagccctatcccaggagcattgtgactgattgccaagagcaccagtcatttatcttcttgcttccagcttccttcctactctctgctgctatcccctgtgtcgcggggtgctgggatcctacaaatacatttctcagtctggagcctctgagtatgggtgttggattagtgattaccaaagagaagaacttgcatgagttttgaaagggtcggggtgggggtgaactgtgtgagattggaatatggggctcttccaatgggaagcacagacaggaactggaaggcttttgggttccctccctttgtccagagcctccataagggaaagactggctcccacgtggtccccaggcagtgtggtcgcagtgaggcagcagtgtcgagcacaaatgcagcagcctgtggggcacggcaggtgcaggctctggctcaagccatggtggtgacgggctggcagcttcaggctcccagagtcctgagacagcatcagggccctgggctcctgcattcctgcaaggtggtggtcttggttctaaggctgccatgaatactctcagagcctcagtggtgggggattacgggctcttggtgaaaccattttctctttcactccttcagcacagaagtggtaggagctttctgcagttcttaatctcttggccatcttaccttccctttctaccttcttctggatctcctgcccctttctaaatgattcattttcaatagattccttctgttggaatgcatagggtggtaatgccttcttaccagaccctgccagaagtagtgagctaagtcttttattcttatcatctgcaatcaacaagagcctctcatgcatcattacattcatcatttcatcaccaaacacatcattgcataatcagacacgtcattacatcatcacacacatcattacctcatatgtgcacctcccactctccacctagacacagggaagagaggaaggcaccaggaaatcagagtggtaaagaaaacttcaggaaatcaggtggttttaagaccctttattatgacttaaataaattctgaaattagtttctttaaggaaggcccctaaaccgggaatgaacatgaataagaattatagtcattttagcgaccatagtttccccaggaattattgcactaaggcatttaaatttttttccaaatgctaaaatattttgtcagctttattgaccattctttctaacccctcagtaaattatatctctatctgaagtggaacataggagatgccctaagcttctcaaagatgttttgtaacgatctaggtaaggactgtgtctaatggaaatgacaggcataatttatttgtgaaagcagaaatgaaattcaaccttgacaacagattgcgcatttttccataatgccatggaagtgaaattcttgtgatgtagattaaatcgtggaatttgacttattgttcaaaaacattagttcaactctaaacagttgaattactcagcagctgtgtacaaatgtatgatacagataacaaaatgtattaacaattccctagatctacagaaatctatcactgctttttaggataagcttgacttttgttcaaataaaaatgcaaaaggaaagtgtatcctaaaaggcaatgacagtttaatgtgtttctgacatgcaaccttcaagagatccatatatgaaccattttgtgtggatagtacaactctaaacataatgttatgtggaaatttgtatacagaatatttagcaaagaagagtcaggatgaataaagtgaaaggaaagactttcccaatgttattttttaagtgatatgagatgcatcaagtgagatgtgtttgacaaaactttattcaacgttgatcctgacagaaaagaagcaggaaaaaacaattaatacacttcctatgtcttgaaaagtagcaattttaattttattgtgcattttgcttgacgattttatatatgacttccagtcaatatttcatctggaggactgagcaggtattatgattcccattttatggcagattgcaaggtgaatgtcacctgtcatcagcgcatacctggccaggggccacgtcttccagattccagcccacacggcatgggtgcctgcatttccctgttgctcttctcctcacactgatattaatgaagcacatctacttttagtcaataaccacttttatgttacagacacataacaactgggaaataaacatctatataattaatctcaactaagccagttaacccttactttttacctaggctgtatgctgaaatgtgtgccttttctataaaggggtttgtattcctctcattatattgtatcaggaggaatcactctaagataaaacagtttatctccaaaagtctgcagaaaatgttgataacaacctgcaactctctggtaaaggactgtgaaatgcaaaacaaaccaaaccaagccccaagacctactcatgtaagatgatgctatgatacattgcattcatctttagctttttagccgtctaaattgtgttctatgagagtcttaaatatcttccctttatctccttaagaaagtcctaaattcttagccaattttttttccttttttttttttttaagaaaggatctcgctctgttgcccattctggagtgcagtggcacaatctcggctcactgcaacctccgcctcccgggttcaagtgatcttctgcctcagcctctcgagtagctgggaccacaggactataggtgtgtgccaccatgcccaactaatttttgtatttttagtagagacaggatttcaccatgttggccaggctggtctcaaactcctgatctcaagtgatctttctgcctcggcctcccaaagtgctgggattacaggtgttagccactgtgcccggcccttagctggtctttgaggacacaatactgtcctgtgcattctttcccagacatggccttacatcaactggaatccccaaccagtcactgtcttgcattgttttttaaatacattatagtttccactttctggtactggttcttttccttctagttgcaagtacctgatacctctgtctatagcaacctttcttcatggccctgctcaaatgctccatcctccacaaagcattcattcattgattgcaccagccagaagtgaagtctgcatcctaagattacatacaactctttcttcaagccctttattccaatcatatccatacggctctggattgttttcatgaatgtccttatctaatctctcctgagagaccctaaattcccttgggagagggactttattttagagctaaggctgccttcaatcttctttatttagttatagctgctataaaccttctttgacgttagaaaaagcataccaatatctaccaatatttagtatttattaagttcctgttatatgtcaggaattctgcaaaggattttacatacgctatttccatttgccttaagagttctgcaagatagtataaaccaaaaggtatctgagacaggtctcaatcaatttagaagtttattttgccactgagaaggaaataatcgtgaaggaggtttgtgcctttctccaaagataatgttgaggacttcagcatttgaagaggaatagctgtctggaggggaaaaagggagggtatggtcacattactgaatccacatgctgcaagtgaaaggaagcaggttggggaatagtcaataatatatttatctcttgctccataaatcagcactttacataagataaggtgaacacagagtagctacctatggagacatttaaccttttatcttagctgtctgtagaggaacaagaggaaaggcagtttcttgcacgactcaattttcagcttagtttgttttcttctggcatagtgagttggggccccaagtttttattttcctttcagaatagatattactattcatataaaaggccccataacttataaaagactgtcagcgctggtgtaagtcaaatctgacctaactctagcctaccatactgatattacactgttgtgcaatcatggtctgctatgatttgagtgtttgtcccttccaaaattcatgttgaaacttaatccctgatgttgagaggtggggcctttaagcggagcctgggtcataaagactctgctgtcaagaatggattatccacttattaattaatggattaatcagtttatgaattaatgtattgatgggttgtaacaagagtgggactgatggctttatatgaagagcaagagagacctgagctaacacactcagcttcctcaccatgcgatgctctgtgcctcctgagaatgctgcaggctgcagagaggtctcctgcaacccccaactagcaagaaggccctcaccagatacagcctgttggccttggacttctcaacctccataagtgtaagaaataagttcattttctttataaattacctagtttccagtattctgttatcagcaacagaacagggactaagacatggtctcaataataatctcaaaaactatttctgtcctcagaggtcataattgcgttgaagacttaggttccaagaagggacataccacaaagtgggacactacacataatagaagtaaaattgctcttctttcaaccacagaggcagagctcattaattctgactgtgaggaaggatttgaggtaggcttaataaaagagataatatttgagctaagccttgaaggagaagggtgatgttgacagaggagaagatggaagggcattttagagagagagaacaggtatgattaaagccataagctccatgaacagggatgagttgttggaaggaaggggtgtaggtttggaacagggagtgagttatgaagctgcaacaaagactaaagtccaacttggaacaacgctgaatgcaacagaaagggagtcagcattttatctttatgaagtgagaaagcatggagtgggaaactgacatgctcagaaatttgttttgagcagatggatctatgaacagcatgagaggatatatctaagtgtatcttttaactgagatacatatctagaaatgtgcatttttaaaaaattcctgacttactacctaaaagtctacacatgtctttatttgtacatccattctgaccaagttggaggtaaaatatttatattgtagaacatccttccagactcatctcacagccaagctgctgtgagctactttctgtttatttttttccagttacattttttttttcaaaaataaaccttgtattaaggtgttggggttgatttaggggaaaaaataatctcacatgttttctgaaaattacaacttaatgtaaaataaatagaaaatgttttctattaacctgttagtttcctagctgaatattttgactatcttttgcttgcctgtctactgcacaaatattttatcttttaacatgtcaaacgtcaatgaagttatgacagacaggccacatccccacttccatagagaagaatcataattgtccctcttagtgccttgtgcattttaacaatttgagaggaaactcaatctttatgtaaagaatgtgccaatttaagcattttgtctcacccatctgccctctgatggcctcttatagatgttctgccttttaagaataaattaggccaagtgcagtggctcatgcctgtaatcctagcactttgggaggttgaggagggagaattgcttgagtccatgagttcaagaccagcctgggcaacataggaagactccacctgtatggatcatcaaaaaattaacggggcgtggtggcatgcacttgtagtcccagctacttgggaggcggaggcaggaggatcagttgagcctggaaggttgaggctatagtgagctgtgatggctccactgcactccttgaataaatcagatccatgaatactttatccattactgggggaaaaaagaagtcttatgctatactatacattgttatacattgtttcttgaccaaatgaattcatgttatgcttgtaagaactcatatatattaaaataattattaaaatctggagaggttcatgcctgatataattaggctttgtgtccccacccaaatctcatttttaattgtaatccccataatctccatgtgtcaagggagagaccatgtgggggtaatcagatcatgggggcagttttcctcatgctattctcgtgatggtgagtgagttctcaggagatctcatgattttataaggggctctttacccttcacttggcacttctccttcctgcagccttgtgaagaaggtgtctgcttccccttcacctactgccctgattgtaagtttcctgaggcctccccagccaggctaaacagtgagtcaaaacttcaagtttcctattcttccctaaaattgataaatgttcaactgatttaatgtagctagaggtctagcaattaagggaatgatgcaaaaattaaagaacaggaacaaaaaggctcttcttcttggtaaagttatttccaagataaaataggtcagagtcctttttagtattgggttgtctttatgtttggtggtatggctgcaatagagttcatagcgtcaggccactgtggaaccattgtttcctgaaagttctgtatcattaatatgtttctctgaaatgatttaacttctaaactggtacagatctcagtacgtacatgtgaaggggctgggcatggtggctcatgcctgtaatcgcagcacttttggaggccgaagtgggcggatcgcttaatctcagaagttcaagaccagcatgagcaacgtggcgaaacctcatttttacaaaaaacacaaaatttagctggatgtgggggcacatgcttgtcatcccagctacttgggaggctgaggtgggaggattacttgagcctggttggccaaggctgcagggaatgagccttgatcatgccactgcactccagcctgggtgacagaacaaggccctgtctcaaaaataaaaataatacatgtgaagggtgaacttaacataaatagactgtgctagggacagaaaatatttaaaaactctaatccaaaagcttttgacagtattttctcttttttgaatgattagaagtgtgagacattgaaaacatcaaggatcacatgtaaggcaattagaaaacattccaccaaagactctgggggagcatgaagtatctgtcagtgaaccagcaggcaggagagctgatgtttgcaagaatgcagcagaaactataatgcacattgctatcctaagttagcttgttcttactcaaatcattaaaacaataacctcattttctgtctcaatagaatccttctattaagagtgttatacattttatagatgtagaaagaacttaacctcatcttcagtgttccacctgggtgggtgtggctgatgcatttgcttcatttcagactccaaaaagcatattggtttatattcattagctttactggttccttttctctaaagaacccaaggtgctcttgagagctgcttcatataatgagcatgtagtgcctcttaaatcaggagaacaaagaggcagtcaaggagaaagacaagtaaatgaggaatgaaagaccttgaacatgaaagtgggttgagtttgatgatgccatacatttggcattgcttatgcagttttcagtaaactaaaatcattttttcgatgccattggctgatcaataagaccaagaggttatagagaacaccaggtattcaattcctgtgacttcagaatatcagttatctccaagtgctgataacatcattgataatataaattatttctcaggtgtttaaatctagtgttgactttcttgaatctgaaacattttagaatgttttctcaacaattaatgccctttattccatctttccattcattgtcccttccccaccgccatgctcacacttgattcttgactgaccacttccccattttctttctcttcataaccattttattttttcagcctgcattttcaaagccacatccttctggtttcttgtatttgcttgccttttgaccccagccccttttcattcctacaatttcctttctttttatcctactttttctccagaatgtgatttttcttctacatgtctctttctgctttgcatgtcctgctgaagattcctctctctgtcctctgtgtgtgctaactccatggaagccctttctccatattatactttacatcaaattgtttgttatccccccaggaaggttttttattcctttacactttctccactttccacgtctaggtgaccacattgggcatacttgattccagttccttcccattggcgggtgctcagctgaaaatggcagctctgtctccctcccctgtcactgggactcttctctccaaggtgaaggaccatctgaagttttgtttacggaattatcaggggtcctgaataaggactgccttccttatccaggcacaattccctgatttccaaccagacaccaggaaagctgaggactgaattgtgccacccccaccaccaaaaagtccatatgttgaagccctaacctccaatatgatggtattggagatgggccattgagaggtgataagggttagatgagttcatgaggacctgtattagttagggttctctagaggaacagaactaataggatagatatatacataaaggggagttcattacattacatattaacttacacaatcacaaggtcccttacatgattgcgaggccatctgcaagccgaggagaaaggaaagccaatccaaatcccaaaactaaagaacttgtagtccgatgcttgagggcaggaagcatccatcatgggagaaagatgtaggctgggaggctaggtcagtgtagtcttttcatgtttttctgcctgctttatattctagacatggtggcagctggttaaatggtgcccactcagattaaggatgggtctgcctctcccagcccactgactcaaatgttattctcctttggcaacaccctcacaaacacacccaggatcaatactttgcatccttcaatccagtccagttgacactcagtattaaccatcacaatggcagtgtaagttacttcaatcgttgtggaagacagtgtggtgactcctcaaagacaaagacagaaataccatttgccccaggaatcccattactgggtatatatgcaaaggaatataaattgttctgttataaagacacatgcacatgtatgtgcattgcagcactattcacaataacaaagatgtagaatcaacctaaatgcccatcaatgatagactggataatgaaaatgtggtacatgtacatgatggaatattatgcagccataaaaaagaacaagatcatgtcctttgcagtaacatggacggagctggaggccattacccttagcaaactaatgcaggaacagaaaacaaattccacatgctctcacttgtaagtgggagctaaatgatgagaacatatggacacaaagaggggaacaacagacgctggggcttctcagagggtggagtgttggaggaggaaggggatcaggaaaaataactaatgggtactaggcttagtacctgggtgatgaaacaacctgtacaacaaagccccatgacaaaagtttgcatatgtaacacacctgtacatgtacctctaaacttaaaagttaaaaaaagaatgcagagtatctccactgctattgaatatgatgctaaaggtgtttttctaaacaagaaaaataagtaaaccagttagaggcataaggactaggaaaaatactaattcctattattttttagatgatacctggaaagctttagataattaatgatcaaactaattcacaaagtacaataattcagtaaattagcaataaaaataacatacagaagtcattagtatacacccaaaacaaaaatttatagagtattcagtattagagaaaactctatgtacaattacagcaagatgacataccccttagaaataaagacaaaaagaaatgtgccaagtgtataatttaaaaaacctttaaaatctgaaagaaaaaaacgtagattaaacaaaaggccaaacatccttgaacaagatggctcaaaaacataatgaagtcaattctaaatgggtgaatttataaaattaatgtcacaatttttgaaaactacgaattgtcttatggagtaagattagttgacacggaagttcatgtggaataaccagcaggcaagaatagccagaaaaacccttagtagggtcaagccctttcagaatttcaacacattattaagcatctttaatgaaaataatttgttacaggtacatgagaagacagaaagactagaggaatagaagagaacatctagaaaccggtagaagtacagaagaaggcagtttcgtatttaataaggatggtatctcaaaccactgggcaataataaatttttttcttgagacagggtcacacgctgttgcccaggctggagtgcagtggctcaatgaaggctcactgcagcctcagcctccaggctcaaacaatcgtcctggctcagcctcccaagtatctgggactatgggcttgcaccaccatgcctggctactgtattatgtttattcttaatttagagacagggtctcaatatgttgcttagatgggtcttgaactcctggggtcaagccattcttctgccacagcctcctgagtagctaggactacaggtgtgcaccacagtgtcaagaataatggatttttaagcaaatgttgggacaagctggaaaatgataaatttagatccatacttcatttgtacacaggagtaaactccaaatgaatccagtatctaaacatacatgcacatacacatgcttagatgtatgcatacctacataatacagccatgtaagtgctagaagaaaaatgaattaattcttctataatctcagtgtggggaaagggctaagtatcactcaaaatcaaatgcaatcaaatatatataacatttgaatatgtaattttctaaaaatttgctgggcaaaaaatgcaattaaaaagtcatgagaaatatacacctgcaccacataagaatatttcagtcagtgacagaccacatatttgatggtggtcccatgagattacaccgtatttgtagcatactttacctaagtgtggataggtttaggtacacaaataccatgtgtaacatgtgttacagttgtctacattattcagtgtggtttcagggtgcacaggtgtgtagcccaggagcaatgggctacaatatacagcccaggtgagcagtgtgggctgtgccttctgggtttgagtgtgttcactctaagatgattgcacaaggaccaaacaacctaaagatgcatttctcaggaagtattcccagcacagagttgtataagtagcctcataaaggagctaatgttaatacatttttaaaaattgaaaattgaaggaaaaaaattttttaaaaatacatatgctatgggtacaggcatatttctatttagatactttctatcatgaaaatattatccaaatataaatataagattaaaaggtttctaaactgagtttacaattcaatcagattttaaagataagtgatattcctctaggcaaggccatgggtcaaagagacctttaaacagcaaactgggcctacagtgtaaccaatttaaaaactaaacttaatttacatttagaatttatctgataagactttcactcagggcagtcttagcaaatttgaggctcagtatctgcttctgaagctgggagacaatccctgagttcatcattttctttcatcactttgtccactgaacttaggagcaaccaaccaacttcattatgttccttggttctccacatatggtcaaaggtattatctatagagtcactaaactccttgcctttcacaagtagtgaatcaggagtgtcaaatgcatttattttgcataactctctaaacatttcacaccaaagactatcagtgttctccatactattagaaataaagtccttaacattttggggtctaatcatgttaagcaaccaactccagaaaccccaaaactaactaaagaactccatccttaatattctattcctctagaaccacttctggtaccaaaatctgtattacttggggttccctagaggaacagaactaataggagatatatatatatatatatatggcagttcattaagtattaactcacatgatcacaaggttccacaacaggccgtctgcaagctgaagagcaaggagagccagtccagtctcaaaactgaagaacttggagtctgatattcgatggcaggaagcattcagcatgggagaaagttgtaggctgggaggctaggccagtgtagtcttttcatggtgttttttttttttttttttttggcctgctttatattctagccgtgctggcagctgattagattgtgcccactagattaagggtgggtctgccttccccagcccactgactcaaatgttaatctcctttggcaacaccctcacagacacacccaggatcaatactttgcatccttcaagacaatcaagttgacactcaatattaaccatcacagggcccaagcttcatgatgggattagtggctgataagaagaggaagaagatttctctctctctctctctctctctctgtctgtctctttccccaccccacactaaccatttgagaacacatagagaagtggctgtctgcaaactgggaagagagcactcactgggaactgatttagctgaaatcttgattttggactttcaaatgtctgttgtttatgccacccagtctatagtagatttgttattgttgttgttgttgttttagttgttcttttttttgttagtttggtttttttttatagcagccctagccgactaagacagatacctcaaagcctctgacctacgcctactaccgtggcaatacaaagtcactgtttcgtaacactgtgacccaggataatattttcagttccataaacacgtgtttataaactgaaacctcttaggtctttcttttcacaatattctgaaaaccaagtggatatgttctcaaattatttatggtcaaaagggaaaaaataggaagtgatttatattgtaagggacagaaaacactacagtgaagatttactgagtagtgttggtgtttgaaatatatttcgttgttgttgttgttgttgtttttgagacagagtcttgctctgttgcccaggctgtagtgcagtggcaccatctaggcttactgcaacctctgcctcccgggttcaagtgattctcctgcctcagcctcctgagtagctgggactaaagacatgaaccaccacacccggctgtaatgtttttgtatttcttagatttttttcaagttgttaacaaagtgaacttaagaatgaggacaccatcatttgtaaatactgactaattccataggctgtaacagaacaatttatgctagactggtttccccatttttcaagtctgtctttaaggcagtgaaaacaggcaggactctacaattagctttttagtcatatgattaaacaaagaatgcattgggcctggtgatacagggagacctttcctcttactgatagtaaaaaaaatgaaattcgtttttcattttaaaaaaagtgatcgtaattgtttggttttctggttgattgaaagatccaaaaagagggttgtggtgccactgcctggtatttgttttaaattaattttaatgcaagttgaaattgtgatcaaagatttagctttatccaagaaaaacagttctttattcctaatgcatttcatttcacgccaaccaattaaacctggcaaagagacaagggcattagccgttaattaaacaggggagccccagaatgcaaaatttaatgcattctacctctgttctacactcccaagttaccaccacatttttattcataaactcttataatcccataggacagttggcattcccagatatttctccttaaaagtacttgatgggattttaaatatcagtcaaatattcataattttaaaattgtatttagaaaagcaggaatgaatcctaaagtccattggatttcagtaactgtagttgtctctaaaaatacaaaaccattttcttgacttctgtttcagacaaattagagtgacatataacactgtaattatgtttgaagtttggctcaaccatagataagctaagaaaataataatttttaaaagttaaagttaatggaaggctgaatgacatttgtttaaaagccatttttaaaacttcagcaaaaattctcaaggacttaaggagagttgctgcacaaactttccttgtgaaagggattgagaaagattccaaccaactcctccgggtgccgtgagtcatactgtgtaaatgcaaaagatttcagactcaagtcaaccgattttgaagtgcttttgaagtttaaagtgctttaccaatgagtaccaaacatcaaatgaaatcttccgggcaaagcaaatcatatgttcaaaaccaaatgcttaggagagctctctgaggtattagcatctcagatgttaagaagaaaaaaaaattcatcaaaaaatgtttcatctgatgcatctcctacttgcaaatagctatcactgatacttttcaaaggtgttagtctttcctaaaaacccagttggggatgagagtgaaaatgtatgttttagacagtattcaagtcatgtctgaagtgctttagtcaagtatacaaataaatgctgctcccgttctgggtgaaaacatcatgtcgggcaaaagattaggacagaataggcctttttaaaaagatttttttccaggtgtttttgggccaagttgcccagttatcagagagcaatgaggttcactttccacgacagtattatccatgacaatacaacctccccagaaggcatttggcaaagcaatctcatgcctttgaactgtgaaggccaagatccttgaccccagaggtctgctgaaaaatcactaccatgaggcaaattgattagtaggagaaaaggcatacaaatatatttaatgtgtacagacaagagtcttcacaatgaagactcaacctctcaatgaggtttgaagcttatgcactatcctgaggttacagaaagagtgggggccttggagccttgtgaaataggtgactggagggggagaagaagaattctattgtggggcagtaagtgattactagggagaatgaatacatgggaaacagggattaacttgtaaatagttttctttggaatttaactgattcttagagacagtcatctggaaaaagggtctgttcaggtgtggtaatatgttggtcatctttccagcaatgggtaaggagataataggagaggaacaagaacaattgttctccttggtgggtgagtcctagccttatgtagataggaaaaaagttttttgcagcacttgttgatctctaagggcttttcgttcaaaatactcattatatcagggagccctatttttcggtgaaatattttgatttccttcacaaccatagtatcatgtggctgcactttttgcaagttgatgaactggaagaaaatgcctgggtgctgagtctgatacccgtaggctatgggaggtccccaaaaccaggtgggacctcaatcctggccggtgtccaggctcttgataccatcaggagaagaaattcaaggaagagtcaaaaaaatagtgttaagtgtggacatttattgcataccaaaagtacacaccgaagaaaggtgagtgcaggtgtactcaagaaaatgagtcacgcacaacagagtttggggctgctacctttatggttttcttaaaccaagaggtggaatattaacgaagatttctggaaaaaggtgagatttctcggaactgtggtgccacccagttttacaccaaatatgggtgttcccagatctgtcatggtgcttgtgggtgtatgatgtagtatgttaatgagtgtataatgaggccttatgtgaaacgaggtcaaatccagcatcatgttgggcctagttggttttagccagcttggtccacatcctattttgtaggttcttatcagcccctagcttatgcagctatttcagcggtttccttttgctaatcatgtgggactgctgcctgaaatttccttttctcctgccaccaccctgtatcattcctgtctcaggtccatcaacttttccacactgcttagcctgcaagaggttaccttcaagaggaggaaaagacctgcacaaacaaatgcaggagagacataggtgggaattgtgagtcgtcaattggaggtcatgggctccctatgcaagcagaatctgaatcctgatggtgtcagtttctgcttagagggatctatcccaactcgcttgacctcacaggatttcagtgtgctcgctgtacaacagggatagtaataaccacctaaaactaatggcatttattcatgcacaagggtggaggcacagcatagagtggtggttaggattatagggtctggaggctgactgggtgggaatcctcaggcctcccctccaaggctctgtgctttagcatctctgctctagagggcacatgtaaatggggacagtgactgttgttaccctgtgggccttactaaatcatgtgcatgaaatatttagcatggcaactctcccactctaaatttgcaatgtatttgatctgaatgacaaataaaaatgatttctggccgagtgcagtggctcacacttgtaatcccagcactttgggagcctgaggccggcagatcacttgaggccaggagtttgagaccagcctggccaacatggtgaaaccctgtctctactaaaaattcaaaaattatccaggcaaataaaaaataaaaataaaaaataaaaatgatttctgaagggccataaggaaattatgagtaagggttaaggacattcacaggaacccccaatgtatttctctatcaatattccagaaggaatttataatcaaaggactaagaaattcagagatgctaccattttcaacagatggagaagtgagaatagtaaaaacagacaactgcaatagatactatatgtttaactgttttaacatgctaccagtatttattcaagtgattagagttagtaacggaaacatgttccattaatttaggaaatgctgattaaggacctgctttgtgcttcaccatttgtgtatctgtgttagaaactagggttataaaaataatgtgttctccgtaagggaatgtattttaaattgtaagagtgttaagacattcagaatagtagggcaggagtcaaaggagagctgtatattgacctcttaatagatgctccaaggtggactcttctgtcccctctgccagctccctgactccttccctaggatggaggacctggataggacggggtcacaggcaaggctatggcaggggtaggggggagctggaaggcaagggtgccctcagcctttgctcttctctttctgctcctggcttgtttttttcttgtcttttctcccagttgaatgaggtgagtaaaggcctgtggggcagaggggagccctcgtaggtgtctgtgtcagccaaatggtgtcctctccatgttccagactaaatgagcagacaatggataggatgataaatccaaactcctcttctcttcccagactcctgtgtcctttttgctctgatacaacaaaacaagaaagctggtcttgtaatgtaggttattctgagttataaaggttactgtattcatttactagggctgccttaaccaagtaacacaacagaaatgtattgtctcacagttcttgaggcttgaaatctccagtgttagcgggggctggttccttctgagggggatgagaatgaatatgtttcccgactctctcctagcatctcatggtttgcttgcaacgtttgacattccttggctggtacatgcatcaacttcatgtctgtcttcatctgcacatggcgttcttcctatcccttcacatcctcttgcctcatgcatgtctgtcttcatctgcacatggcgttcttcctatcccttcacatcctcttgcctcatgcatgtctgtctcagtgacgagatctccccctcttagaaggacatcagtcccggtggattagggctcaccctaatgacctctttttaacctgattgcctctgtcatgaccctgtctccaaataaggttacattctgagctgataggaattaggactccaacatatggatttttgatgtgcacagtttaactcataacagcaaccaatagtgaaagtctaaatagtgatataattattttaaaaaatgggataagaagagagggaggtactgtgagtactttcatgtatcataacagcagatcattatatggagttgatgaaattttaaaaagtatcagtagaaaggtatcatttggtaatatggaggtaattactaaaataaaagcagaaatggtggtgagttttgcacttgagaattggttgagttaaaaaaaacttttggatctgactctaaaatctgtattatagagtttatattagtggatctcatgtatctcttctcaaattgtatgtgccttcttgttcagagaaatttcatttttaatgagaacttagacaaaaactaattaaatcaatcaattcatcaattgcaagtctaaggaaatttataggaaaagcaacatgttcaactctatagctggcagcgcccagtgtatcagtgtctcactgtgtccggaattggtgggttcttggtctcactgacttcaagaatgaagccgcggaccctcgcggtgagtgttacagttcttaaagacggcgtgtccggagtttgttccttctgatgttcggatgtgtttggagtttcttccttctggtggggttcgtggtctcgctggctcaggagtgaagctgcggacctttgcggcgagtgttacagctcttaaggtggcgcatctggagttgttcattcctcctggtgggttcgtggtcttgctggcttcaggagtgaagctgcagaccttcgcagtgagtgttacagctcataaaggcagtgtggacccaaagagtgagcagcagcaagatttattgcaaacagtgaaagaacaaagcttccacagtgtggaaggggacccgagtgggttgccagtgctggctctggcagcctgcttttattctcttatctgaccccgcccacatcctgctgattggtccattttacagagagccgagtggtctgttttgacagggtgccgattggtgtatttacaatcccttagctagacataaaggttctccaagtcccccaccagagtcaggagcccagctggcttcacccggtggatcctgcactggggccgcaggtggagctgcctgccagtcccacgcggtgcgccggcactcctcagcccttgggtggtcaatgggactcagtgccgtggagcagggggtcgatgctcatccgggaggcttgggccacacaggagcccactgagggtggggggaggatcaggcattgcgggctgcaggtcccgagccctgccccacgggaaggcagctaaggcccggcgaaaaattgagcacagcagctgttgacccaggtgttaagcccctcactgccccgggctggcggggccggctgaacccacggccacctggaattcgcgctggtcccagcaaacaccgcgcgcagccccagttcccaccggcgcctctccctccacacctccctgcaagctgagggagccagcttcagccttggccagcccagaaaggggctcccacagtgcagcggtgggctgaagggctcctcaagtgccaccaaagtgggagcccaggcagaggaggcgctgagagccagggaaggctgtgagggctgccagcacgctgtcgcctctcatcatcactgctgtaacaaaatatcacaagcttagtggcttaaaataacacaaagtcactatcttatgttgctggaggtgaaaactctcactgtgctaaaatcaaggtgtctgctgggtataatttcttctggaggctcaaagggagatttcgtttccttgctttttccagcttctatagccattcgcatcccctggcttgtggctccttcctctatcaaagtaagcagagtagcatcttcatatctgtctctgactttcaccctttcctgcctccttcattcacttacaaggaccttgtgattacattggcacaatgagctaatataagatcatctcctatttcaggatccttaacttaatcacatctgcatactcccttttgtcatgtaagaaaacatatttgcaggatgtagggattaaactggggacatatttaggggtctttattctgcctaccatactcagtaaaagacaaaggctgttttagtttggatgtacaacagacaaagacaatagagaacagcagatattctggtaaagaaaagccatggttcccataattctcccagcaatgctagtgagcgccttttccagtggggactatctatcaagtctcttgacaaaagcaaataggatgtggcaaggttgaactactgatcagtatgcccttgaaacccttggagggttatgctcaagtaatgttttaacaaggtgggcagaggataattatttctctaagccacaggatgaatggtaattgataaaattccaaatagaaattgtgagcatgtgtaattcgattcattatttttaactttgcaaaacatcatttatctaactttgcaaacttacaactttgcaaaacgttacaaggaaaatctttgcgttttagtttccaatgctattaaaattgaataatttaaaatgcagactctgacagaataacttaagtgaaagaaaaataaagttatacagaatttatttaatcaatagatttgagaagacaggaaaatttaatgttgagggtatcaaataggcgcccagtggacagaattgtctatgtggtggaatgagatacagcaccactgacacttgcacctggaggaatgcttatttagacggtaataacaaagtcagtgatttttcctactattttcgatgctatcctcaggctatagatttaaactttatgagaagttcaattaaaaaggcgatatctactaatttctcaaatggcctttatatgagtcttatatagacacagggacaattacatacaacttgatatgaaaataaagcaaaccaagaagttaaaagaagtcttatggttcatgtttgtaaaataatacattggaacatttttcctagttgagatttaaacagaaaaattatatgtgttgacttactgcttgcatgtatatttctgcaagagataaaaaccttaggattaataattaaaaccattctggagttttatatcagcaggtaccaaagctgtcagttgcatgatcttaaccacaattaaattcaggcataacactccctgattataccaatatagggagaaaaagatttcttctcgcccaggtcagtttttatagataacaaacatttaaccataaaagaaaacatgctctctgtagagggctaattaaacaccatagtaataagataggaaaggttgtttcaggtgagtgaacccaactccagtcatggaagaaagaaaaggaagcccttgatttccatggttgggagaggcacaggtggcagcaggaatcctcaggatgtcctaaggaaaggtttcctctccagcttttaagtcagccatgttggcttcatatgttaaagcccttgctgtttacacagtgctgtttacactatttattcctgaacgctttgccctgcgtttatccccctgagaaaggataagcccttccaaactaatgacccccaattcctttgtggttggtcatcctttagtgcctcgttagccagaattacttaatgtcattcatcagccttgcaacactcacatggcatttacttggctagcaattttattggaacttaattattagcgagaaaaaatagaaacattaaaatggtgcaaacctatagcaatgaaatgcttagcatgctgttaatgctgcagagaatcttaaaactaaattgaatctggcctcatggcacttaggttgtgagaagcactgcttgcatttaaatattttgctacacatagatacaggaaacatgattttgatgtttgttaaataagagttaatttttcttatataacagaaaaaagccctccctatttttttcccaatcaagttgtttatttctaattagactaaatataaggtgaaatgtattcaacatatccaaaacactattttaataaagtgagcaaattgtcaagatccatatatttatttcagactttttaaaagttaagacaattttaatttattattctataaaattcagtttaactgtcagtttagttttgaaattcagaagtcaatttggaaaatggaagtgtttatcattagttgcattttgtcctgatctcagaaaattacgtatatgttttcctgtatatacttccatatttgtcattggatgagcaaatgataaaaacacactgaatttatgtaatttatctctaatccctttaataaaacatttcataattttcagagaattcagaattcttaatgagtattcttcttcatgaaacagtgtcttctgttcatattgaatgcagcagactcaggaataactatgatttatcaatggcatatttttaaggctaacatcaacagtagactcttgaattcaatcatgtcagcacaatttcaaaggattgcctttgctgagtacaaagaatctacatggttagctaaaaatggtgcaaacttaagcattgtgtaaaggaaagatctattgattttctgtgtttctaattggtgttaggcaccacattagatcaactcatcacttacctgccatttctccctctttttactttgtgttgaagagtttggaaatcttatgactagcctacttgttctgtgcccatgaagcaaattaggtatcatgaataaaagatctgggtcagcacaaatgtagccttactctctctgtttatctaaagacctaagcctgttcacatctccaacaccctttgcatgaaggggaaaccaggtgacccaaaccaggtatctgaaatgacattgcatgcctgaattacaaatcctcctcctagctttacaccaaagggctggcagtactgacctgggtgtctgagaactacaagaggagaatatactgaattttcagttccttctgggtcgattctaactattgggccccagaatgcagtcagtcatggattctaagaatcagattaaaaaatggagtttaggggtcagtccattgggcatatctgaaaacgcaccctgtcgttattttccaaagacctgagggcacagttggaacatagctgatacagtcagcaactgggaatatcctacccatttgaccctatcacccatgcagtaaagatttttataatagaaataattaagtagaagtctaaagacctggcttccctactaagatacttgaacaaatttaatattgcattcctggggagaattgcagagatcagtgttaccattaaaacttgaaaatttcaagtgtgttgttttccatcacaactccactggacttccccgttcgagatgtgtagttgatagaagacacttgaagaatgatgtagtttagtaaactcaacaagatgctggatctctttgcagctttggttcagatgccatctttttattggaatgaataacacacagcctaccaccagacattcagttaaaggtttggtcgattttgaccagtatttattctcccagtatccactctcttctagatacttttattcacataagctgtgccaggttttagcaagcatatggacatccggttagtccctgcacttccctgactactttgtagctgtacgtggtcatgtgaccaagtccaggccagaggacttggtcacatgaccacatacagctgcaaagtaatcatgaccaatggtgatgacatgaacaagttctgtctctcatccttgagaaataaaggcaaatgcattccattatttcttccttcatgttggctaagtggaacaattgacttaaacccagtggtcttaagccatgtattaaagataacaaggctatcctttccatccttggccatctacttccatctgttgcacgaaagagaagaaaacttctctcctatttgaaccattatattttaaggtctttttgttacagcagcttaacatgtttcccaactaatacagcgtgtaactctctgtccacttaatgcactattccacattgagctcaggatacttcttcaatcccaaaatagatgcttctattttcttggtcattccaagttcctcctccttgggaatgcttgatttctctgtgtttatcctctcactgttctacacaatcccaatataaacttgaaggtgtgctccctcatttgcccaaatgagaactcatacaacacatgtgtagatgtagaaaatttcacaggttattcagataacctaaaatcaatacttacttactgttaaaaaatgtccttcaaaaataaaagaaaaagagtaatgtttatagtagagaaacttgacaaacactcgatcaaccagatgatcaggtcaacatcaaaagtgacaagtcatattgacagtatgtacccatggcatgatgtgatgagaaggaaacaccacctctgtggtcttcttcccaaatagccataaccccagtctagtcatgaggaaaacactggaaaaacccaaatggaaggacagtctaccgaccagtattcctcaaagcccttgaggtcatcaaaaacagaaggtctgagaaaccgtcatggtctaaaggagacttagaaaacatgactgtcaaatataatgttcagcagaacattgaaaacaaaagatgaaaaaaatgaatgtaatgtgatatcctggatgaaatcctcaatcaagggatattaggaaaaaagtatgtaaattcaagtaaatgatagcctttagttaatgataatgtatcactatcagttcattatttgtggcaaatgtaccagactaatgtaagatgttaacaatagggaagtctggttatgtggtataggactttctgtaatgttcttgcaactttttttgtaaatccagaactatttataataaaaattttattaagtatgacccaggaatggactttcaatgggaagttggtatggtaaacactggacctcactatttgaacacattagctggatacctgaagaaatggagataggagatagatgatatgtaaggcagaagatatggggttaaggagctggagactagctgtggtggtgcatacccgtagtcccagctactgggaaggctgagatgggagaatcacctcagccaggggaggtcaaggctgcagtgagccgtgattgtgccattgcactccagtctgggcaaaagagtgagacaatgtttcaaaaacaaacaaacaaaaaaagatgaagatggtgcatgaggacatgaactagagcaaaaggagcactcatggccagagacaggaacatttgatgttaagatggtgtgtgagatgaaggcatcccaagtgatgacaaaaacgaaggtaggaaatgtgtggagcagtcaatgtttggagatgccaatggtcaaagcaataaagtcatcataggttatttattatgtaaaggaaaatgttagaagaagtgggaagatggaaagaggagcatgaccgagggccaggaactgatgaacaaacaggggaggttaaggaagggcaagaggtcagctggtggctggagaggagaagtgataccaattagatatgagaagtataatcaatatggcattattgtatttcaatagtgttgaaaataaatgaaatttacttaatatagcaccatatcaaacgaaatactttttctgaactggtttggttccagattcttattgaagtaaaacataaatctacttatgggtattaagggataacgtatcattgtgtggatcatatgtttgtcagatacattttggctgacaagtaatgcgaacgataattgtgatttctggaaactggcgtactgcatctgaaggtcagtgtgctcatttccccttggatgcatacattggaatgttattgtaattcagaaggttctttctcagctgcactgcatttccatcggggaaaatgccaaccctcggaataagagcatgtgttatagagacatgatgtagttgctaaagcaaagtgattttaattgaattgtgattctttctcctgtaacttgagttgtaccattttgtgttgatgtgataaaatctgaattctttgttaagtgatggcttcaacatgcacaggtcatatgacattttaaatatttcgttgtattttcagtttttacttttagctaactgaacttgaccctagaactactatttttcctttaactcctttctttttttttttttaaagacagcaaccaaatgtgcttgtcttttaagggacatatatgtcaagagttttgaaggatgctacagtaagtaatttggatggcactggaattaaaatccagcatgtatttttgctggatgtgactttcaggaaaagatcttataacttgttacagttccaaagccattacacagtatacagtcatgtgtcacttaatgatgggataagttctgagaaatatttccttaggtggttgcattgttattcaaatatcataggttgtaggtaaacaaatctagatggtataacctaccacacatctaggctacatggtatatagcctgttgtaacaaagctgtaaacttctacagcatgatattgtactgaatactataggaagtactgaatactaactcaacataagtatttatatatctaagtaaatttaaacagggaaatggtacaataaaaatacagtataaaagataaaaaatggtatacttgtatagggcactgaccatgaaaccatgaatggagcttgcagacgtgggagttgctctgggtgagttagtgagtgagtggtgagtgaatgtgaaggccattactgtacactactgcaggctttataaacactgtacacttaggccccactaaatttatttttaaatgtatttatttaataaattaacctcagcttactgtaactttttttactttataagcttttagatttttgaaaactttttgactcttgtaatagcacttagcttaaagcatacatggtatggttgtacaaaaatgtttttttctttatatccctagtctatcatccaagtttttttctacttttaaatttatttttttactttttaaaattttttgtgaaaaaatgaagacacaaatatactcagtagcctaggcctacactagagtcaggatcatcaatatcactgccttccaccttcacatatggtcccactggaaggtcttcagggacaataacatgcatggaggtgtgacctccaataacattgcctttttctacaacaccttctgaaggacctgcctgccgctgttttacagttatatacatatatatagtgtgtatacacacacacacacacacacacatatgtatatatatatgtatatatgtagaagcaaaacactaaaatattagtaaaatatatagtatcataaatatataaactagtaatgtggttgtttattatcaagtattatgtgctacacataattgtatgcattgttttctaacactggcagcacagtcaattttattttattttattttttgagatggagtctcactctttcaccaggctggagtgcactggcacgatctcggctcactgcaacctccacctcccaggttcaagtgattctcctgcctcagcctcccgagtagctgggattatgggcacgtgtcaccatgcctggataatttttgtgtttttagtaaaggcagggtttccccatgttggtcaggctggtctcgaactcctgcgctcaagtgatccgcccgccttggcctcccaaagtgctgagattacaggcatgagcctctacgtccggttgcagtcgacttttttacacccccatcaccataaatatattagtaatgccttgtgctgtcacattacaaaggctatgatatcattaggcaacagtcatttttcagctccattataatcttatgggaccacctctgtagggagaccccctgaaactatggctatggaataaaagatgaaatgctcctgattattgtaaatacaaaattgcatgcaggattgtgtaaagacaatgccaggttggactgccagaacgagccaacagcacgtgatgtgcttccccctgcagagagcctatgaatggacatgcagtcagggaggtttcacatcaccaagattcctatcccagaaaagcagatgttcatagctctgggaatggaatgcgacccttgtggaaagcctataaacggatgcacggggggcacttgtccatatggataagatagggctataaacgccctcatcttgccacggctcttctagccctctttagggttaaggcatactcccttctgagaatttctggtctaactggttgtctagcttcacatcctgtttccatggattgtttgtaactagcttttgttgcaatcgttactgctgattaatatcttgctaatcataggttacggaaagattgtgtttctgttttaaggctctgttagaaattactgatgcacacactatattgtaaattcttatctctgtatactgtacttctacatacaaatgtactgtacttctacatacaaatgttatgttaaagaattacttcatccccatgtgaccatctcacctcataatcaaatgaccctaaatccctcactaacctacccccaccctcactaaacgtaataataaatgctggtatatccagtgcattgttggcaccgcgggaccagaaggcagtgacccacctggacccagctttcactgtcttgtgtgtgtctattatttctcaacctgccgatccacctgggaacaaagagagccccattgcattgcgggctgctggccagatccctcaatacacctccatatatgcagtctgccattaaccaaaattttgctatgcagcatatgactgtaattgattcaagatcagttatttgaaaatgtaaccccttcctactaatagaataatctttataacactggaattgaaaatccttttccggctgggcgcagtggctcacgcctgtagtcccagcactttgggaggccaaggcgggcggatcacgaggtcaggagattgagcctggctaacatggtgaaaccctgtctctactaaaaaatacaacaaaaattagctgggtgtggtggtgggctcctgtagtcccagctactggggaggctgaggcaggagaatgacatgaacccgggaggcagagcttgtagtgagccgagatcgcgccactgcactccagcctgggcgacagagcaagactctgtctcaaaaaagataaaaaagaaaatccttttccaaatgatggaatatagtaacagaaaacagaatccctactttagtgctagagagatagtttatttttcaaggtcatgtgacacttaccgaatactcttaaaattgtaagcaaataacatctagattttgccgagagctccaactttgcaagcgtgcataaaaagcctctgtttcttcctaagtcaaagaatggaagacagagccctggagtgtctgggagatacttattctacatgtgccaggtgcttagtgcccaggcaactggttagaatcaagttaacctcaattcgttttccatcaatgattctggaatttctatgaaaacagttgacctggagaccccagtagttgctgaagaaatctgggctttcaatcatctcctacttttgactccagtctattccagaactaggcatttagcctctattatgaatactctcctcactggcaaagaaaaggaggtgggtaatgattacctaaacttcagagctaactataagcataatttgtggccaggtgtggtggctcacacctgtaatcccagcactttgggaggctgaggcaggcagatcacttgcggccaggagttctagaccagcctggccaacatggtgaaaccctgtctctactaaaaatacgaaaattagccgggcgtggtggtggacacttgtaatcccagctacttgggagcctgaggcagaagaattgcttgaacacaggaagtggaggttgctgtgagccaagatcacgccactgcactccagcctgggtgacaaagcgagactccgtctcaaaaaaaaaaaaatataaaaagatgaattgtgatagataatgcttagtaaagatgcaatggaaattgctaattcagcaacatataagccgttttatggtatcattaggcagagaaaatcgatatacctaaggtgaataatgtttctacttgtaccacatccgtgatagtctaaactagggattctcaaagtgtggtgtttgaaccagcaacatcagcatctcttggaaactggatagaactgcaaattctttttttttttttttttttttgagacaagtcttgctctgtcgcccaggctggagtgcagtggtgcgatctctgctcactgcaacctccgccttccgggttcacgccattctcctgcctcagcctccagagtagctgggactacagatgcccgccaccatgcccggctaattttttgtatttttagtagagacagggtttcaccatgttagccaggatggtctcgatctcctgaccttgtgatccgcctgccttggcctcccgaagtgctgggattataggcatgagccaccacgcctggcctagaactgcaaattcttaggccccacccaagacctattgaatagaaactctactggtggagtccagctatctgcatggacaaacctccaagactgatgatgcatagtcaagtttgagattcatgactctaatccagaggtcagcaaactttttctgtaaaaggctagatggtaaatactgtcggctttgcaggcagtatggtcttcacctcaactactcaactctgctgttttagcctgaaaacagctatagacaggacgtaagttaattgggtttggctgtgttccagcaaaactttatgaaaaaagcagctggatttggtcaatgagacataatttgctgacccctactctaaaatacttcttactaattttagaccagtggggcttgttttatatgagtggattgaaagcattcatctatgtatgttatttttaaaaatagattctctttatataaaacgtatgtctgtctattcctgagtacacattaaaaacatcatttttaattatctgaatttgtaagtttcatgggtaaatagaaaaggagatgcttatgataaagttaatcataattaaaattaaaattatcacataatatattaagattcacataacaaaatgttaatattctctttaaatatcattactaacacataatcaacaaaatcttaccttggattttattacatagtttagaacttttattgcatgtcataatctttgtagtataataaacaaattttaacatttcctctaagcacaggagatcatatatgtcatcacccttaccttacagctaataaatagttgttcatttcagaattcgggcagttgaagctgtgtgaacatgaaccattcatcattacagatgatcctgatcacatagatacatggtatccagcaattgcaacttagaaagtgttatcagtccaagatctgattggttctgcaaatttagatgactcgttttctaatattttcaagttgtagcccaatgttctcatacatgtcatttctgatttaccattaaggatgttctggtaaattgtttctctcgactgctcatgcagtgttttgaactggtgccatagtagatttattttcttcccttcagtatagacacatacatgtgcttatttctaaacctcatcacttgacactgaggaccaggaagcaaaacctaagtgactgaaagtcttttcaagttattctttgattggcttttggagtgagtttgatgcaatctcctcacttttctagccaaggcgatttggccaagttatctgttctcaacctttcggctgtaatactgttttgccaaacacagaaacactaatgtagatagctcacacttacggtttcagaaatttttttcatacaaggaagttttcttaaaatgtgtaaatctctttttttctaaatctacaaacaagatttaataatataacacatatacattgtaatacattttgtaaatatttgcatatgcatatgcacaatatatagtaaacgtaaaccattttatatttccttgtatttcttaaagccaatgaaaaacattttaagtacaatcatataatttactgatcaaagaaaattttttcccactcttctataaacttcacagagcctgagatttttatcaaataaatcttggataccttctagcacttgcgtagtacgtttttttaaatatattttttaaatttagcttttattttcagtagagacagagtcttactatgttggccaggctagtttccaactccctgggctcaagtgattctcccacctcggcctcccaaagtgctgggattacaagcaatgagccaccgtgctggcctagcatagccctttactaaaaaaaaaaaaaaagccactataaatatttgctgagatactgagtgaatggatggactaacaaatgaattaactaatgaagcagtgtctgaatttctgaatttaggagaaattctttttttttttcaggaacattatttaaaatgtatttaacagctccatgcaacttctccagaatgatggacattgccctatggacatacatgaaaaatgtatatatttatttatagcatatatatatagcttccttgattagtgtattcactttatgttgtatgtttttttctacagatgactgtaaaagcctgtttggttatgatacaatttctataagcactaaaacaaacaaactaatagtcccatccctattagtgttgaatatttgaaaggtgttatttttgggtcatttttaaccacgttgatatctctttttctgaatttgactttgtaatacttttttattttttaatttatttttaattttttttttatttccataggttattggggaacaggtggtgtttggttacatgagtaagttctttagtggtgatttgtgagattttggggcacccatcaccgagcagtatatacatcactcaacttgtagtcttttatccctcacccccttctgaccctttccccaagtcccctaagttcattgcatcattcttatgcctttgcatctgtgtagcttagctcccacttacgagtgagaaaatacgatgtttggttttccattcctggattacttcacttagaataatagtctgcagtttcatccaggttcttgcaaatgccattaattcattcctttttatggctgagtagtatttcctcaaatatatatatatatatatatctcacagtttctttatccactcgttgattggtgggtatttgagttggttccacattcttacaattgcaaatcatgccactataaacatgcctgtgcaagtatcttttttgtataatgacttcttttcctctgagtagatgcccagtagtgggattgctggatcaaatagtagttctacttttaattatttaaggaatctccacactgttttccataatggctgtactacttacattcccaccagcagtgcagaagtgttccctgatcactgcatccaggtcaacatctactgtttgatttttttgattatggccattcttgcaggagtaaggttaccaccttactccttatcgcattgtggttttgatttacatgttcctgatcattagtgatgttgatgcatatatttattataacatacatgtaactttcttgattagtgtattcacttaagttgtacttttatttttttctatgaatgactttaaaagcctgtttggttataatacaatttctataggcactaaaacaaacaaatagccccattgctatttgtggtcagaatttgaaagttgttatttttgggtcatttttaaccatgttcatatctctttttctaaatttgactttgtaatgctttcttattttttaatttattttaatttattttaatttttttatttctataggttattggggagcaggtggcatttagtcacatggtatttggttacacaagaaagttctttagtggtgatttgtgaaattttggtgcactcatcacccaagaagtatacactgaacccaatttgtagtcttttatctctcacccccttttcactctttccccgagtccccaaagtccattttgtcattcttatgcttatgcatcctcatagcttagctcccacttacgagtgggaacatgtgatgtttggttttccattcctgagttacttcactcagaataatagtctgcagtctcatccaggttgttgcaaatgccattaattcattcctttttatagctgagtagttttccattgtgtatatataccacagtttctttatctactcgttgattgatgggcattagggttggttccatgtttttgcaattgcgaattgtgctgctataaacatgcgtatgcaagtatctttttcgtataatgatttcttttcctctgggtagatacccagtagtgggattgctcgatcaaatgatagttctacttttagttcttcaaggaatctccacactgtaatgttcttttaaaatatgtgctttttatttcttgcttgtatttttttgtattttgaaattgatttaggaagtatatataatccatagagacctcagcccatttttaaagattcatgttactaacactccaatagcttcctgtgggtttggcgtggtaggaagtacaggtgaaataaggcaaataagacagaactggtattctggagcttgagaaaatgaagaaccctggcaatcacaatgcagtgtgagaagtgttatgagacatgcatttgcaggacccctaggggcacgtgtctgtctcctagtgcagcccaggaggtattgtcttggaaggcatccctcttaaatcatctcccagaggatggcatctgatgagggtaggatgcatattccaggcaaaggaggcaaaggcactgggttattaaagtattgcaaataactcctgcacacttctggtacaagtacaaattggtacaatccccgaggagaaatatttggtaacatctaccagtaataaaatgtattaatgatcagatatgggacccagctctcccagctgttccatttttgagaatgtttcctgcagagacacttgcccatggatgacgtggcggatgcacagttttgttcacggcagccctagccttcgcacagagttacaaacaccctagatgttcctcaggagaggaaggattcaataaaacactgtgtgtccaaatggtgggaatgccactacaatcaaatgataaggaaggctttctgagatatgatgttaggtgaaaaaagtggtttgtaaatggatgtgtatgatatactatatattatgtgaacaagggaaaatacatatatgcctttacttgtttcttgtaaatgtataaagtcatctcaacgtgtaggtaagaagctgacaaaaatatttgtctcagtgtgtggtgttgttatatgggactagatacaggactcgttggggtgaagaatgagagggagagaatggtccaagaaacagctacagaccttctccaagcttccgcagtcatcaactcatggccaattccatttcatcccaactcctagacatttctgcctgccccagagtagaatatcttgtatatatacagatgtgcgcgcacacacacacacacacacacacacacacacacacacacacacacattcatgtgcttggcttatggcccaaataagatccatgcataaaaattaaaggtaaaatttttattttaaatatgtactttgtcaaacttctgcaataattataaaagccttaaattatgaatagagtaaagggagtttgttattagtatcaaactctcctagacacagttttatttttattatgatttttcttttaactcatggtgatctttgtgtgtctttttacatttttaaatatacagggccattgaaggttttctttaggcattaactttttaatttttgtattatagttagaaaatttcagattctttgaaatttgagaagacatactttatgtcaagtgggtaaccaagttttagaaaattttctggaacgcttgaaaagaacgtgttctccaattatttcatgtagttttctatatatgtccattacaaggagcttattaaactattaaatcttttatatttatattagtttgatctctatgccagtcatagaccattctcacagctggtgagaatatgctgaattatcccagtataatggcggatttgttcatttctattttcattctgttaatttttcttttatgtatattatatataaatgccatttaattagatgcatatagatttaaattcttatagctatctgagaacttaacagattttctcaaatggatgactgttttatccataaggatgactttagcattaatatttaattcatctgatgttgatacagttaagcctcttttccttgggttaacatatatttggtctttggttttccatcatcttcttttcaaaccttttgtgtctttatcttttcattatagagtttaatctgtttgtatccattgtgtttgtggactcatttctgtcatcttatattgtactttctgttagtatacttgctgttcatatcacttttattctgtctaccttgtttgtgtttgttttattttagcttattaccattttattttgtcctttattgggtcagaagtcacatcctctaatttcatccttttattggatattatagaaatgttataatatatattttttgaagtgtgtacacaaataaagtgaatgagtaacctgagtcttcttcagaaaaatataaagaccacacaaagtgggcacatagctgtggagggacaaaggtgatgctgggcacacagactgaccacacagagctgggtctcttcaacaatgtcgtatgtctacgtgaagaaggatgccaaggcacactctaagataatgtgtgttgggggggaggaggcgtgtgtgtgaatgtgtgcggcacacctgatgcatgctcaggagtgtatgtatatctgtgcaccattgtttttaattcaaaaagtgcatagctttcattttcacaggaagttatgatgcctcatacagcaagtacctttggtacctttggatagactttttttttttttttttttgagacagagtctcgctctgtcaccaggctggagtacagtggtgcgatcttggctcactataacctctgcctgccgggttcaagggattctcctgcctcagcctcccaagtagctgggactacaggcacgcaccaccatgcccagctaatttttgtattagtagagatggggttttgccatgttggccagcctggtcttgaactcctgacctcaggtgatccacctgcctcggcctcccaaagtgctgggattgcaggcgtgagccaccgtgcccagcctgaatagacattttaaggtagcatgtcatttttgccatgaatttggcagctgtctacattctaaaaagctagattcaactttgaaacttccccagtctaggagagtatagtgtaaacagatcaatcaccatagaagggggattaaacagacatattctgagcaggcaactggaacatgaaaccactttaagtagcagaattgggcctgttgtgtttagaggcacaaaaggaactgtgaaatatctaaaatccaatagctaagagaaatttcacatggagagactgagaaacttctgcaataattatgaaagccttaagttatgaatgcaaaaacacagtgttgcagatgtttctgtagaaatctacaaaaatgaatctattgcccaccgaaactcaggacagtaaggaagcagaaagttacggcaagactgggctaattctaattccattggccatgcccggctaagcatttcattaattctttactgagaagagatttgaattacagttggcatcaagaagtagttacatctctatttgccaagatcaatcattcagcaaaatttaataattgattcagtaatatagtgtcagtcattcctaaataatgttttctgtttgttttatacatttctgaagcaaaaggacaaaacaattatttttaaaaatgaaaggccagtaccaaaaaggcaaagtcaaaattctgcaagttttggtgctgatcatgggttggccagatatactttattgcttttggaaatggttcttgagtgattagtgtaggaaatagtgtagaaatattctggaagggctttctctgcctttgtgtgaagatttccagttccccggagccacagagcctgattcatttgtctacacacaataataataataataataatgatgattattattattattctgagttgcttgagctctctctctctctctctctctatatatatatatatatacacacacacacaaacatatatatattctggttattaatctctcattaaatgtatagtttgcaattattttcttccattctttaggttgtctcttcattgaaagtttattataccatgcagaagcttttgagcttcatgttattccatttgtctgctttgcttttactgcctgtgctttggacatcttactcaaaaagtctttgtccagaccagtgtcctcaagcatttccccatagttttcttctagtagcttcatagtttgtggtgataaactatgagcatgcagttttgactccatttgccagtgttgtggactaaagttgtgaggacagaatggtttgtgttttcataagttttcttatgcaaagttgatttgatgacagtggcctcctaagaatgaactttcatcaaaacattgaggtctccaaccaaacagacacaaaagcactccttaatgtgggagtcttcagtaccatataaaatgtgcaaattagcaacatttctgagtattgagctccaagattcaactctggaatattttatggttttctttgttttaatacttaatggaggagacacatttttgcttgtaaacgaataaactcatgtgtctaattatgtattaggaaaatgaggtcatttccttctatgtggtaatatattcacatatagggggaaatgccataatatatgggacaataaggtgaataatactata

SEQ ID NO: 167 - DNA, 50209 bp, Homo sapiens
  source 1..50209: mol_type = genomic DNA
ctatgagaccttgacatgactacactaagttcattttcaggtgcttattcaaaggggaagtcactgatggcaaattctacctcacaacctcatctgtatagaaaagatgtgccatgatcgtgccactgcactctagcctgggcaacagagtgagaccttgtctctaaataataataataataaattccaaaacaaaacaaaacaacaacttatagtggccataagctcaagaccacaatgcaatcatggttagaaattagtactcaattgtacagaagaagccattaagcccctcctaccacagctaactgagattccggctggtggctctgaggctttgtcctccatctgtccatggtgatgctctagcatttcataacagggttggtctggtcagctctcaacacatcaacataacttactcttgcatccgagagattattcaagtgccaagtaccatcactttcttcttcttctttttttttttccttgagacaaaatcttgctctgtcacccaggctggagtgtagtggcgccatctgggctcactgcaacctctgcttcccgggctcaagttattctcatgcctcagcctcccgagtagctgggaccacagatgcatgccatcacgcccagctaatttttgtatttttagtagagacaggttttccacattggccaggctggtctcgaactcctggcctcaagtgatccacccaccctggcctcccaaagtgctgggattacaggtgtgagccaccacacctggccactatcaactcttcattgttgagtttttctaagttaaaacaacctgttttttgagctatgctgcatattacatgtttcaggaactccccatagactgatttcccagctccagaaacatgcaatccatctgctattcccttgggctttttgctttcttctttattttagagatgggggagggtctcactatgttgcccaggctggacttggcctcctgggctcaagagatcttcccacccctgcctctcaagtagctgggactacaggtgtgagccactgtgcctagctttttgatatcttgattccctcagaaccaggtggaaacatgttctgaataaaagccagtcctgggtattcttgctctactcaccggcttggttgtgttgggctgagccttatagaacacagtgctggagaccttctcagggtcacttcctgtacccttgactttgagctgcagccctctggttttctcaggtgagttttcttgactctttccactactcttcagccgataaagtgaccattccactcatgtgctttcccctggggtaactcctagtggatgcagtgttgggaccccttagtttcactgggcagtgtcacagggcaggctctttagaagcagaatttcagctggagtttggggcacaggaggtttatcagttgatgtaaagggaaggaggaggaagcaggatcgggcagggggagagctgagtatgatgcaagccacacaaagccttggccagcccagcggggagctctggagcagggatggcgtggcagagtgttttggggtaaagggcatgagcttggggaagtgactttctgcagactctgatggagctgacatctggaggctgcctgcccaccgcactccctgcagctgtgcagcgagcctttccttgaaaaggggtctcagtggtgcacatttttttttgagacagagtcttgctctgtcgctcaggctggagtatagtggcatgatctctgctcattgcaacctctgcctcccgggttcaagcgattctcacgcctcagccacccaagtagctgagattacaggcgtgcaccaccacacgtctctactgtttttagtagagacggggtttcagcatgttgaccaggctggtctcgaactcccgatctcaagtgatccgcccgcctcggcctcccaaagtgctgggattccaggtgtgagccaccgcacccagccagtggttcacatctttgtctcccactgtcaggaaaggtatggggaggagctgtgaaaagaaatgggtggccactgggtaagtaactggggacccagggaaaatcctgttactcccatgactcgcccacatggtcctgagccagtcactttaccactctgtgcctcagtttcctcaagactcagttgagggttggggagtatatccattcattcttctgacctatattgactgagtacctacatgtgccaggcactgtgccaagttataacagtcaacaaggcacacaaaacctcgccctcagggagctgacattgccaagaacccctcaaatctacccagtgacccagactgagggcagatgtcacccctggccttgcttgcaatgatcatgacgcacagtgagcaccgtggcctcgttgcatattcagacagatgacagcctgacatggaagctgaggatctaatcagtggcatccacatggtaacaggaaggaaggagccactgtgggtccttgagcaggagcacggagatatcagtgcaaaacttcagaagggcaattccagtggcaatcaatagaaaaagacctttttactgcatgtcaccctgccccttaggtgagtcaaattaaggcaaatagccgaggccaggccaccctgtctgtcccctgttatatttttggttttggtttgtttatagctgagttattccctagtggtggcagtgatgattgggaatttggctttctgatctgaccatttggtgacttctgggaatgaatgaacggatgttggcagagaacagcaggagtcaggcatgttatcctgtgtctcttggatctcttgccctgtggctaacggtgtgaaaatgaagcattaagctccctctgtggctgcagtcagactcctggggtgagtgagtaatgttttcccatctctggagggtgtctatacattattttgtaatgtcacttgaattaaaggaactcagttctgattggctgatagagataaataagcacttatacaaatcaaatattcctaaaatttaggaaaatgaggaaatcagactttttaaatggctgtcctctgtagtccaggaagaaactgaacttttagtaccgtaaatgcactagtcttgaaaaagattcctccttcagaaactaattcagagactttaagaatccaagttctcataattaagataaatctttggcaaatgacattagtttaattatttgagtttaataaaaacagtataggatgggtgcagtggcttatgcctgtagtcccagcactttgggaggccaacgtgggagaatcccttgagcctgggagtttaagaccaacctggccaacatggcaaaaccctgtctctaccaaaaatacaaaaattcgccagtagtggtggtgtgcgcctgtagtcccagctacttgggaggctgaggtgggaggatggtttgagcctgggaggcagaggttgcagtgagctgagatcatgccattgcactccagctggggtgacagagccagatcctgtctcaaaaaaagcaaaaacaaaaacaaaaacaaaattatgctattattaagtaattatcctgtaattattatggatgctttctctctgatttgttagtgttaagtataatacaagtgtgcatttatctacttaagtttgtattttcctaaattgatgaaggtttactgatcaaataagctaccacttctcctccataatgttgaagattacaaaaaatgtatccttgcatttgactaaaataaatcattaatctaataagtttatttcaacgtaattatgttttgtagtacgtcatcttgaagataacttccaagatctttaggtaattgaaaattctgactgatactcaattgacttaattaatggatgttcactggatgcccagagcatttctaagtaaggaagaaaacggaaacactgattactaagcacaattttaaatttgtataattttgcttattattatttttaaatttaattcaatttattttaattgagacagggtcttacttcgttgccctggctggaatgcagtggtgcgaacacagctcattgtggccttgacctcccaggctcaagcgattctcccacctgagcctcccaagtagttgggactactggcgcatgccaccaagcccggctagttttcgctttttgttttttgagacagggtctcactctggttgcccaggctggagtgcagtggcctgatcttggctcactgcagcctcgaactctcaagcttaggtgattctcccacctcagcctcccgagtagctgggacaacaggcacacaccaccacacccagctaatttgtgttttttgttgttgttgttattgttgttgtttgagatggagtctcactctgtctcccaggctagagtgcagtggcgtgatctcagctcactgcaagctctgtctcccgggttcacaccattctcctgcctcagcctcccgagtatttgggactacaggtgcctgccaccatgcccagctaattttttgttgttgttgttgttgttgtatttttagtagagatggggtttcaccgtgttagccaggatggtctcaatctcctgacctcgtgacctgctcacctcggcctcccaaagtgctgggattacaggcgtgagccactgcgcccggcctaatttgtgtatttttttttagagagagggtttcaccatgttgcccaggcaggtctcgaactcctgaactcaagcagtcttctcgcctcggccacctgaagtgctgggattacaggcctgagccactgcacccagccatatttttgtattttttgtagagatggggtttcgccatgttgcccaggctggtctggaactcccaagctcaagcaattcacctgcctcggcctcctgaagtgctgggattacaggcgtgggccactgtgcctggcctgctgcttgtttgtatgtgctacagagaggccctgttttggggtctatcaatcaacatatccatttttgccacatcaagatgtcatataagggatgtgggccattctagggagctggtttaagtgtagccctgagcttggctagttgactaaaatgacatttcacaattatccacaccttggtgaagtcaaagttagttctatttaatctcttagggcttattaaagaccccaaagagctttgatttacgtgggttatggctattgatacttactgggttagaaattaaaacagaaaattgtaaatatttattgagtcatagtaataacaaatgcattaacatgtttaacataaagaatatcttagggccgggtgcagtggctcatgcctgtaatcccagtactttgggaggctgaggtgggaggatcacttgaggctgtagtcagactcctcaggtgagtgagcaatattttcctgtttctggagggtatccataaattattttatgaagtcacttaaattaaaggaactctgttctgattggctgatagaaataaataagcacatatacaaatcaaatatttctaaaattataggaaaattagaaaatcaaactttttttttatttcctgggcaacatagagagaccttgtctctacttttaatttttatttaaaagtaaaaaatgttgggtgtgatggtgcatacctgtagtcccaactatgtgggaggctgagatgggaggattgcttgagcccaggagtttgaggccatagtgagctatgatggttgctactacactcaagcctggaagacagagcaagaccctgtctcataaaacaaaacaaaacaaaaacatatcttggtattactatgaaatcagttctgacctttgggcccttgacatctgtcttcaagtaaagtgtcagtttgttccatgatatgaaacttggaaagtgaatgttatttgccttggctgataacccctgagttatggaggaagctatgcaatgtattcatgtcttaggtttgtttccttggcttacaacatacatggtgattcttttttttttgtgagacggagtctcgcttctctgtcgtccaggctggagtgcagtggtgcaatcccggctcactgcaacctctgccccctgggttcaagcgattctcctgcatcagcctcccgagtagctgggactacaggcacgcgccaccatgcccggctaatttttgtatttttagtagagatggagtttcaccatgttggccaggctggtctccatctcctgacctcgtgatccgcatgcctcggcctcccaaagttctgggattacaggcgtgagccaccgcgcccagcctgttattctttactttatatttaatctgcctagagaggaaagaatgttttactagaatagttttctgtgctttattttggctttagtatgtccttaatttttttggggggggcggggcgcagcgcggacagaatcttgctctgtcacccaggctggcgtgcagtggtgcccatcttggctcattgccacctctgcctctcgggttcaagcaattctcctgcctccgcctcccgagtagctgggattacaggtgcgtgcaaccatgcctggctaatttttgtatttttaatagagatgggatttcaccagttgcccaggctggtctcgaactcctgggctcaagtgatcaccccgcttggcctcccaaagtgctgggattacagatgtgaggcaccgtgcctagccaattttttttttttttttggagatggagtctcgctctgttgcccaggctggagtgcagtggcgcaatctcagctcactgcaacctccgcctcctaggttcaagtgattctcctgcctcagcctcccaagtagctgggattacaggcacacaccaccaggcccggctaatttttgtattttttttagtagaggtggggttttaccatgttggccaggctggtcttgaactcctgacctcaggtaatccacccaccttggcctcccaaagtgctgggattacaggcgtgagccaccgctcctggcctcgtgcctggcctattatgtccttaatttttgttttgttttgttttgttttgagacagagtcttgctctgtcacccaggctggaatgcagtggtgcgatctcggctcactgcaacctctgcctcctgggttcaagcaattctcctgccgcagcttcctgagtagctgggactacaggtgcctgccaccatgcccggctaattttttgtatttttaatagagatggggtttcaccgtgttagccaggatggtcgtgatctcctgacctcatgatccgcccacctcggcctcccaaagtgctgggattacaggcatgagccaccgcgtccagccctatgtccttaatttttgaagaaaagaaatacaaagaaaaaaattttctctcttaagtgatttataatcatgttactctctatccgtatttttatgttttattgtcactttggtcaccattattgtttctcaggtacctataatatcttactcaagtgtataaaactcctcttaatttttcttttttcctttttttttttttgagatggagtctcgctcttgtcgcccaggctggagtgcaatggtgtgacctcagctcactgcaacccctgcctcctgggttcaagcgattctcctgcctcagcctcccaagtagctgggattacaggtgtgagccaccatgcccagctaatttttgtatttttagcagagacggggttttaccatgttggccaggctagtcttgaactcctgacctgagacgatctgcctgcctcagcctcccaaagtgctgggattacaggcgtgagccaccgtgcctggtcttctttttttttgagagggagtgtctcactctggcgcccaaactggagtgcaatggcatgatctcggctcactgcaaccttcacttcctgggctcaagcaattctcccacctcagcctcccgagtagttgggattccaggcacgtgccaccatgcccagctaatttttgtatttttagtagagacggggtttcaccatgttggccaggctagtctcgaactcctgaccttagttgatctgcccacctcagcctcccaaagtgctgggattacaggtgtgagccaccttgcctggccaagccaccatgcctggcttaggttttcatttttatcttcccaaagtcagacctaaatatagaaaaaaataaagtttaactttcatgatctcctttgtacctaaaactatctttgagatttcacacagggatcctagaaagttacaaggatcagttatttcactttatttaaaaaggatgctagataccgggtgtggtggctcatgtctgtaaacactttgggaggctgaggcaggcagatcacatgaagctaggagttctcgccaacatagtgaaactctgtctctactaaaaatacaaaaattaggctgggcgtggtggctcatgcctgtaatcccagcactttgggagtgagtccgaggcaggcggatcacctgaggtcaggagtttgagaccagcctggccaacatggtgaaactccgtctctactgaaaacacgaaaattagctgggcgtggtggtgtgtgcctgtagtcctagctccttgggaggcagaggtgagagaattgcttgaacctgggagatggaggctgcagtgagctgagatcatgccattgcactccaacctgggtgatagagtgagactccgtctcaaaaaaaaaaaaaaaaaaattaggccgggcatggtggctcatgcctgtaatcccagcactttgggaggccaaggcgggcagatcgcttgaggttagaagttcgagaccaacctgggcaacatggggaaaccccatttctactaaaaatacaaaaattattggtggcgggcgcctataatcccagctactcgggagactgaggcaggagaatctcttgaacccaggaggcagaggttgcagtgagccaagatcacgtcactgcactccagcctcggtgacagagtgagactctgtctcaaaaaaagaaaacaaacaaacaaacaaacaaaaaaagtgtatgctttatcggaagttcctggagatgtgtgcccttgcttttcataatatgttgcaacttagaggaaacactgaatgaaactgttatgaaatatttcctgggcagggcggtggctcatgcctgtaatcccagcactttgggaggccaaggcaggaggatcacttgagcccaggagttcaatacaagcctgggcaacacagtgagaccccgtctctactaaaaatttttttttaaaaagtaaacgggcatggtggcatgcacctatactctcagttactcaggatgctgaggtgggaggactgcttgagcctcgtaggtcatggctgcagtgagctgagattgtgccatggccacagagcaagaccctgtctcaaaaaaaagaaaaaaattattttcgttgagttttcctgtattcatcagagtcctggtggtgctttgcttgatgatattagacaacagcagtatagagtattattggtcataataattggttattattgtaaatgcttacttgctcacagccttctttaatttgaatctgacatcttctaggccagtgacgctcagtgcacatcagacttacccataaggttttattaaaatacagatgtttagattctactccaaactgactgaatctcgttattttatattcttggtatattatgcatgctacatctcaggattattatatactatatacaaatttttttttctatatactatatacaagtttttttttctggttggacgtggtggctgatgcctgtaatcccaacactttgggaggccaaggtgggcaatgacttgagcccatgagttcgagaccagcctgggcaacatggcaaaacccagtctctacaaaatagtacaaaaaattacctgggcatggtggcatgtgcctgtaatctcagctactggggaggctgaggtgggagagttgcttgagtccatgaggtcaagactgcagtaagctgtgattataccactgcactcaagcctgggcaacagggcaaaaccctgtctctaaaaaaaaaaaaaaaaagtaaaaataaagattttttcctctataagaatgtgttcatccatatttataaatgagaggtagcattcacaggtgtctttgaaaataaactttggccaggtgcagtggctcattacctataatcccagcactttgggaggctgaggcaggtggatcacctgaggtcaggagttgaagaccagcctggccaacatggtgaaaccctgtctctactaaaagtacaaaaattagctgggcgtggtggcgggtgcctgtagtcccagctacttgggagcctgaggcacaagaatcactcgaaccagagaggtagggttgcagtgggccgagagcgtgccactgcactccagcctgggagacagagtgagattctgtatcaaaaaaaaaaaaaaaaaaaaaaaaaaaacggcggggcatggcggctcatgcctgtaatcccagcactttaggaggctgaggcaggtggatcacttgaggtcaggagttcaagaccagcctggccaacatggcgaaaccccatctctaataaaaatacaaaaacattagccgggcctggtggcacgcacctgtagtcccagctactcgggaggctgagggagagaattccttgaacctgggaggcagaggttacagtgagccgagatcgtgctactgcactccagcctgggtggtagagcaagactccatctcaaaaaataaataaataaaaataaacttaatcattatctttagagacatttttgtctaaaaaaattattaggaacggcttaaaactgcaaacatttttatcttagtttctgtaggtgtgggatctgggtgcagctttgctattactaatagatagtcctggctcagggtctctcatgaagttgcgtctagggctacagtcatctgaaggcttgactggggctgggggtgtctgctcccaagaaggcccactcacctggctgatggctggtgttggctattggctggggtgcttcaggtctcctccatgtggcctctcagtctccagggcctcatttttttcatatagcctttctaattgatggctgggctccagtgagacagagagagggatctttttataaatgaatctcagaggtggtattatcatttctaccatattctatttgttttgagtcacaaaatccagaccacactcaaggcggggggcacagacaccaggatggggaatcatcagggaccacctcaaaggctgaccacagcattgcccctaaaatgtatggggccccagacaagtattttttgcaggaactctgtctatataaacaatttaaatacaaaatgtattacaagatcatgagtccatatgaggtattgggatttactgatgaagattttaatttatttattttagagatggggtcttgctctgtcacgcaagctggaatgcagtggcgtgatctcacctcactgcagcctcaaattcctgggctcaaatgatcttcccaccttggcctccagagtagctggaattataggcatgacgccactatgctcagctaattaaaaatttttgttgttgttggtggagatagtgtcttgcttttggagggtaaaggtttagaacaatgtgtcgacccattgtgaagtgaaataaatcaatcaataaataaaatagaacagtgtgtatgtctgggtgtggtgactcacccaactacttgggaggctgaggtggagcccagggttgagaaatgttcaaggctgcagtgagccatgatggcaccactgcacttcagcctgtctctaaaaagaaaaatttttaaatgaaataatgctatagctgtcataaatttgtaggtactaattaatagagtggcaagatgcaaaaagtataacctctgggaaatgtaataaataaatgatggaaatataccagaagcaggaggctttaacttacctttgtcagcaaatgacagctctagtagacaaaaacaaaaacagtataattaataaagctatatcaaattctcttttcttaaaaccatgaatacatcttttagtcagtcagcaactatggaacattagtaatcactggccataatattaggccacagagaaaagtttaataaattccaaaaagtagaatggatacagaccacattctttgaccataatgcaataaacataaacatggactttttcttttttctttccctttcttttttttttcttttcttttttttttgagacagagtcttgctctgtcacccaggctagagggcagtggtgtgatcatggttcactgcagcctctgcctcttgggctcaagtgattctcctacctcagcctcctgagtagctgggactacaggcgtgagccaccacacccagctaactttttgtatttttttgtagagacggagttttgccatgttgcccaggctggtcttgaactcctgagctcaagcaatcctcctgcttcggcctctcaaagtactgggattacaggtgtgagccaccaggtctggccaaacttggattttttaaaacaaaaataaaaccacaaaactccaatagctcagggaaaaaagatttagctctctcacgttttataatatccagtgctgtcaagagtatgaggaaaactgataatatataacaggtggcagtataaaattcagcaagcattttagaaaaagtttcacagtatttatcaaagttttacatttatatacattttgatccaggattttttttttttttggctaggaatttgctctttgtgtgtgtggtttttttttttgttttgtttttactttgtaaatttacttaaaaaaatagctgtctgcatatttttaatggatgagtaaaccaaaaatatataaacagctatttataaaggggtgaataaaaaaagataaaatagtttcttatgggtggagggagagggaagaaggttgaggagacagggatagaagctagatttatctaaatataccatattattattattattattattattttgagacggagtctcactgtgtcgcccaggctggagtgcagtggcacgatctcggctcactgcaacctccgccacccgggttcacgccattctcctgcctcagcttcccgagtagctggcactacaggctcccgccaccacacccggctaatttttttgtatttttagtagagacggggtttcaccgtgttagccaggatggtcttgatctcctaacctcgtgatccacacgccttggcctcccaaagtgctgggattacaggcgtgagccactgcgcctggcccatattattattatttatcttttgaatatactgtactattattgagaaccatgcaaacacagtatcattgtataatcattattatataaaattatgtattatttaaaaattgcatcatatcaaaaggaagttatagattactggggtcatatcaagcaagtttcaaaggctcccattggccaaagatggggcaatttgagcatcaaaaagaacaataactgcaatagattgaaatacatcacctagccctcagggcagaatgatgccacaaaatctccctggccacctttggaggatgctagtgaaccaactcattctgaaaactgataaataaagagagagacaaagtaactgactagataattgattaaagaattattatttttgagatatgatcatgatttactgctaacttgttaaaagctcttatcatttgggccgggcgcggtggctcacgcccgtaatcccagcactttgggaggctgaggcgggcggatcacaaggtcaagagatggagaccatcctggccaacatggtgtaaccccgactctactaaaaatacaaaaattagctgggcgtggtggtgtgcacctgtagtcccagctactcgggaggctgaagcaggagaattgcttgaacctgggagacggaggttgcagtgagccgagattgcaccactgcactccagcctggcaacagagcaagactctgtctcaaaaaaaaaaaacaaaaaaaggaaaagttcttatcatttacagcaacatcttgagagattcatgggtaaaatgatgtaatatctgggtgttgcttcaaaataatccagtggggatgtgggtagaggacataaaagaaacaacattggctgtgaattgataaatgttgaactaggtgatgactacatggagatttattgtattgttctctctacttttttatacgcttgaaattttccataacagaaaaataattttatggaggcaaaagctgtaaacagtgttctatgcctatattgagagtatgactcatgacttttttttaaaaaaagccagacctgaccttaaaaatttcttttattttaatttaattaaaaaaaatttttttagagacagcgtctcactttgtcgcccagactggagtgcactggtgtgctcatagctcattgtgcagctttgaactcctgggctcaagcgatccttccaccttagcttcttgagtagctgagactacaggcacgaaccaccacacccaactaatgtctttatattttatattattttattataattttattttactgtattttatttatttgtttgttttgagacagggtctttgctctgtcacccacgctggagtgcagtggcatgatctcagctcactggagccttgacttcctgggctcaagtgatcctcccacctcagtctcccaagtagctgggactacaggcatgcaccaccacacctggctaatttttaaaaaattttggtagcaatgggacctcaacatgttgcccaggctggtctcaaactcctggactcaagcaatcctccctcctcagcttcccaaaatgttgggattagaggcattgaaccactgcacctggcctattttatttttgaaaatagagacaggtggggggggtgggtgtctccctatattgctcaggctggtcccgaactcctggtctcaagtgatccttttggcttcccaaagtgctgggattacatgagccaccactcctggccactgtgctgggtttaattgtggagaactataactaagcattgtctttaaaaaacgagtacattggccgggcgcggtggctcacgcctgtaatctcagcactctgggaggcggaggcgggcggatcacgaggtcaggagatcgagaccatcctggctaacacggtgaaacccccatctctactaaaaatacaaaaaattagccgggcgtggtggcgggcacctgtagtcccagctactcgggaggctgaggcaggagaatggcgtgaacccaggaggcggagcttgcagtgagccgagatcgcaccactgcactccagcctgggcgacagagtgagactgcctcaaaaaaaaaaaaaaaaaaaaaagagtacattttgggccggttgcagtggctcacatctacaatcccagtactttgggaggccgaggcaggcggatcacctgaagtcagaagttggagaccagcctgggcaacacggcaaaaccccgtctctactaaaaaaacataaaaactagccaggcatgttggcgggcgtctgtaatcccagctactcgggaggctaaggcaggaaaattccttgaacctgggaggtggaggttgcagtgagcccggatcacgccactgcactccagcctgggagacagagggagactccatctcaaaaaaaaattaaaattaaattaaaataaaaaaagaacattttggcctacaattcctgacaaagatggaatgtgggcaaatgcatgatgacctggattatttctgggagaattgtaaagagtttctgtagtcagcagaaatgctttgaatactttccatatattagttcattaatcccccatgaagtacaagtaggggaaactgaggcacagggaagttgactaatttgcccagggtcacaaagtgagtaagtggcagaaccgctatttgaacctagctgcgctcatagtgctttaatcttcaatcagcgaggatcgtcaagttggctgctggatctttctggatctttttttcattacctcgcctttcatgttgtttgtccacatagcttgaggctttatcacagattgctcttgggggcagtgttactccagaaatgccggaatgctccgctattcctcactccacccctaaatatacagcatctcctcccgcccttaagctctgaaaaaaatgctgcggagccagaaaggctgcagaaagccgggtgtgaccactggctctgtagccaacctgttccctgctgctgctgctgctgctgctgctgctgctgctgcagtcgtttggtttcctctttgaatctgagatgattctgaggtctacactgcaaactcttggcatatatcatttctagaattccattcctactcgacctaggctgtgagtctgcactagttcgcggcacgttagatcgcgcccatttcccttattggcaagttgtcaggttgaggaagctccaggcctggaggagggcatctccagccaccagccatgaagcccagggcctcaggcaccttctggcctccgggtggcctcctctattcgctgacccagacactagtccagtggttcccaaagtggggttccctggcaggcagcagctgcctcgctgggaatctattaaaaatgcatactcccaggccccacccatgacccactgaatcagaagctgtgggcctggggcccagcagttggtgttttcagaagccctccagtggactccaatggttcctagagtttcaaaagcacactgggctaggccaggtgtgccaagagagaagtagctttttggctcaagtcctcacaggaatggtcagagggtccccatcagtctatcagtgtgcaccatacaacgctcacagagggacacacgtgtgcccgtgtgcatgcgtccctgtatggactccagttggagggggagggacagttttgccttgtggttttgtcactcgccattggaaaatagccctttcccctactactaaatagcttcccattgttttctagtccctttacttccatttcagagagtgttttctcttctgtgtttttttgtttgtttgttttttgagacggagtctcactctctcacccaggctggagtgcagtggcgcgatcctggcccattgcaacctccgcctccgggattcaagcaattctcctgcctcagcctgctaagtagctgggattacaagtgcctgctaccacactcacctaattttgtatttttaatagagataggggttttgccatgttggccaggttggtctcgaactcctgacctcagatgatccacctgcctcgacctcccaagtgctgggattacaggcatgagccaccatgctgggtccctcttctctttggaaaagtcatccacgttggttgcaagtttttcagaaaagagggaactacattatagaaataaatggcaaacagacacccaacacccaaggaataatttctcatctctgtcctttcaatgtgtatatttctaaatgtccgtgtttatatttacataaattaaaaaaaacggtttacttgtacgtgtcattttgtttttatcttaaatttttgtgtttttaattttggtgatatatcattttggttgtactttttcacttctgtacatactgttacataacatgcagttttccagtaacactaacttgtgaatgcatattttacaattttatttatatttatttatttatttacttttgagacagtctcactctgtctcccaggctggagtgcagtggcttgatctcggctccctgcaacctccacctcccaggttcaagcaattctcctgccttagcttcccgggtagctgggattacagacccgccaccgcgcctggctaatttttgtttttttaagtagagacggggttttaccatgttggccaggctggtctcaaactcctgatctcaggtgatctgcctgcctaggcctcccaaagtgctgggattacaggcgtgagccaccgcgcccggccccccctttttttttttttgagactgagtttccatcttgttgcccaggctggagtacaatgatgcgatctcagctcaccacaacctccgcgtcccgggttccaacgattctcctgcctcagcctccccagtagctgggattacaggcatgcaccaccacacccggctaattttgtattttcggtagagacggggtttctccatgttggtcaggctgatctcaaactcccaacctcaggtgatccgctcacctccacctcccaaattgctgggattacaggcatgagccaccgtgcctggcaggatagaagccattttaactggggtgagatggtatctcattgtagttttgatttgcatttctctgatgatcagtgacattgagcaccttttcctatgcctgcttgtcatttgtaggtcttcttttgagaaatgtctattgagatcttttgcccactttttgatcagattattagattttttcctctagggttgtttgagctctttatatattctggttattagtcccttgtcagatgggtagtttgcgaatattttctcccattctttgggttgtctcttcactttgtggattgtttcctttgctgtgcagaagttttttaacttgatgtgatcccatttgtccatttttgctttggttgcctgtgtttgccaaattcattttacaaggccagcattaccctaatgccaaagtcagacactacaagaacactacagccaatatccctgatgaacataaatgcaaaaagcctgcacgaaatactaacaaacaaaatccaacagcacattaaaaggatcatacatcatgaccaaatgggattaatccctaagatgcaaggatgggtcaacatacataaattaataaatgtgatataccacattaacagaatgaaggataacaatcatctcaaaagattcagaaagagtatttcacaaaaattcaatgccacttcatgataaaaactctaaactaggtatagatggaatttacctaagcataataaaggccatatatgcctggctaatttttgtatttttaatagagacggggattcaccacgttggccaggctggtcttgatctcctgacctcaaatgatcctcacctcggcctcccaaagtgttgggattacaggcgtgagccaccgcaccctgccacaattttcttctaagataaaaaagtttacataagggttctctgggatggaaacaaaagttggacagagccaggattattttaataaaatacaattaataggagttgtgataaatgaaatgatgccccacaaaagtgcccatgtcttaacccccacgttctaggaatatattatggtatatgacaaagaatagaggctgtagataaaatcaaggatgataatcagatgactctaaaacaaagagattaatttgaattatgagattggtgtctacagccataccaccctgaatgcacctgatcttatctgaattataagtgtgagcctagggtaatcacaaaagttcttaaatgggaatgagaggctaagaaaattaatgctgtgatatgagagtcagatttttttttaatttttttttaaattatgttgggctgggcacagtggctcacgcctataatcccagaactttgggaggccaaggcgggcggatcacctgaggtcaggagttcgagacaagcctggccaacatggtgaaaccccatctctactaaaaatataaaaattagccaggcatggtggcaggtgcctgtaatcccagattcttgggaggctgaggtaagggaattgcttgaacctatgaggcagaggttacagtgagccgagatcacaccattgcactccagcctgggggacaagagtaaaactccgtcacaaaaaaaaaaaaaaaaaaagtatgtatacacggccaggcacggtggctcacgcctgtaatcccagcactttgggaggccaaggtgggtggttcacttgaggtcaagagttggagaccagcctagccaacacggtgaaaccttgtctctactaaaaatacaaaaattagccaggcatggtggtgcacacctttagtcccagctactagggaggttgaggtaagagaattgcttgaatccgggaggtggaggttgcagtgagccgagatcatgccactgcactccagcctgggcgacagagagactccatctcaaaaaaagaaaaaaaaaatatatatatatacacacacacacacacacaattattcttagaatatatatatatatatatatatacatatatatatatatatatactaggtatatagtgtaaaaataatgctgactgtacttttgaaaatttatgtaatagaattaatcaagaattttatgagataaaaaagtgatgattttgaacatacaataaataacatttatgaggtaaagtctattttttttttttgagacagagtcttgctctgttgcccaggctggagtgcagtggcgcgatcttggctcactgcaagctccacctcccgggttcatgccattctcctgcctcagcctcccaagtaactgggactacaggtgcctgccaccacgcccagctaattttttgtgtttttagtagagatgaggtttcaccgtgttagccaggatggtctccatctcctaacctcgtgatccgcccaccttggcctcccaaagtgctgggattacaggcgtgagccaccacgccgggtgtaaagtctattattttcagatattcaaaatatgtttctcttttgcaatttacattattacattccacttatgttttcattgaaaaatgcctctttttttcaagctggcattggaatcttgaccctcagcttcctcattttcttcctcgtcttcacacttcttctgtaatgcaggcctgagcccacagacctgaccatttatcacctggtcttcatccacatagtgatcctccttactctggtgtcattgttgtctccaggtctgcctgagtcactgtattttcagaatgacttcaagtgtaaaggattttttttacctgaacaagatgatgagaagtttctccatctgcaccacctgcttcctgagtgtgcttcagaccataatcatcagccccagaagctcttggttggtgaggtttaaccataaatccaccattttcacctgtcatttcttgttgtttttacattttctcagtttttttttttttcagtagtaatctcatcttgtgcactgtggggtcttctaatgtgaccctgagcaatcttctgcataccagtaaagactgttcacttttccaccatgaactccatcatcagaagactgtttcttactctgtttcttactccagatatgtttttcttataggaacaatgctgctttcaagtgcatacagagtggtccttttgttcaggcaccagaagaaattctgatactttcacagcaccagcctctccccaagaccttccccagagaaaagtgccactcagaccatcctgctgctagtgagtttctttgtggtcatctactgggtcgatttcatcatctcatgcacctcaacctcgctatgggcatatgaccctgttgtcctgggtgtccagaggcttgtcagtcttttggtgctactcagatctgataaaaggataatcattgtgacacaaactgtgagacagagggttaacaagttatttttattgaaaatagattattctgtcaccagttaaattacataagtagtacagaacttgctatttaatttaacttaaatgtatggatttacactttcaatatgtctaaatacttttgaatcaaatgctgccaattctctgtgggttttttttagtttaacatacatgatggatagatactcccatatgtttacaagtgtcttctttttcattttgattttcaggccttaatacagagaacatttttctttctttttgaagtataatattaagaatatcctcctggtaatataatctctctgtcttcgtatttttgagaatgttttatttttatttattaaagatatttgactaaatattaaattcttacactcaatatttacttctccttgttctggcttctatcaaggctgtgtggatggtgcctacaaatttgtggcttacctctgttttttatctccctaattttaagatttttctttctttttagtgttatacagcttgactattatttctgtataaatgatcacctgtatttaccttttttttgaaaactatgtacttctgaattcgagaattttttctggcttttaattttacaaaaaattatttctttctaaaattacatttgtgtcttattctttgtatgtatttcagtgaaacaactgaatatactttattccttctaatctttgtctttatagatctataaatatatttacatcttatatcactttacttttattagcatcgattttctctccttaatcttccagtgcactatttatctcattagcttattctaagttaatagtttcccaatacaatgtatattgaatttatagatttttatttctcatttattcaatttacagttagctctttccatggatgctcttcaatttttaagtttcttcctctttaaacactatttttgtctcttattttatcactgaattgatgtaaacattttaaatacaattccaattattattaatttatgtagcatccaatttcttcttactctaaattgtggtagcttattttgtgtgtgtgtgtacttcataacttcttataatttagctgtcatgattgggagacctttccctgtaaatgtcttcaatcagtatatttgtttgttctacttaacctggcacaatattatcaattttgccttgtgatcagccattcgcttctcacgttgataaagcctttgaatcttttcttgactcatttgtgttcctggaaagttctgatatttttcctttcagccccattgggcattctagagatttttgtaacttttgatgcacaaactttcacactgcacacataaaatattttagttatgtaatgctaccacacatcagcatcttatgagaaatcttgagtctctttacttgaagcaccccctctccaatatacagtatgatacactgatgtgcagaatgtgattagtttattaatcatatgtgaaaatattagtagctacatatggccagaatagatttttctctctacaaatgtaagttagtgttgatagaatttgttatgcgatatttggttctttggtttcagtctcaatgctttcttcttggcatttcattgactctgtaaattaacctcagcatcaattttcttttaaattcaacagttattcaaattgatcgaaaattaaacttgtatgtagctagttatcacttgtgggttacactttaattgacggtttctgatgtcatttcatagtgtctagaatataggacctattggagatctactttcatgaaattactgacataattttgggtccaaaatttcaaaattttaaatatttttatttggaattttaaaataatttatatgctctttttactggctaataatgctattcattataatctgatattcaaactgtctaaaaaagttaacaatcattgatttatttgttgtatatacagtttatttctatgacagttttaatgtcacctaatattatttttaatgtttcaatttctcatttaaatacattttgtgttgtttattttaatctcattcaatctgtatgtgcaaatggcttagaaaaaaaggccatatatgacaagcccacagctaacatcatatagtcaacagtgaaaaactaaaagcttctcctttaagatcaggaacaaggcaaggatgcccattctcaccactcctattcaacatagtactagaagtcctagccagagcaattaggcacgaaaaagaaataaaaggcagctgggcgcggtggctcacacctgtaatcccagcactttgggaggccaaggcaggcggatcacgatgtcaggagatcgagaccatcctggctaacatggtgaaaccctgactctactaaaaatacaaaagattagccgggcgtggtggcgggagcctgtagtcccagctactcgggaggctggggcgggagaatggcgtgaacccaggaggcggagcttgcagtgagccgagatcatgccactgcactccagcctgggtgactccagactccatctcaataaataaataaataaataaataaaaaagaaaaaaaaagaaataaaaggcaacaggccaagtgcagtggctcacgcctataatcccagcactttgggaggctgaggcaggctgatcacttgaggtcaggagttccaagaccagcctggtcaacatgatgaaaccccgtctctactaaaaatacaaaaacttagccaggcgtggtgccacacgcctatagacccagctactcaggaggctgaggtgagagaattgcttgaacccgggaggcagagggtgcaactccagcctgggcaacagagcgagacttcatctcctaaataaataaataaataaataaataaataaatggcaaccaaatcagaaagaaaaaaaactacctgtttacagatgatagaatcttatatctagaaaactctaaacactccacaaaataactgtgagaactaataaacaaattcagtaaagttgcaggatacaaaatcaacattaaaaaatcagttgtgccgggcacggtggctcacacctgtaatcccagcactttgggagacagaggtgggtggatcacctgaggtcaggagctcgagaccagcctggaccatatggcgaaaccccgtctctactaaaaatataaaatattagctgggcttggtgctgagtgcctgtaatcccagctcctcaggaggctgagccaggagaatcgcttgaacccgggaggtggaggttgcagtgagccgagattgcaccattgcactccagcctgggcaacaagagtgaaactctgtctcgaaaaaaaaagtcagttgcatttctatacactaacaatgaactatctggaagggaaattaagaaaataattccatttacaatagcatcaaaaagaataaaatacttaggaataaatttaaccagacgtgaaagacatgtacactgaaaactatgtaacattaattaaagaaattgaagacaataccaatgaacagaaagacatcctgggcttgtggattgttagacttaatatagttaaaacgtctatactacccaaagcagtctacagattcaatgcaatccctgtcaaaatctcaatgacattttctacagaaatagaaaaaaatccaaaaatccatatggaactacaaaaggcctcacagccaaaacaatcttgagaaagaagaacaaaagagtcatcacactttctgatttcaaaatctattacaaggcttcagtaattaaaacagtatgctactggcataaaaacagacagacatagaaaccaatgaaacagaatcaagagcccagaaataaacctcacatatatggccaactaatctttgacaaaggtgctctgaatacacaagaggaaaaggataatctcttcaacaaatggtataggaaaaatttgatatccacatgcaaaataatgaaatggacccttatcttacactacacacaaaaataatttggaatttattttaattattccattattttaataaagaaatttatttttaaataaatgtaaataaatacattttattttattttattatttatttatttttttgagacagattctcactctgtcgcctaggctggaatgcaatggcgtgatcccggctcactgcaacctctgcctcccaggttcaagcgattctcctgcctcagcctcccgagtagctgggattacaggcatgcgccaccacgcctggctaattttttgtatttttagtagagacagggtttctccatgttggtcaggctggtctcgaactaccgaccttaggtaatcctcccacctcggcctccgaaagtgctgggattacaggcgtgagccactgcgcccggcctacatttatttttaaataaatggatttaaatgttaagacctgaacctataaaaatgggacacctgcatagggcattaaccatgagtagagcttgcaggactggaagttgctatgggtgagtcagtgtgtgagtggtgagtgaatgggaaggcctaggacattcctgtacactaccatggactttataaattctgtacacttaggctacactacatttatttaaaatatttttcttttttgggccaggtgaggtggctcacgcctgtaatcccagcgctttgggaggccgaggcaggcggatcacctgaggtcaggagttcgagaccagcctgaccaacatggagaatccctgtctctactaaaaatacaaaattagctgagtgaggtgacacatacctgtaatcccaactacttgggaggctgaggcaggagagtcgcttgaacctaggaggcagaggttgtggtgagctgagatcacaccattgcactccagcctgggcaacaagagtgaaacttcgtttcaaaaaaaaaaaaattcttcctattttttttttttttttttttgagacagaatctcactctgtctcccaggctggagtgaggtggcacgatctgggctcactgcaaccttcgcctccagggttcaagcgattctcctgcctcagcctcctgagtagctgggattacaggcacccgacaccatgtctggctaatgtttgtatttttagtagagacggggtttcaccatgttggccaggctggtctctaactcgtgacctcaagcgatccgtccgcttcggcctcccaaagcgctgggattacaggtgtgagccactgcacccggctcatttaaaatatttttcttggctgactctgggcacactacctatgagttagccctgcttctcaaggagcagtaccattcaaaaaattaaaattaaaaaaagagagaaaaagaaatttaaaaaattttctttcttcgataataaattaacctttgtttactgtaactttatggactttttagtttttaaaaaacttttttactcttttgtaataacacttggtctaaaattaaagacattgtatagttgtacaaaaatattttctttctttatatccttattgtataagttttttctatttttaaaaatattttacatattgcttgagcccaggagtttgagaccagcctgggcaacatggtgaaaccccatccctacaaaaaattcgctgggcatggtggtgcacacctgtagtcccagctactagggagactgaggtgggaggactgcttgagccggggagattgaggctacagtgagctgagattgcaccactgcactccagcctgggtgaaagagtgataccctgtcttcactctctctctctctctctctctctctctctctctctatatatatatatatatatatatagctatatatctagtatatatatatgctatatataggtatgctatatatagtatatatgctatatagaggcatgctatatatagtatatatatgctatatagagatatgctatatatagtatatatatgctatatatagtatatatatgctatatagagatatgctatatatatagtatatatatgctatagagagataaatatatatatactatatatatattttaacattttgaactttttagttaaaactgagacaaacacacacgttagcctaggcctacacagggtcaggatcatcaacatcactgtcttccacctctgtatcttttcccactggaaggtcttcaggagcaatgacaggcatggagctgtcatctcctgtaacaatgccttcttctagaatgttttctgaagatctgcctaagggtgttttacagttaacctttttgtgtacataagagtacactctaaaataatgattaaaactatggcatagtaaacacataaaccagtaacagttgtttattatcatcaaatattatgtactatacataactgtatatgtgattcagtatttttattttattttattctattctattctactcttattttattattttattggaaacaaggtctcactctatcgacagactggagtgcagtggcccaatcctagctcactgaagcctcaatctcctgggctcaagtgatcctcccacctcagcctcctgagttgctgggattacagatgcctgccaccgtgcctcgctacagtacttttataggactggcagcacagaaggtttacaccagcatcaccacaaacacgtgagtaatgtgttgtgctatggttagatgataggaattttttttttttgagacagagtctcactctgttgcccaggctagagtgcagtggtgcaatcttggctcaccgcaacctctgcctcctgggttcaagcgattctccctgcctcagcctcctgagtagctgggattaaaggcatgtgccaccacagtcgggtaatttttgtatttttagtagagatggggtttcgctatgttggccaggctggttttgaactcctgacctcaagtcatccacccaccttggcctcccaaagtgctgggattataggcgtgagcctataatctggccagatgataggaatttttcaactgtattataatcttatgggacaactgtcatatatgtggtctgtcattgacagaaacatcatcacttgttgtatgactatggcatgattccacttatatggggtatccagagtagtcaaactcatagaaacaaaacactaggatggtggttgccaggggctgagaggatggggaaatggggagttgctgttcaatggatattgcgcccggccagccacaccaattcttacaccaagaagtgatggagcacaagtgctgatgggccttaacaccatcataaacatcttttgtttgtcccggggaagaaattcccaactccttccaaaggtctgccaaagtctaccagtatcccaagctgatttccttatcccctcagcagatgctggaaagctggaagtctccttccttctcactctcctgcttgacatctgcacagccattcttcttcctccccttgctccccttcctccccttctccttctcctacttattgagacagagtctcgctctgtcgccgaggctggagtgcagtggtgtcatctcggctcactgcaacctctgcctcctgggttcaagcaattctcttgcctccacctcctgagtaggtgggattacaggtgtgtgccaccacagcaggctaatttttgtatttttagtagagacggggtttcaccatattggccaggatggtctcgaactcctgacctcaggtgatctgcctgtcttggcctcccaaagtgccgggattacaggcatgagccaccggcgcccggccctttttattattatatattatttttgagactgggtctcactctgtaatccaggctggagggcagtggcgtgatcacagctcactgcagccctgacctcttgggcacaagcagtcctcccgcgtcagccacccaaagtgctgggtctacaggcatgagctactgtgcccagtctacgatttttttaaaatttataattattttgtttattcaggcagtacaacatgatgttttgatttatgtacacattatagagagtcaagctaattaacacacccaatacctcaccaatttatcatttttgtgtggtgagaacgttaaaaatccattctttctcctctgaagctgtagaggatggggtgtccctgctttcctttttaacgataaaatcatgtttgttatttcataaaatagttagacagtgaggctttgttagtttgtttaatgtcctaactcggcaaaattgaaaggtggcaacactctgcccctctcccatgcaccatgcatacacacatatgtttacagctaggttttttttggggggggaggtagtatccatatcatgtattaattttcttacaatttattttttcttttctttcagtgacggggtgttgctctgtcacccaggctggcgtgcagtggtgtgatcatagctcactacagccttgacctcccggcctccagctatcctcccatctcaggctcccaagtagctgggaatacagacatgcaccaccacacccagctaatttttctttttctttttcttttttcgtaaagacaggatttcgccatgttcgccaggctggtctcgaactcctagcctcaagccatcctcccaacttggcctccaaaagtgctgggattataggcaatgagccaccatgccctgcctaattttcttacaatttcaaaatataaatatcatatcttaataatttataatgacgtcaccaatattctccctattgtctcaaaaaagtggcaacctttgcagaagggaggatcttctaaaagaacaaaatgaaaaaagataagaattctaacttgggtcttgcgccgggcattgcctgaagcagacagccagaggcaatctttcaggaatggagtgaggaagaaatggggagggagaggtaagcctgggggttctgtgggcagcaggaatcttcagctgctgggaggtaaggggacttctaagaaagtggatgtcctctgtttgactttgttatattttctgctgtgtggcccgggcttgtcagcttgtcatctttctcccttggccctataaacacagagaaacagagaaaagaacaagaattctggggacagtggaattagaaccagaggtgaccaaagggacatattatccaggtggtaactgccggaagtagatgttctttaacagtttaaaaagtgatgatgaggccaggcacagtagctcgcgcctctaaccccagcactttgggaggccgaggtgggtggatcacctgaggtcaggagttcaagaccagcctggccagcatggtgaaaccctgtctctactaaaaatacaaaaaattagccaggcatggtggcatgtgcctgtaattccagctacttggaaggctgaggcaggagaatcacttgaacctgggaggcagaggttgcagtgagccgagatcgcaccactgcactccagcctgggcaacagagtgagactccgtctcaagaaaaaaaaagtgatgatgatgatgacagaaagaatacaatgtagaaaagcttagacccttggctaatggggctttgtttaaccacataggatttaatcccaaccacttctgccaaaattttgttctctagaggccctattctttgctttctttattattattattattattattattatattattttttttagagttgaggagtctggttctgtcacccaggctggagtgcagtggtgtgatcttggctcactgcaacctctgcctcccaggttcaagcaattctcctgcctcagcctcctgagtagctgagattacaggcgtgtgccaccacgactggctgatttttgtatatttatttatttatttatttattttctgagaccgagtcttgctttgttgtccaggctggagtgcagtggtgcgatcttggctcactgcaacctctgcctcccaggttcaagcaattctcctgcctcagcctcccaagtagctgggattacaggcacccaccaccgtgcctggctaatttttgtatttttagtagagacggggttttaccatgttggccaggctggtcttgaactcctgacctcaggtgatccacccacctcggcctcccgaagtgctgggattacagatgtgagcctctgcgcccggccaatttttgtatttttagtagagacggggtttcacactgtttttcccaaagtgctaggattacaggtgtgagccacctcacctggccccattcttttgctttctaccctttcttaaccctgttcccaaaatgtatgcgtctgtggctggaatatgttaaagggaagtagctttccacctctgtattggttcattctgactctgctttttcttgcacctgtgctcttctttttaaaatgtttttgagtgtttttatttaacactaatacacattgggtttggccaaatagatgtcttttcatccctgtgcccctctgcaatgatacatttctggagaggagaggccaggcaggtttcattatccttacacattacctggcaagctgccatgtgcaacaggtatttaatacatattttttgaaaaacaatctctcatgtctttggaatcattgggaactacaaccaagtgaaggcagtagaagttggtggctgatgaagtgcctacaatgcatgctatttctatagggaagattccaaacgtacgtcaattgttagtaaaggaattgatagaggccaggcatggtggctcatgcctgtaatcccagcactttgggaggccggggcaggcgaattgcttgagcccaggggttcaagatgtagcctgggcaacattgtgagattccgtctctactaaaaatacaaaaattagccacatgtggtggctcacacctgtagtctcagctacttgggaggctgaagtggaaggatcgcctgattccaggagttcaagaccacgctgggcaacatagggagacctcgtcactaccaaaaataaaaaaaattatctgggcgtggtggctcatgcctgtggtcccagctacttaggaggctgaggtgggaggattgcctgagccaaggaggtcgaggctgcagtgagctgagatcatgccactgcactccagcctgggtgacagaatgaaagcctgtcccccaaaaaataaaataatgaaatcatgagctaaaccaagtacaaaattaataaataaaaagattaaaaataaaaataaaataaaggaatggatagaagggatgaattgtcaacaagatcccgatatgttttcccttctgatttcaagtatctaattcagttattcattttaccctgagggtggcagcaggagtctcttctatcgcccaagcgttgccaagaggcaacttttaggtcactctgacatgagctaacagatgcagtttctggttagagagcttggacagatccatgccatttcctctcccttacaaggttggggggaaaggctgcgtgcggcctcaggaaaccctggggagcagcagggatcctccccagctgtcgcccaattagaaagccagtgatttaacagaaggccaagaagactcacagggccaggcctggggttctctttgttccaccttttttcccatgctgagaaatgaaagagaaaaacattgcatgacaagaattaatggtgtcaaacaaatagcatcaaagacaatttaagtattgctcttctctctcggaaatggatgaagacaaagagtagtggcttcctttttacccattaactgctctacatttggaaagagctggtggacagtgttttcatactgtatccattcagcttgatgcttacaaatgtacagttcagaaatttttcaaggaaacagtttgctacaaagcacatagtttcctctgatcataaccatgacctcgtttataatcataatcttgtttataatctcaggatgccaacatgcccaaaatgactttggaatcattgttttaaaatttcatctttttttaagactttattttttagagcagttttaggttcatggcaaaattgagcagaaagtgcagaaatttcccagataactcctgcccctacacacccacaacctctgtcactatcaccacccctaaccagagctgtacagttgttgcaattgatgaacctgcaattgacgcatcatcatcacccaaagtccatagtttacattatgactcactcgtgttgtatattttatgggttttgacaaagatacaaggacacatatccatcattgcagtatcatgcagagtagtttcactgccctaaaaatcctctgtgctccacttattcatctctccttcccctcaactcctgtaaaccactaatctttttactgcctccttagttttgccttttccggaatgtcatatagttggaatcatacagtatgtagccttttcagattggcttctttcacttagtatatcagtctgttctcatgctgcttataaagacatacccaagactgggtaatttataaagaggtttaacggagtcacagttccacgtggctggggaggcctcacaataatggtggaaggtaaaaggcatgttttacatggtggcagataaaagagaatgtggaccaagcaaaagggttttccccttatgaaaccatcagattttgtgagacttattcactaccatgagaacaatatgagggaaactgccccccatgattcagttatctcccactgggtctctcccacaacgcgtgggaattatgggagctataattcaagatgagatttgggtggggacacagccaaacctatcacttagtaatatgcatttaagtttcctccatttttttttttttttctgagacagagtctcgctctgtcacccaggctggagtgcagtggcgcgatctcggctctctgcaacctccgcctcccgggttcaagtgattctcctgcctcagcttcctgagtagctgggattacaggcgtgtgccaccacgcccagctcatttttagtagagatggggtttcaccatgttggccaggctggtctcaaactcctgacctcaagtgatccacctgcctccgcttcccaaagtgctaggattacaggcatgagccaccgcgcctggcctcttccatgtctttttatggcttggtagctcagttctttttctcactgcataatattccactatctggatgtaccagtttatttatccactcacctaccaaaggacattttggttgcttccatgtttttgcaattatgaataaagctgctataaacattcctgtgtgtagatttacgtggggacataagttttcaagtcatttgggtaaatatcaaggaatgcaattactggatggtatagtaagagtatgtttagttttgtaagaagccgccaaactgtcttccaaagtggctgtgccattttgcattctcatgaatgagagtttctgttgctccacatcctcgacagcatttggtgttgtcagtgtgttgttttcaccattctaataggtgtgtagtggcatctcactgttgttttattttattttttatttttttaattttgagacagggtttcactctcgttgcccaggctggagtgcaatggcgcgatcttgactcaccgcaacttccgcctcccaggttcaagcaattctcctgcctcagcctccctagtagctgggattacaggcatgtgccaccacgcccagctaattttgtatttttagtagagacggggtttctccatgttggtcaggctggtcttgaactcctgacctcaggtgatccgcccgccttggtctcccaaagtgctgggatgacaggcatgagccactgcgcccagcctaactgttgttttaatttgcaagtctctaatgacatatgatgttgggcatcttcatatgcttatttgccatctgtccaccttctttggtgaggtgtctattcaggtcttttgcccattttttaatcaggttgttcattttcttaccgttgagttttaagagctctttgcaattttggataatagtcatttatcagacacctcttttgcaaatattgtggcttgtcatttcattcacgtttgtggggaggggggaacggagtctcactctgtcacccaggctggagtgcagtggtgcaatctcggctcactgcaacctctgcctcctgggttcaagcaattctcctgcctcaacctccaagtagctgggattacaggtgcacactaccacacctggctatcatctcattctcttgatcatccttttttcttaaattaaaaagtgagcaatttctttgcagtcagaacaacatttctgttggcagtgtgtggtggtaaagagggggactctggagttagcttggatttgaattccagttctgccacttattagctgtgccagttactgaatgtctctgtgctgcactttcctcatctttaaaatgggtatatgagctgggcgtggtggctcatgcctgtaatcccagcactctgagaggcagaggtgggtggattgcttgaggtcaggagttcaagaccagcctgggcaacacggcaaaatcccgtctctacaaaaaatacaaaaattagctgagtgtggtggtgcacacctgtagtctcagctacttgggggactgaggtgggaagatcgcttgggcccaggaggaggaggctgcagtgagtggagatcgtgccattgcactccagcctgggcgagagagtgagactctgtctccaaattaaataaaacaagatggagataaacccgtactcatagggttgctgtgaaaattaggtcaattaatataattagtataagagatttaaaacagtttctgcaatatttattattaaattatttgattagaacaaaagatatagtttgcacagtggcagagacatgcatgaaaagcaatggtagacatttctgacatgaagggcatgccttggcagccttttaagatcattctccactgagcagcagcagtttcgttttagaagtcacatcaaagctactttggcttttgcaaggcgatttctgtgcattatgcacagaatgacataccaacctaagaaaattgatctactagcaattagtgagatggagcaggagaaggagctagcttgctatggaaaaagtgacaaagagatggactgagttgagacacttagaggtctctgacactaactggctgcctcactttgtacaaatcactttattcatctgtttcaggcttccacttggttttgttttgttttttgagataagagtcttgctctgtcatccaggctggagtgcaatggcgtgatctcggctcactgcaatctctgcctcctgggttcaaacgattctcctgcctcagcctcctgagtagctggaattacaggcatgcaccaccaggcccagctaattttttttttttttttagtagagatggggtttcaccatgttggccaggatggtctcgaactcctgacctaaggtgatcagcctgcctgggactcccaaagtgctgggattacaggcgtgagctaccacgcccggcccaggtttccacttttgttatgaaggtgttacagttatcagggctggggatggatatgcacattaatcgtgttttttaattttctgtatttcatgatgctttgacatcttggggccttgctaatcttggagagactgtccctcccagggctaactaattcctacagaacttgactctgagcatgcttttgatatgcaaaccaacaatcatgagaccatacccaaaccacctcctttttctaactctcacacaccagccaatattccccctccagggccaggtactgaacaactaggggccaccctgtagcccaccaaaatcattcaaactatccagtcctaaggtttctcagcttgccaatcctgtctcatccattccttcccataaaacctacaataaaggctctgggcccatgctttctcctcactcctgactcctgactgaccctggtgcctcccatgtggcccttgcatggccatggcttggcaagccccctcctcttgagaactgtgagtaacaaactatcttttcaatggcagttgccttgtgatctgctgggctcaccatacctcaatttttaaagattcttggttatattttaaaacaatctaaccccaggtgctaactctggtggctgcttaatagctgtcccaagtgagggatgagaaaaatcttcaggttgagtcaaaatatcaatgtctgccctgagcatgggttgtgaggaataaagatgtgagagaaagggtttgtcctccctgacacagatgatctctaggggcccttgcagctctaatatctaagcattttagaaagtattttaaggccaggcacagtagctcatgcctataatcccagcaccttgggaggctgaggtgggcagatcacttgaggtcgggagttcgagaccagcctgggcaacatggcaaaacccccatctctactaaaaatacaaaaattagccaggcatggtgccacatgcctgtaatcccagctactcgggtggctgaggcaggagaatctcttgaacccaggaggtggaggctgcagtgaactgagatcacaccactgcactccagcctgggcaacaaagcaagactctgtctcaaaaaaaaaaaaaaaagaaagaaaggaagaagaggaacaggagggaggaggagggatctgagctagcacgctcagccccttgccaagtgataccctgcactgtctcaggactcttcagagtcctcaccagcaaaaagtcccccaccagatgcagccccttgaccttagacttctcagcccccacaactgtaagaaagaaattcatttcctttaaaattacccagtttcaggtattctgttataagcaacagaaactggactaagacaggaaaacacaaacattcagtccattgccttccaacacctgcctgcccccgacaattcatgtgcttctcacatgcaaactacattcaattccatccaaacatccccccaaatcttaactcattccagtatgaactctaaagtctaaagccaaaagtctcatctaaagatcatctaaatcaggtatgggtgaaactcaccctgaagcaaaattcctcttcagctgcttaaaagaaaccaaagtatttgcttccaaaatacaatgatgggacacaaagagggtctataaacattcccattccaaaagggagaaacagggaaggaggacggggtgacaagtcccaagcaagtccaaaacctagcaagggaagttctgtgagatcttgagactcaggtaatcctctttggcttgaagctttgcctccagacctactggggtgtcagtccctcatgccagacccactgagggggcaatgtcaccctcacagtgagagacaggactagctggatttcctaggctgactaagaatccctaagcctaggtgggaaggtgaccgcaatccacctttaaacacggggcttgcaacttagctcacacccgaccaatcagggagtaaagagagctcactaaaatgctaattaggcaaaaacaggaggtaaagaaatagctaatcatctatcacctgagagcacagcgggagggacaatgatagggatataaacccaggcattcgagcccgcaacggctaccctctttgggtctcctccctttgtatgggagctctgttttcactctattaaatcttgcagctgcactctcttctggtccgtgtttgttacggctcgagctgagctttcacttgcagtccaccactgctgtttgccgccgtcgcagacccgccattgacttccatccctccagatccggcagggtgtccgctgtgctcctgatccagcaagccgtccactgctgctcccgatcgggctaaaggcttgccattgttcctgcatggctaagtgcctgtgtttgtcctaatcgagctgaacactagtcactgggttccacggttctcttccgtgacccacggcttttaatagagctataacactcacgcatggcccaagactccattccttggaatccgtgaggccaagaaccccaggtcagagaacccgaggcttgccaccatcttggaagcagcccaccaccatcttgggagctctggaagcaaggacccccaccccccggcccggtaacaacagtttggcagcactcactgctcatgctgtggttgtcagggcaggagttgtagcctcagggctctgctgggagcctccatccccaccgctctactgggcattggtctcaccctttgaaatggaggtggaggctgggagtggtggctcacacctgtaatcccagcactttgggaggccaggacaggccagtcacaaggtcaggagatcgagaccatcctggctaacagggtgaaaccccgtctctactaaaaatacaaaaaattagctgggcgtggtggtgggcgcctgtagtcccagctacttgggaggctgaggtgggagaatggcatgaacctgggaggcggagtttgcagtgagccaagattgtgccactgcactccagcctggatgacagagcgagactctgtctcaaaaaaaaaaaaaaaaaagaaatggaggtgcaggtagtcctatgccctaagcccatgtactctgggcctctgatgggactggtgacctggacggtctctgaatcaccttcagggttcttcttcccttatcttgaagaacagtgtgtgttcacagccgaatagttctatggtttggtcctataggatctaagaagtttaatcatcttccttcattttgtcccattttctttttttctttttcttttttttttttgagacagagtctccctctgttgcccagcacccaggctggagtgcagtggtgcaatctcagctcactgcaacctccgcctcctgggttcaagtgattctcctgcctcagcctcccaagtagctgggattacaggcgtgcaccaccgcacccggctaatttttgtattttcagtagagacagggtttcaccatgttggtgaggctggtcttgaactcctgatctcaggtgatccacccgcctcagcatcccaaagtgttgggattacaggcatgagccactgtgcccagccattttgtcccattttctctgtttcctttagtcccagtcagcagtgccatttccagtacaatcccatcgctattgctgttttgttgagatggttaatgaagtccacagttcacattcacagtaatctccttgtcaaatagtccagcagatccttagtgttctcttccaaacatgctttgtcatgttttgtaatatggacagggacaggctgagaattttccagacccactgagggagcaatgtcaccctcatagcttgggtaagtttaagttctggttcctttttgcataacaattctgttttcaattcatatctctcttctcaaatttgactataagcagtcaggaggaaccaagcctctcctttcaacactttgcttagagatctcctcagctaaatctccatttcactgttcacaagtcctaccctctacaaaacactaaaacgtaaacacaattcagccaggttctttgctactttataacaaggatcaccttttctccactgtccaataacacgttcctcatttctacctgagaccacatcagaacagcctttaaccacccatatttctaccaccaatctgttcatgattacttatgtattctttaagaaagcagaagctttctctacagctctcctcatttctttctgactgctcatcagaatcacctttaaaggtccattcaatggcaatataggatttttctttttttcctttttcttttttttagatggagtcttgctctgttgcccaggctggagtgcagtggcgcaatcttggctcactgcaacctccacctccctggttcaagcaattctcctgcctcagcctcctgagtagctgagattacaggtgtgcgccaccacgcccggctaatttttttttttttttttgtatttttagtggagatggggtttcaccgtggtggtcaagttggtctcaaactcctgacctcataatccatccacctcggcctcccaaagtgctgggattacaggtgtgagccaccgcacctggtggcaatataggatttttctagcgcatgcacccaaatttatgtcttagtctgttttctgttgctataacagaataccacagaccaggtaatttataaagaaaagaagctcagccaggtgcagtggctcacacctataatcccagcactttgggaggccaaggtgggtggatcacttgaggtcaggagtttgagaccagcctgactaacatggtgaaacaccatctctactaaaaatacaaaaattagctgggcctggtgatgaatgcgtgtaatcccagctagtcgggaggctgaggcaggagtattgcttgaacctgggaggcagaggttgcagtgagcagagatcgtgccactgcactccagcctgggtgacagagtgagattctgtctcaaaaaaataaaaaataaaaataattttaaaaagaagcttaacaagctcacagttctggaggctgggaagtctaagagcatggtgctagcatcagatgaggccttcatgctgcatcatcccatcatgggtagacagaatggcaagagggtgcatgcgagagacagctcacttttataacaaagccactcccacaataacagcattagtccattcatgaaggtgacagccccatgacctaatgtcttcttaaagaccccacctctcaatactgttacaatggcaattaaaggtcaacatgagttttggagggaacattcaaaccatggcactcttccagcctctagtcattacaattacaaggccacttccacatttttaggtattcgttacatagcacccctcacttctcagtaccaatttctgtcttagtcagttctgactggtataacaaagtgccatagactgggtggcttataaacaacagaaatttctctcttaacagttctggttggaagtctgacattacggttccagcatggtcaggttctggtagggatgctgtttagggttgctgacagctaaattttcattgtatcctcacattgtggaaagaactctctggggtcccttttatttatttatttatgtatttatatttttctgagacagagtctcactctgtcgtccaggctggactgcagtggcaccatctccattcactgcaacctccgcctcctgggttcaagcgattctcctgcctcagcctcctgagtagctgggattacaggcaaacaccactatgcccagctaatttttgtatttttagtagagacagggtttcgccatgttggccaggctggtcttgaacttctggcctcaggtgatccacctgcttcggcctcccacagtgctgggattacaggcgtgtgccactgcgcccagcctggggtccctttcataagggcaccaatcccattcatgagggctccactgtcatgacttaatcacctcccaaaggtcccaccttctaatactatcacattaggggttaggatatcaacatgtttggggagacacaaacattcagtctattgcacagccttttaccttctgcaaataaaactgcttccagtatacccaaagctgtactaaaacctctttttttttttttttttttctggttttcctaggcagagtatttgtgtccctgggtacttgagattagggagtggtgatgactcttaaggagcatgctgccttcaagcatctgtttaacaaagcacatcttgcaccgcccttaatccatttaaccctgagtggacacagcacatgtttcagagagcacagggttggggggtaaggtcacagatcaacaggatcccaaggcagaagaatttttcttagtacagaacaaaatgaaaagtctcccatgtctacttctttctacacagacacagcaaccatccgatttctcaatcttttccccacctttcccccttttctattccacaaaaccgccattgtcatcatggcccgttctcaatgagctgttgggtacacctcccagacggggtggtggccgggcagaggggctcctcacttcccagtaggggcggccgggcagaggcgcccctcacctcccggacggggcggctggccgggcggggggctgactcccccacctccctcccggacggggcggctggccgggcggggggctgacccccacacctccctcccggacggggcggctggccgggcggggggctgacccccccacctccttcccggccacctccctcccggatggggcggctggccgggcagaggggctcctcacttcccagtaggggcggccgggcagaggcgcccctcacctcccggacagggcggctggccgggcggggggctgaccccccacctccctcccggacgggacggctggccgggcggggggctgaccccccacctccctcccggacgggacggctggccgggcggggggctgacccccccacctccctcccggacggggtggctgccgggcggagacgctcctcacttcccagacggggtggctgccgggcggagaggctcctcacttctcagactgggcggctgccgggcggaggggctcctcacttctcagacggggcggttgccaggcggagggtctcctcaattctcagacggggcggccggacagagacgctcctcacctcccagacggggtcgtggccgggccgaggcgctcctcacatcccagacagggcggcggggaagaggcgctccccccatctcagacaatgggcggccgggcagagacgctcctcacttcctagatgggatggcggccgggaagaggcgctcctcacttcctaggtgggaaggcggccgggcagagacgctcctcactttccagactgggcagccaggcggagaggctcctcacatcccagacgatgggcggccaggcagagacgctcctcacttcccagacggggtggcggccgggcagaggctggaatctcggcactttggggggccaaggcaggcggctgggaggtggaggttgtagcgagccgagatcacgccactgcactccagcctgggcaccattgagcactgagttaacgagactccatctgcaatcccggcacctcgggaggccgaggctgacggatcactcgcggttaggagctggagaccagcccggccaacacagcgaaaccccgtctccaccaaaaaaatacgaaaaccagtcaggcgtggcggcgcgcgcctgcaatcgcaggcactgggcaggctgaggcaggagaatcaggcagggaggttgcagtgagccgagatggcagcagcacagtccagcttcggctcgacatgagagggagaccgtggaaagagagggagaccgagagggagagggagactgagagggagagggagaccgagagggagagggagaccgagagggagagggagagggagaccgagagggagagggagagggagaccgagagggagagggagagggagagggagagggagagggagagggagaggaaacctctttctttagcactattcatgttctcttctcctggacgtcagtaccttaaatagagtcatcctccctcatggactccacacttctctctctctctctctgtctctctctctctctctctgagatagggtctcactctgtcacccaggctggaatgcagtggcaagatcatgggtcactgaaacctccacctcccagggctcaagtgatcttctcacctcagcctcctgagtagctgggactacaggcatgtgccacagtgcctggttaatttttgtattttttgcagagatggggtttcactatgttgcccaggttgatctcaaattcctgggctcaagcaatcttcctacctcggcctcccaaagtactgggattataggcatgagccactgtgcctagccatatatccttctctctcttatcctactccagtctggctttggtccgcacttgttcactgacattcctctctgtgacatgatgagttctctgtgggcacactgagtttgaggtgtcaaagcacataaaaatggaaaggtctactaggcagttgtttatgtggtccaactctcttttggttcatatttgcttggtgtatctttttccatccctctattttcaacctttctttgtggttttattctaagcgtgtttcctgtcacaggtctgtagttgaattaacaacaacaacaacaaatccaatctgataacctctgttttcaacaggcatgtaatcatttatatttattttgattacttatgtattggaacttatttctaccatcttatgtttgctgtttactaccccgttccccctcatcttttcccattatatgttagatggataaagtttttgaaattgccccattacacattttattttttcctttgctggttctgaagttatagatggtatttctcctcatttagtggtttccattaatttttaaagttcctgaatctcatgcttccagtatcaacatgcctaaccagcagggcctccattaatttttaaatatatgttctaaattataaatttaagagccaggcacagtggctcacacctgtaatcccagtgactttgaaggctgagttgggaggatcgtttgaggccaggagtttaagatcaaactgggtaacatagagagatcccatctatacaaaatttttttttcaatgagccaggtgtggtggcacatgcctgtagtcctaactacttgggaggttgaggtgggaggatcccttgagcccaggaatttgaggctatagtgagctaggattgcagcactgcactccagcctggataacagagtgaaacaaataaaaaataaatacttatgtttctataaatttacatacatagataaatattaaaaatatattaagccagctatagtggcacacacctgtagtcccagctacttgggaggctaagctggcaggatttcttgagcccaggatttcgaggccagcctaggcaacataatgagaccccatttctttaaaaaaaaaaatatatatatatatatataaatatatatacacacataaacacacaaaccaatatccaaaaaatatatctttaaaaatgtattgtctcagccggacatggtggctcatgcctgtaatcccagcactttgggaggccgaggcaggtggatcacaaggtcaggagatcgagaccaccctggctaacacggtgaaaccccgtctctactaaatataaaaaaaattagccaagcatggtggtgggcgcctgtagtcccagctacttaggaggctgaggcaggagaatggcgtgaacctgggaggcggagcttgcagtgagccgagatcgtgccactgcactccagcctgggcgacagagcgagactccgtctcaaaaaaaaaaaaaatgtattgtctccagttcatcagtatatgtattatctacctactcttaaaagaataaaggccaggcgcagtggctcacgcctgtaatcccagcactttgggaggccgaggcaggtggatcacgaggtcaggagattaagaccatcctggctagcatggtgaaaccccgtctctactaaaaatacaaaaaaattagccaggcatggtgacagatgcctgtagtcccagctacttgggaggctgaggcaggagaatggcatgaacctgggaggtggagcttgcagtaagccaagatttcgccactgcactccagcctcagtgacagagcaagagtccgtttcaaaaaaaaaaaaaaagaataaagacacagtgaatcaagttctttaaaagcagagccaagaagagtcctgtgataggcagcttctgacatggccccaatgatttctgccttctgatatttacacccatgtggaaatccctgcacttgagtgtgggctgaacctagtgaccagcttctaatgaacagaatatggcaaaagtgataggatgtaggatgtcacttctatgattaggctccaaaagattgtgacttctgatgtgctagttctctctctctgtcactatctcttgccctcttctttgctccctctgatgaagccagctgccacagtgtgagctgccctatggagaggcctctatagcaagaaagtgaggccttcagtccagcaaccctcaagcaactgaaacctgccaacaaccacatgagtcagcttggaagtggatccattacccatcaggctttcagatgagaccacagccccggctgccaccttgattccaacttcatgagagatccagagacagagaacctagctaatctgtgactagattcctgactcacagaaactatgagataataaatgtctgttgttttaagctgctaaattctaggtaatttgttacacatcaatacatggctaatacaaagattttttttttctgtgacaactttttttatcatatggagaggcaaaggtggcacagactctacaatcagccaaacgtggctgtctcttgccttgggcaggttatgtaatccctgagctcagtcttctcacttgtaaatcttttttgttttcttccccttcctccctccctccctccttccttcttttttttttttctttttttttcttgacagagtcttgctctgttgcccaggctggagtgcagtggcatgatctcggttcactgtaacctccacttcccaggctcaagcgattctcatgtctcagcctcccaagtaactgggactataggcatgtgccaccacgcctggctaatttttgtatttttagtagagatgaggttttgccatattggccaggctgatctcgaactcctggcctcaagtgatccacccacctcggcctcccgaagtgctgggattataggcctcacttgtaaatctaagctaacaatgcctgccttgcatatgagcttttcagattgttaataaggtttaagagggcatggcacacagtaggtcatcatctttatgacctccattcttgtaaatctgatgctcattccaatttcagtgttctgggttcttcaaaaagtccccaccactaaaactttgctttatcatgaagatttcactcagtccattgtgtgatagtattcataaagcacctgaaagtactacctctcaaatgagtatctcccgttctcaaaatcaatgccacacatagactctaattcaaccatggtacaggggatggtgaattaggcctggagcctctaagcaatggcctgccatccaacatcaaatcatgctgaaaatcctttttttttatactaagacaaaaacacaatcaaagaatcattgcagtttctatgtgaatgaacctcatatgaaatcctctgaacagcagtggctcatatctgagagggaaggaggatgtgagaacatctacattactagatcttcatgaatgggctgctgaagtctggcttttccctgtactaaatctctctgtaattttgtgcctgctcatggaaactgcattcacaaatagtatattatgcatatacacagacttacacagacaacctttgcagataaaaagcaaatccctgccaatgataaacaaaatgaacataaaacctattacagtcttagattatcttctaaaccttacattctcttatgcttaattcttttcatttttaattttaatttttaatttttttattttcctgttctcctcagctgctcataatttgtatttttagagacagggtcttgtgctatcacccaggagtgtagtgacctgatcatggctcattgcagcctcgacctcctgggctcagtgatcctcctacctcagcttcctgagtaactgggattaacatgcccggctaatttttgtatttttagtggagatggggttttgccatgttggccaggctggtctcgaactcctggcctcaagtgatctgccagcctcggcctcctaaagtgctgggattacaagtgtgagccaccgtgccaggcctatgtttattatgtatatatttttacatttaatatgcataccttttcttatattcttgtatttcatacacataatggtcagcagcctgtatatactaccctggatcttttttttttttttttttgagatggagtttcacccttgttgcccaggctggagtgcaatggcacggtctcagctcactgcaacctccacctcctgggttcaagcgattctctggctggcattacaagtgtgagccaccacatccagccttaccctaggtattttagaacaattacagacagtaaatacctatcaatctatacctatatctacatatcttaagaattttatta

SEQ ID NO: 168 - DNA, 15255 bp, Homo sapiens
  source 1..15255: mol_type = genomic DNA
attgtgacagattgtggacatgtttatgtccaaaggagatgaatatgaatgttctgagtgtggctagatgtatatgtacaggtttgagtgtatgcatatgtagtgtgtgagagtctgtatgtccaggtgtgtgcacttgtggatattttatgatagtgtatgtgtgcgtcatacacacatacatcttcgggggaggtaggtacatatgtttctgatcaaggagcaagttgcatgtgagtatttaatggtaaacttgtgtgtgtgtgtgccaaaggagtaatggtgacttactcagggctgtgaatccgagtgtactatgtcctctactgcttgcctggggagcagaggttgagtgctacagaaataggctctcatggctgggctggggcccaggcacacaaggccctagacacatagccttaatctgcacaggaggaaggctgtgtccacgcaagaactgtcgtcatgtttagaaacttggtgggtagtctggagaacaaagggaatgtgaccttcttccatgatcagatttgccacaggtttattcccctgctctttcttccacctcatagataagaataaggaagtggtgaaggtgaactcacagccctcagctaatttctcctatgttcccctctccctgcccccttcttccccttgcagcacccccagtgtctatgagcagcaagctccaagttggcctctaaagtcactggatgctctgttccctgtggttgtctcaggcctgttactgtaagcagggatgcctgggcaaagcccacctctattcctggagctcagctcactgaaaacctaagttggttgatacccacccaactgccttttcgcttgtctcctccaggaatcaaaggtctcttgtcctatcctatcccttttcctttctcccctttttatttcccctggttaggactgggctagaggcccactatcttagtccattttgcattgctatacctaagactgggtaatttataaagaaaagaggttctgcagagtgtacaagaagcatggtgctggaatctgcttctggtaaggacctcaggaaactttcaatcatggcagaaggcaaagggggagcaaatgtgtcacatgacgagagagggaggaagaaggtgagggggtgtcaggctcttttaaacaactagcttccacgtgaattaatagagagagaactgaattattaccatgaggatgacgccaagccattcctgagggatccacctccatgactcagacacttcccattgggtcctaactccaacactggggatcaaatttcaacatgagatttggagaggacaaaaagccaaactgtatcagccaccttaccccctcctcccagaaaacagaaaaagaggccagtgcatgtctagggggagaggaattgttggaggattatcagagcctggggccagagcacttgcctgactccctcacatcagctcccttttcttgctccacagactgtcaaactcaccttcttccactgtgcctatttcctccagttgtcagagctctagaagttcttttgccagatggcctgggatagagacctgtgggctctgcaaatgtctgaaagtcctttataagggtggatttaatggttgagactggacaaggttttggtcaagggtctgggctttggattctcttttgcctctctgggatccctggggcccatgctaaggacccatgacatggcaaccagggtgcctgacttggcccaaagataactgagccttagtcctgagttcaagcctgtctttgtctcctttatataggcagaaaatgatgttcatgttctgcaaagtggacattttcctctaccaggccatcaaccatattcattgcaagcaagctgatttaggcagagctgcaggcagtctgtatgttgatacacagatttcctcttccacatcatctccacctttcagttcctgacacccacaaagctccttcctctatttttttgggctgtttacaagtcttggaaggtctaattctctccagcctctacctagaagtgaaaatatagggatagaaaagtggtttaggattttggataacttaagtttcatccttcccaattctgccacctgatgcaaatctctttgctgctctggcctcagtttcctccagctataaaatggattcattgtaagttgccctgcccacttcccagggcagttggagaacagtctttgaaggttgggtattgacatgtctgcatgcaaaataagctagatgacatgtagacctggtttcctagagaaattagattgtgggtatcagagcactgaacaatgtatctggaaggtgaacatccttgcagaacaatatgcaaatgatttctctggtcttgagcttgagagcacagttaatttttgaaatattctatatagccctgctcatagcacattgcctctttagggaaattcctagttctaacctgaaactccttctcaatttgttaccacattcttctagggttttgagcctggctctggttgctcaagcaacatttgggaacctctgacttgaaggaaaatgactagcaaagatgtttccctaaccttttcattctctgcttttttttttttttttttttttttttttttgagacagtctcactctgtcgcccaggctggagtgcagtggcatgatctcagctcactgcaaactctacctcctaggttcaagcaattctcctgcctcagcctcccaagtagctgggattacaggcactcaccaccatgcctgttttagtggagatggggtttcaccatgttggccaggctggtctcccaggctggtctcgaactcctgaccttaagtgatccacccgcttcagcctcccaaagtgctgggattacaggcgtgagtcaccgtgcctggcccattcattgctttttgatcctttgaggatatgcagtcaactcgctgtcttatgctgtttccagggttctgtttaaaaaggggtgtggcactcctgcttgaaggtgaggcctgaaaagtgggaacagtgggttatctggattgctgggatgaggacaagaggacagagtgtgtatagagtcctcatttgctttttcagggcccataatttgggttctgcaccctaaagctgactactccagcatcctttaacatggctagaggagtatttaggggctctttatccccaaatgtgagataaactgtggctgacttgctggagaaacttccctttaggcttcttcaccttcaagtcagtggtggtggagagcagagaggagcattgacctagacaggccctgagattatttttccagagataagtgtctatctcatgaatgcacagtttatcaggacccattcattaggtttcttctgggtggagtgttttcatggaagttggaaaggagccttcacactttggtctcctgctcactgaggaggcaggacctatgtatccagatattgaggtgccatcctctagttagactagatggcagtaccacatggggtgaggggttgtgggggtggccccaggctgagggttcagcttcatgccttttttaaagctccctctgtacaaccttctcttttccttttttcccttaacttcttttgtctcttgattgttactcactcctctcattccccaacagccctctctaccattcttccattgttttgcttcctgcctatcattccctggccataagcatccaaaatgaatactcggctgggtgtgatggctaacgcctgtaatcccagcactttgggaggccgaggtgggtggattgcttgaggtcaggagttcgagactagcctggccaacatggtgaaacccagtctctactaaaaaaaaaaaaaaaattagccaggcatgatggtgtgtgcctgtaatactagctgcttgggagactgaggcaggagaatcacttgaacctgggaggcagaggttgcagtgagccgaaacggtgccactgcactctggcctggggtgacagagcaagactctatttcggaaacaacaacaacaacaacaacaaaaacctaaaatgaatactcacaaatgcattcacttatacccagctgtacaaaagatggctctctaattcctgggggaaagccaagcaaggtgaagaggatacagatgttgtagagcaattcattgctcccaaggtcttcaaaactcagcagaggtcccagtgagaattcagggatcaggctagccaacctcggttgagaaagaccccatgtccttcccttcccttcctttccttttttgttttttctcttccttattcttactcctttgaaaaattccttgctttccttttctttaaatatgacaaaggctccctcaccaggggtgactttcaagagcagggccatgcaaggaataagaggactgtgtggaaatggctctctcctcctcacaatgtttctttaactgaagagagagcaaggaaaccatttccattcctactgcttccttaggtctccccaggaacagatggttactgtcaaaaccagtgagtggataagctggttgagaggaagcccctgctagcagagtatagagggctgggccctggattaggagtccagagccctttatatatccatgggagggaggtaaacagggagagagggagaaggaagcagagggagagagagggaaaaggaagtagtatattctaagctatttcctacagaatctttttcttgcttagatgtaagtccaggtctggcaagggcagggtgggcagagggaacagtggtgggcatgggatgggcacaaaagtgcctctgtcctctgtgctgaggattcaaggtgaggtgagaaccagacttagtgtctccatgaatcaaaaatatggagtggaaaagcaaaaaatttagttgaaggaactttttatttggtaagcttcatgccaagaagctcagctaattgttttccactaaatcaatcaggtgaaccaatttgaccaaaacggaccaaatggtctgcttagttttgatgtcatgtaaacaataacttctccctgggccccagttttcctactaatactagtcttatgtatgatgcctattacttatataatagcaacactatagaattatttcttaggttagtttctctggttcgggatacacttctcccccaccttcaattccaaaacagctgctcagagctagaagagagctgcattccttttttttaacagctactcagaggtagaagagagctgcattccaccccccacacacccttttttttttttttttttttttttttgagatggagtctcactctgttgcctaggctggagtacagtggtgcaatctcggctcactgcaacttccacctcctgagttcaagtgattctcatgcctcagcctccccagtagctagaattacaggggcccaccatcacgcccaactaatgtctgtatttttagtagcaacggggtttctccatgttggccaggctggtctcaaactcctgatttcaggagatccacccatctcggtctgtcaaagtgctgggattacaggaatgagccaccgcacctgggcatgcattcctcctcttaaaatttcattctttgacattccagtgaaggatgaggagtttatctgcaacatggcagctgttaacctggaaggtctgcacaaagtggcccaattgtagtagcattccagttgggatcagaccccagtgctgcctcctctaaccagcatccaaacttctaatcctaggctggctggatatccttcaaatcttctgggttccatggagttggttagacttttcctttccttcccacctccagtcctaccccatctctcccatcctttacctggcccagacacttttctaggataaaggcttattttcagcactctatcgcttattatctctttctttttctcaggtgattttgccccctcccgccttgagtcttgatttggctacaacataagaggatgtctgatgcaaactagctaaaaccatgtaaaagctttcaacttgggaaacactaagctccccaaagtcaggtgccagctcctttctaaagccctggcttcctagttcaagccccatacctaataggctatgggttgaggacaaagtttgccttagatcatagagatttccaagttgctgcaggtgtttgagtacctagtcactggaaatgggcattgaggggtaggaggagttgggccttgattatcaaaatgtgattttgactagaatgatctgagatctatccagcacggatattctccgtctaatcaacttcatctctctgagcctcagtttcctcctttgcaaaatagagataactccgctgggtgtagtagctcacacctgtaatcccagcactttgggaggcgggaggatcacttgagcccaggagttcaagagcaacctgggcaacacagagagactccatctgtattagacagacagagagagagagagagagagagaaagagggagctctccacatcctgccaacttcacagagctatgggggtgctaattagatggccatccaggtggtaacctattatggccagattgccctggcattctaattgttagatgttgaaaagtagctgaagtatatggaatactccatggatgtaaagaggttagataacaagtattagaatcatccgagctccagaatcagcatccctttggggtgaggggacaactccaggagacaatggcattgtatgctccaggtctgaagaggggaatggatggaagagaaacttgtggtctgagcccttcatgtatggaaagttgtcttgctttactcctaggagttccaagccaaccaggaaattgatttctaagatcacttcatttaaacatcattgggctgcataaattccatctcagcccacaaaatatgctttgacccctgcctaagctcctattacccccactggtctccattttcccttcacttattatcctttcctcccctcacccaattttctaagcaccacaaccagcctgccagcagccagctcactcagggcctcatcctttggacaaattcctagaactcacggcccagatgggagaataatgaagattcatttaccccaggactcttgcttgatttgttgttgagcctctgcctgattttcagtcatcagcccccaattttattcccagagccagcaagggccaagcctcattttcctgggggcccaaatcctcccccattttccttccatccaggcttcaagccagaggccaaacgggggtcaaggatgacggctcattggcagggccaagcaggtggccctgccctaggttcagccctagggagcttcttgttttctcctgaacttccaagaatctccattcccagatgaggcatgctgtcagatcttggcatatgacaccaaatatgtccccctttccctcttctgcctgagtctaaatgtcccttttcctttgacctacaatgtagaagattcttgctaagagctggatgaggaaggcttcatggggtggggcggggcggggggtggtgggtcgcatcaactagagtgcaattctatgtgcgaagagggaaaagcccagcttccgaacctccaagatagcttgtttaaaatttctattgaaagaatctaggggtatttacctctcagctctggacgctgagttttcagacctgcatattttgggtagaagggcctgtgtcaggctgtgaagccagttcctggcaggccaaatgtggcaaagaaccattcagtaaagcagccagcccagcaacacaggcccaggaggcagcttcggagctggttcagctacagaaggtctgagacgcctcttccaagcccctttaggaagcctgactctctggctttcaagctgcctgctgtccccaatccctctctttctggtgcagacactgaagaaaacggttgtctcttgtttcctgcctggagcagctggggctacttgaatattctgcgggatattcctggaaggtgacctccctgtatcctcctctttcggagacaaaggcaaagcaggatgtggttgggaattacacttttaaggaacaggaccattaggtgacgctaagcctcttagccactatgtggcgccatttacccatttttctgtgcaaggttagtgggcggtggctacacgcaaagcaaaccaaatatcaaaactcgaaaacttttcagggatctagttctgactaggctcctaatatgttgagggtacttgggcaaatctcttgacctctaggcgcctcagttcctcattttgtgaaataggagacagatggtgggggggtccctgaaatcccttccagcttcataattttgcaactatgtgagtgaattcccaatgaacatccaagcgatgcaattttgggcctttgggtcacacacagggtgggtaaaaaaaaaaaaataaaagcgcacaagggccaaggcatgggtttgggggtgagggtgagaagggggtggtcatggaagcagggatcctctacaacacatgggccaggatttttcttgagctttccatggcgctagggaaaagataaggagccattcatttgcttagtaaacattgatcacaaactagatgccaggcactgtgtgatagaggcaaggctgcggtggtgggtgggagagaagtgaatggtgggtgggacaccaagatgagtaaacctcaaagtgtttaccagccagtggggaatagatgagtaaacaaataaccagtgcacaaggaagaatggagtctgtgctaaatagaactataaactgctggaggtgacagggaggaaggagggatatattctgaccagataagaaaggtctcacagaggaggagccattttaactgggctttgaaagatgaacagatgtctgtgtgtggtgggggaggggtttggagaaagggagagcaggagggggagggaaaggcaggcattctgggcagaaggaatggcttaaggaaaaatgagggatgggtacattatgctgttttggcggaatagggagtagtctgaggtggcaggagagacggagtgggaaaagagttcacaaaaatggtttggggccagattctggatttacagagacttttcacctggtcagataaggtacagagcgtatgggacaggctcccaagatatggacagagttctagccctcccgtatggagagggcaagacccagtacttcatacgtatacaaggccaccaagggacagttaaggtgaacaaggcaggcaagcctgactgaaagtatggtagattaaaggggaagggagcctgagagggcattctgaaggagggcagtcttccaacagcgagtattccactctcctctgtcctaaaacctacatagtagaagcttttaaaaattatttaacttattattattatttttttttgagacagagtctcgctctgtcacccaggcaggagtgcaatggcatgatctcagctcactgcaacctcagcctcctgagcagttgggattaaaggtgctcaccactatgcctggctaatttttgtatttttagtagagacagagttttaccatattggccaggctggtctccagctcctgacctcaggtgatccacctgcctcagcctcccaaggtgctgggattacaggcgtaagccactgtggctggcttatttaacttttattttaggttcaggtttgttatataggtaaattgcatgtcacgggggtttgactgtagattatttagtcacccaggtaataagcacagtacccgataggtagtttctcaatcctctccctccttccacccttcaccctcaagtaggccctggtttctgttgtttccctctctgtgtccatgtgttctcatcatttagttcccacttataaatgagaggatgcagtatttggttttctgttcctcattagttcacttaggataatagcctccagttccattcatgttgttgcaaggcacatgttatcactccttttaatgactgtgtagtattccttttctttttttggagacagattcttgctctattgacatggctggagtgcagtggcatgatcttggctcactgcaacctccacctcctgggctcaagggattctcatgccttagcctcttgaatagctggggttaccggtgtgtaccaccattgccagctactttttgtatttttggtagagatggggttttgccatgttgcccaggctggtctcgaacccctggcctcaagtgatccaccagccttggcctcccaaagtgctgggattacaggcgtgagccactgcatgcaggctttttatgtctacatagtattctatggtttatatgcaccacattttctttattattattattattattattattgagacaaggtctgactctgtcgcccaggctggagtgcagtggcatgatctcagctcactgcaacctctgcctcccgggctcaagtgattcttgtgcctcggcctctcaagtagctgagactacaggcgtgtgccaccacacctggctactttttgcatttttagtagagatagggtttcacgatgtttcccatgctgtcttgaactcctgggctcaaacaatcctcctgccttgacctcccaaagtgctgggattacaggcatgagccaccgcacctggccccacattttctttatccagtctatcattgatggtcatttaggtttattccatgtctttgctattgtgaatagtgctgcaatgaatataggcgcgcatgtgtctctataatggaacaatttatattcctttggttgggtgtatacccagcaatgggattgctgggtcgaatgggaattctgttttgagttctttgagaaactgccacactgctttcttttatttatttatttattttgagacagggtctctgttacccagggtggagtgtagtggcatgatcatagctcattgtagcctcaaacttctgggctcaagtgatcctcccacttcagcctcccaaattgctaggattacaggtgtgtgccaccatgcctggctaatgttattatttttttattttgtagagacagggttttgctatgttgcccagactggtctcaaactccttgtcgcaagtgatcctcccgcctcagcctcccaaagtgctgggattacaggagtgagccaccatgcctggtcctacactgctttccacagtggctgaactaatttacattcccaccagcagtgtattcacattcccttttctccacagccttgccagcatctgttattttttggctttttaatgctagccattgtgactggtgtgagatagtatctcactgtggttttgatttgcatttctctaatgataagtgatgttgaacgttttttcatatgcttgttggctgcatgcgtgtcttcttttgaacagtgtcggtcggacgcggtggctaatgcctgtaatcctagcactttgggaggctgaggcgggcggttcacgaggtcaggagttcgagaccaacaatgtggccaacatagtgaaacctcgtctctactaaaaatacaaaaaattagccaggcgtggtggcaggtgcctgtagtcccagctacttcggaggctgaggcaggagaataccttgaacccgggtggcagaggttgcggtgagctgagatcgcaccactgcactccagcctgggcaacaagagtgaaactccatctcaaaaacaaaacaaaacaaaacaaacaaacaaacaaacaaaaaaagaaaactgttcatgtcctttgctcactttttaatggggttgtagttttttgcttgttaatttaagtttcttatagattgtggatattagacctttgttggatgcagagtttgacagtattttctcccattctgtagattgtgtttactttgttgatagtttatttttctgtacagaaactctttaactaggtctcatttgccaatttttatttttaaattttctatttttgttttttttattattattattttatttatttttggagacggagtctcgctctgtctagcaacctccgcttcccgggttcaagcaattctcctgcctcagcctcccgagtagctgggactagaggcacacgctgccacacctggttaatttttttgtgtttttagtagagacggggtttcaccatgttgcccaggctggtttcgaactcctgagctcaggcaatctgcccgcctcagcctcccaaagtgctaggattacaggtgtgagccaccgcttccggccttattttatcttttgagacacagattcgttctgtcacccgggcaggagtgcagtggcacaatcttggctcactacaactctgcctcccaagttcaagcgattctcttgcctcagcctccctagtagctggggttacaggcgcccaccatcatgcccagctaatttttgtatttttagtagagatggggtttcaccatgttggccaggctggtctcgaactcctgagctcaagcgatccacctgccttggcctcccacagttctcggattacaggcaattttaatttttatttttgcaattgcttttggcatcttggtagaagctttaaagatctgacctatgaggaacaagaagaggtcctgcttcaaggatggaagagtcattccaggaaacctggcaaactgcctctgctgtggctgcatttgcaggactagtcaccagtttgtttccagttagacctcaccagcccgcggcaaataggaaaaggctgaggcattatgggagctggcatcaatctagttaggataataaagcaggtgggatttaggtcagtcttaaggaaagcagaagactgtattctgaagagtgagagatctggtaaccgtaagaggttataacttgtgtttgttcaatagccgatgagtgcccactcaatgccaggagcatggccggagggaggagtatgaaaagtactctaggaaaaaaaaaaaacaaagcaggttatgagaatgcagaggacaggaccctgtcttggaggaaaggcatcaaggaaggctcccacaaagtggtgagacattagagatggatatggaagaagtagttgatatacagttggaggggatagagcagtgtcccgaagaaaagcaccatgcatgaaagagactggcaggtttagggaagcaagaagcaaatgagctggagtggttgaggagaagcacaggtaaggggaagggaaagggggcgggcagagaaagggagctgatgcttctaccctccccactctgaaaatctccaagtgcccaagttcttatttgccattttttgttaagaatccagctccgtagagctgaactcaggggtccctgtatacctttgtgtttgtcaccactcccctccgctctcattctagccatgaagtccactgaggaaaccacccgctgcaccagccttacagcaagtcagtaatgaagagggaagaggagccaggagcctgctcgcatgtcttgaaactctcaattcagctcagccctggctctgagggaggaacgggctgaaaaggaagagttagggaggttgttggattgtggtaggaatttttattcctcatagaaatttctggtctggtgaagggagagaggcatggagactgggccaaggggtgggggctaccttggaatttagattcatctgggtgatccattagcaaactctcattagcaaaataggagactggcccaatcctcagggatgggtcctggaggcaggagtcggggaagggtggaaggaggggctatggcttgtctcaaaggggctggggtatctgccagttctggcacaggccacaggcaagcaggattctctcttgttcctctgcccctccccttctccaatctctatcccctgccttggcatgagggcctctagagaaaagaaaataaaaatgagtgggcagaaacagctggatacagtcaggaacacatctggcctcccggactgtctcctggtccttgttttgcttctccccccatgccccttcctcctctgcaggcttctgataggaggactgtagcatagctgggggaagggtggggaattagagtggggctgggtgatgggggagaaagttgttctaaatattaactggtcttgtgagatgtcttcttggctggagcctgaccacctaacttactgtttttcctccaactgctgcctcctcctttccctctgctgcaggctggaactaagggcggcgggtggcggcgggaggaggaaggaggagaagcaaagttggccagggtcctgctggctgggggccaggactgcctccctaaacaagcaggcgggggcacatatagccctgggttgagttgttgcccttactcatctggccacagcaggaagaagaggcgcccggaaaaccttagctcttggctatctcttccctgagcacaccctggccctggggcctgagatctctccatgcaggggcagccatgagctccgggggcagcagcaaggctggccacaccacccatcagccacctccagccccgccgctcaaccagccatcagtcccttaactgccagtgttcgtggaccatgcaaaacaaccaagtgagtgaacaggggctggctgagggttgggagaggttcctggacaggaagtgccagcctgtgccctctttttttgccctcagggacaaacatgggaggtttaggcaaactcttctcagggggtaggggacactgaaatgttgatcagtgtaggtgttttgacccccaccccccaaccatttgcttttctgtgttcctcttgccctctctccctctctctctctctctcctctcccaactccccactctgttcttattcctttctattcccaggcaagggactcattaagcccaaagcaattttagggtgcccagtggagagactcacagaggctgctagtgccgatgctgctggtgctgctgctgaggagtgcccaggaccaggtgccaggggagttggagtcaataaccaccactgtcagatctactgacccccaagccagtttctccagtcaggtacctcctactccctgtggaggcctggggatctctaaggccctacagcttccctgtcactcccattttcactccactctctatcccctgcacttagcctcccttggtggctcttccatttacttctttccccaccccaccccaccccagtccca

SEQ ID NO: 169 - DNA, 2316 bp, Homo sapiens
  source 1..2316: mol_type = genomic DNA
aaagactaaaacattttaccaattttgcattgtttgtttgaaattgcattgacgactggtatgttaattttgtatatatttttatgagaacaatgttggacatcatttaatttttttaggtttttttaattgattattgattggttcatttgcaggaactgactattagtaatcaaggatacaaattgttaagagaatatgttacagagaaaaacttgacaagctagacttagatttttgtcgttaaagataatttgtgggatatgatttttataaggagttgcattaaatagaatgtcttacacagatttaagaggttaataattataaaattaagatgagttcttataaaatattcttgaggtataataaaattatacttgtggagtatatctttgaataacatttaaaagcaaactaatactttccaggtaaaataattatcaacataactttttaaaaataattcatagtacttcaggttatttctatgtttgacacattaacttaaaagaaaaaaggaaaatggtgattagttaatgccatacacactggacagaaaagaaacttagctcttatggattcctctccatattttgcagcagggtaaatgtaagttttcttacgtagctagatactgtgttccagtgctgttgatgttgtactgttttagcaatgaagagattgatatgggctgattgggggttagggaaagtgaagcagcagaaccagaacagagtggacatttaaagggtgctaataagtaaataattatgtgaagtagcatactggtcgaaatgcataactcaaagataatcgggaagcgtattttcttttcttttcttttttttttttgagatggagtctcgctctgtcgcccaggctggagtgcagtggcacgatcttggttcactgtaagctccgcctcccaggttcacgccattctcctgcctcagcctcccaagtagctgggactacaggcgcctgccaccatgcccagctaatttttttgtatttttagtagagacggggttttaccgtgttagccaggatggtctcgacctcctgacctcgtgatctgcccgcctcggcctcccaaagtgctgggattacaggcttgagccaccgcgcccggccgggaagcatgttttctgaaacataacctaagaaagtataaatgctgccttgtgcctacaatcctggtgacaagagcaagacttcgtctcaaaaaaaaaaaaaagtataaaagctccttaaaggatgtttcaaaataatgaataatattaatttctatattgtatattcacaaatgttctttctagaataattatttgcttaatggggtgcatgtttagttggtgagaaatgaattaataggttagtgatttattatctgttgggaaaaattttagacattcacatgaaagtagagagaataacataaatgaatttccatatatggatcacttagatttagcaaccgttatgattttgccttacttgccttttcccccaaaatactgtaaagtaaattacagttatcatgacattttcttctaaataagtcaatataaacatataataaacaaggacctttttctatatagtcacaatgccatcactatacatagtaggattaacagtaattccgtaattttttttttgtttttgagatgaagtcttgctcttgtcacccaggctggagtgcaatggtgtgatctcggctcactgcaacctcgacctcccgggttcaagtgattctcctgcctcagcctcccgagtagctgggattacaggggcctgccaccatgcccggctaatttttgtatttttggtagagatggggtttcaccatgttagccaggctggtctggaactcctaatctcaggtgatccgtctgcctcggcctcccaaagtgctgggattacaggcgtgagccaccgcgcccggccattccttaatgtttaacacccagtgcatattcagattttcccagttgtccgcaggatgtcttttatagctgctttcttcaaaccaggatctattcggagaccacacattgcatttgatttttatgtcttttgagccttttaaaatttagagcagttccctataaccccttcttttgtttgttttatgaaattggcttgttgaacttcacaaaacacgagttggggtcatgccaactgtaccgttagtgattagtttacatatagggaaaataatttgtgaatgttggtccattcactctgccagctataccatggcagcatttccagtatcaggaaagcaaaccaggggatctaaaactgagc

SEQ ID NO: 170 - DNA, 3855 bp, Homo sapiens
  source 1..3855: mol_type = genomic DNA
aatgcttttaaatgatacgataggaaaatgagcaggataagaggcagccaacttcactttggcctttttttaaaccctcttaaattctggatatcttttagtgttctctgttatattagttctttgctgtaattgcccaaataatccagtctcagttttctggacctgcagactgtatttgcggatatcacccttagaatctagcaatatgtgatggaaaagtggcatgctttgggccacattagatgggaaatagatgaaccagtaatcagccaactctcaactttagtgagcacttatctcctaactcttctttataccaataacctttgcacatctattttcacctttcatcttctagatgttctgtggtcatgtctgttgtcctattttatttatagagatttcagtcagctcagccagctattcccacctctgagtcttcaagtggtcatctcaagaaatgaaaaactagcaacagtttgtgaataagctaaatgtcttaaagtgttgtcataggcaataaagcaggatcaagagccagccaacctgtaaagtttatggaaaaatggtctcctaatattaacattcctagcataccactgtccccttctttcattctctatcttatgtcctggatattggttactaagctctgccacattagtgtctttacttatgttgtctgaagaatctagtctcactttcctgcaccttgcacactttatttgtgcatgtcaaccatacaatctagaaatatgtgacagaaaaaaaaacaaaatattttaaaatagaatagaagcaagtgaactaggaggcagacaactcctgctattcagaaaaaaaattgggctttcagtgtttgcctcttgccacaacctgcccttttcttatttacacccttacatcctgggtatttggtaggaaaccatcttatattcgtgtctttgctaaagttggcataagaatctagtctcggttttctgtatctgtagactgtgtttgcacatatcatgatagaatctgggaatatatgatagaaaacataatacactttgaaccatgttagaaaggaaactggtgaatgaggagtcagccaactcttgcccatcagccatcccttttctcctaacttctttatttcttccaatgttctgagtttacttttccccttttatctttcaggtatttagtggtcatttctgttgtgttatttatatagagagatcagtagggttgggccaaatattctcacattttggtctgcaagtggtcagctcaagaagtgaaacctgggaagaggttatgaacaagtgaaatgccttcaaatgttgtcataagaggaaagacagcatcaggtgccagccaactcctgcccttttacaaactttgtctcctaatattcctcttcttatcactcccctcttcttttcattcactctttttttttttttttttttgaggcagagtcttgctctgtcgcccaggctggagtgcaatggcgctatctcggctcactggaagctccgcctcccgggttcacgccattctcctgcctcagcctcccgagcagctgggactataggcgcccgccaccatgcccggctaattttttttatatttttagtagagacggggtttcaccgtgttagccaggatggtctcgatctcctgaccttgtgatccgcccgcctcggcctcccaaagtgctggtagtacaggcgtgagccaccgcgcctgtcctcttttcgttcactcttttcccttgtggatatttgttggtcacttctgttatattactttctttgctgaagctttccagaggccgaagtctcttttgtaacttggagtttgtatttgcatatatcaacagttgaatctaacaatttgtggtataaagacatgcttgaacccaaattaaatggaaataggtaaaccatgaaatagccaattccctcccattagttgtaagttccttatttctgtctatgatatttctcattttattttctcctattcccacatggatttttaaaattatctctgtaacattagtatcttttgagagatttgagagagtttccaccttgaagtctgaggtcacaacatcaaacagagaagcttagcaagcattatagaaaagtgaaattccttaaaataattaaataacaagaaagtatgaaccatgagccagccaatttttgtctttgtgccaaactatttatcctaacttccatcatcctttatagcccctccatcatcaccattctattgccttccttatacactctggttgttgtctgggctcttgtctgtgttattgtctttatattggtttcaaggattcacagctcagctttaccaccttgactactgtgggtgtcttgcatgatgaaaaagatttaacaagatagtataaaaatgtgtattcccttaatatttttggattttataaaaagaagttccagaaatcatacacctcctgtcctctatcgagatcctcaatcctaaaataactgtgatcctcagtctccctatttcacttcacttttacatatattctcatgcttgctaaatgtttcatggtcacctctcccccatcagtgtctttgctaagcctgtgggaaaaatcaggcctctgtgttcaatcttgtggactacagtttcttacaatacaaagtagcagtttatgaagaaaaacagcacgtgcattacaaaacttaattcagatggaaggtggtccagatgccagctgacttctaccatttatttaacacctctctcctagcttccatcttctactgctgaccttctttcctctattttcccctttatcgtccaaatgtttaatattcatttttgtagtgctagtgtatttgcaaaggttttagagagactcagtattatcaacttgaggcacttttttttttttttttgagacacagtctcactctgtcacccaggctggagtgcagtggcatgatctcagctcactacaacctccgcctcctgggttcaagctattcttgtgcctcagcctctcaagtagctgggactacaggtgtgcaccaccacacctggttaatttttgtattttagtagagatgagggtttcagcatgttggccaggctgatctcaaactcctgacctcaagtgatctgcccacctccgcctcccaaagtggctgggattacaggcatgagccaccattcctggccaacttgaggaccttttgtggccaactcttaaagagaaatctagcaagagttgtgggcaagtgaaataccttaaaataatgagataataggtgaaaatggaccaagagtcagccaactcctgccctcagccagaacttgtatcccaacttttaatttctataactgcctgtcacctttcttttccccttcactattcagattagtttttttttaatttgtataaatgtatggggtataagtgtaattttgttacatagttaattttaaaactctactgtcaggagtgggattgttgaaggttatttttgttgcattaatcccacctcaaggtctctgtgtagccacttcttgcaagaaatgaattctggcaagagttatgaacaaattaaatgtcttaaaataatcatacaagtggagaaagtaaaccaggagccagccaacttctcccctgaatcagaacatttctcctaacttctatcaccctaccacaaccctccctgccatcaccattttatttccctttttatatactctatgttttatagtgtcctatactgttttagtgcctttacattgatttcagggatacatggcctcaatataaacaccatgagggttttgtgtgtccaatgacta

SEQ ID NO: 171 - DNA, 9046 bp, Homo sapiens
  source 1..9046: mol_type = genomic DNA
aagcctgaaagccctacaaacctctgtgcttcataagcctgactgccccacaagccaaggtaccccacaaaccctagttctccagaatcccaactgccaaacaagcccaactgccccacaagccctagtgctccaaaagcctgagtgctccacaagcctgactgccccacaagcccgagtgtcccacaagccaactgctccacaagcccacctaccacacaaggcctagtgcaccagaaacacaactgctccacaagcctgaccaccccaaaagccaaagtattccagaatcccgactgccccacaagaacaagtaccaaacgtgcccgacttctattattctatttatgtgaccttcttgaaagagaaaactgaaatgatggtgtacaaatgagtggatagtagagttagtggtggagaggtgggattaactataatagcaggtggaggggggttttggggggaggaatgtgatgaaattgtttgtattatgatagtcgttttggttccatgaattaacacatgggctaaaacccatagaactggacaccaaaagaaaagaaaataattttagtgttgcaggaagtcagggaccctgaacagaaggaccggctgaagccatggcagaagaacataaattgtgaagatttcatggacatttattagtttcccaaattaatacttttatagtttcttatgcctgcctttactgcagtctctgaacataaattgtgaagatttcatggacacttatcacttccccaatcaatacccttgtgatttcctatgcctgtctttaatctcttaatcccatcatcttcgaaagctgaggaggatgtatgtcacctcaggaccctgtgatgattgcgttaactgcacaaattgtttgtagagcatgtgtgtttgaacaatatgaaatctgggcaccttgaaaaaagaacaagataacagcaatgttcagggaacaagagagataaccttaaactctgactgccagtgagctgggtggaacagagccatatttctcttctttcgaaagcaaatgggagaaatatcgctgaattctttttctcagcaaggaacatccctgagaaagagaatgcgtccctgaggggaggcctctgaaatggccgctttgggagcggctgtcttttatggtcacagctgtgcgatgaaataagccccggtctcccatagcgctcccaggcttattaggacgaggaaattcctgcctaataaattttggtcagactggttgtctgctctcaaaccctgtttcctgataagatgttatcaatgacaatgcctgcccgaaacttcattagcaattttaatttcaccctggtcctgtggtcctgtgatctcgccctgcctccagtgatatcttattaccttgtgaagcatgtgatctctgtgacccacaccctattcgtgcactccctccccttttgaaaatcactaataaaaacttgctggttttgcagcttggggggcatcgtggaacctgccgacatgtgatgtctcccctggacacccagctttaaaatttctctcttttgtactctttccctttatgtctcagaccagccgacacttagggaaaacagaaaagaacctacgtgaaatatcgggagtgaattttgcctgatattttagtatttggtactttacagaataaaatttaaaaagtaagctagagtgactatattacttaattttttactttataagaaggaaaattgccatggataaatagggacattatgcaatgataaaaaatagtcacttaacaggtaagacataataatcctaactgttaattcacctaaaagcagagcttcaaaatacacaaaacatcatctgatagaactgaaaggacaaataatcaaatctacaatcatattttgatactccaacactcctctctgagtaaatgataaatgaactagacagaaagtcctcaaagttatggaaagacctgaacaacaaaatgaaccacctcgagctgattggcttttgctgaatgcgccacagcaaagcagcagaatatacaagattttcaagtatatgtggaagttttaccaaaataaatcataaatcaacccataactaatttaaaataattgaatatgtacaaagtatgtttttaaaatctgtaatgggataaaataaaaaatataacgaatgagatacctgtattttttaaaataacatatttttagtgatccatgtttcaaaaaattcttgaggaaagttagaaaatatttccaaataaattaaaacgtaaatgtcatgtttaaaaatttgtggaattcaggtaaagtagtgcctatatcattaaatgcttgtattagaatgtaagaaaagattcaaacaaaaaatctaaactttgatcttatataatgagaaaagaaaagtaaattaacctaaggccaacaaaaatatatggatgatacccagcactttgggaggccaaggtgggtggatcacgaggtcaggagttagagaccagcctggccaaggtggtgaaaccccgtctctactaaaaatacaaaaattagctgggcgtggtgatgggcacctgtaatcccagctactcgggaggctgaggcaggagaatcagttgaacctaggaggcggaggttgcagtgagccgagatcacaccactgcactccagcctgggtgacagagcaagactccatctcaaaaaaagaaatatatgtatatatattttttatacatatatatatatggatgatatagatagggaaataaaaaatttcagaaattatagaaaaataataaatgaggttgatggaactaaatttactttttaaaaaattttttgagatagaatctcactttgtcgcccaggctggagtgcagtggcacgatctcagcttgctgcaacctctgcctcccgggttcaagcgattctcctgccttagcctcccgagtggctgggattacaggtgcccgccaccgcacccggcaaattttttaatttttagtagagacagggtttcaccatgttggccaggccagtctcgaattccttacctcaggtgatctgcccaccttggcctctaaaagttacttctttaaatagataagactagttgaaatgtctgacatcaatctgagaatttttttctaaaagttgttcagaagcaatgactttgaacaaagcttcaaatagaggaaagtatatgtaaactataattttcttgtgataacactcttcgttctttagagaagattctgagaagacaagattctccttgaaattgtcttaatttttaagtgcctactatgtggcagattttttttttgagacgcggtgtcgcactattgcccaggctggagtgcagtgacgtgatctaggctcaccacaacctccgcctcctgggttcaggtgattctcctgcctcagcttcctgaatagctgggactataggcgtgtgccaccatgcccggctaatttttttgtatttttagtaaagacggggtttcaccacattgtccaggctggtcttgaactcctgacctcgtgatccacccaccttggcctcccaaagtgctgggattacaggtgtgagccaccacgcctggccgtgacagttgttttcaaatgcattagcccatccaatttgaagagcatcctgtaaaggtcagcagaaagagttcaccttcttcactccatagcatttactgcacttccttttgcagtgccatctgtcatctcaggaggccgaagatttcctccttccatctgatgcaggggcagaattttgctcagagtctttgataccttccacataaccattcttgcctgaacacctgtacaggcaccactagtcacactgaaagccagtatgttcctggggagagatgccagacaggaggcagtggaaggctgattaattattcttttcaaattctagctggcatgtcaatcatggaaccatttttcacctcctgggagaagcccagggtttgtaggaattcagactcagttgatcgctgttcctcttagaattcttatgaggggatggaagttttgagcacctaagaaagcctgtccctgtgtttgcccgttcagtccccaggttcagataagaaggtcattaaaataaaactgcaaatatgctagtgactggacaaactctctgtctaccttcaggcctgtaccctaagaaccaggaaattatgtttcaaatcatactctacttgcagcccactgggaaaacaaacagtatgcagaggatttcccagagggaataccaagcgtctaaagttgcagtccagggtggctgtggctgtgagacaagaccaagggtgtgtggtggcagagtcaagggacttttgcaggggataggattactccatgtcccagggaggggaggtgattctgcacagcctccaggggaggcagcagtgaagaccggacagcaggccagttcccctagtcagaagggagggcacatgagggtgactgagaaagggtgctgtgacacgagaaactgtcggggccagaaacaaatcctgggagtgtacttgtcccatgtgcccaggaaggacaggaatgcaagatgtggatgagcacttgaagcctctcccacaacctgatgagcacccatagtaggtgctcaacagaaagcattcagccatgagctcccaggggacttagcacatgccaccccctaatggtgtttgattctcattgtcacctttgtagacctgcttttagtaccttggtctcagggttctttctgtcacctgagagacatggcgcagtgctgagaagatgcagtcaggagatggggctcaggctggggggagggggaacagcataggctctggaggaattcagaccaggggtctttccagccctgtcccttagtagccacgggattctgggaaatacccaagccctgtgaacctcaagctctacgtctgtgaagcaggtgtgacaagtcctttccactaggactgttggagtgtgtgccatgcaagtgaagcacctagctcagggcctggcgtaaattacaagtttaaagaacggcgaatggctgttttttcctatattattttaccccaggccttaacactctgggattttgttgttgttgtcattgttctccaggacttatcagataatatacagcttggtaagacatggaataatcagtcaaagaatgaagtttcatctataaaattcagtaaatatttcctcttagaggacatacttcaaactttggttgttggggagttttcccaagccagatgcagctcacagctcctagaatttgagtcaaggaccaactccttccttctctgcccgctgcttttccatccaaaccactacttttttttcatttcattgccacccaaaatctagccgttgctaaaattagccaaatggcacttgagatgacctaattagaatgtcattttaatagagtcagctttggctcccagccaggcagaagagtacctgtccagtggcttctgggcctcacttccagggatattcacccttatctctcagaaaacacttgcaggtgatgcgtatccatcacctagctcttgtgctgtgttccacctcactggaacaggagcacagaatgctttccattcctgccccagatggaaactcctctctgctttatccactattcaaaaggaactgctgagcagttttctattccaggcttttctctcatgcctgagaatctggctctggcaccacacagcttcattacaattagctccccgagaaggaactacagtttcccaaagtccaaaaggttttggctcagggcatgtacactcaactattaatactctcacctgttgctccacaccctcaccgctctcttattttccctccagatcttagaagacatctagccactttaattatgtgactgcagatcctagactctaccgccctaaggttaggggtggatgtggcttaccttagcatctctactattaacctaagccttccaaatagcagatgctcaatgaatcttttgagaaaaaatgagccagtgagcagggggacctaattattcatatgtaattctcttgcatgatcaaataagccaagcaaatctggtaagacttcaggatagtgggttccctcctggcccaggacaggtctaaaaatgccgtccaaaagccaagttctgaaatcaagaaccccaaaagacagcttggttgtcttctccactgtgggttctaagggccctcactgaaaccagttatgtgaaaccacctggtagttttcctgaaccaaatcttgtggaaaataaacttattaggctgtccgccaggcacaagaattaccctgtgaaaggcatactggaaaacctaccatcagctcccctccatctccagttaggtcagcctcaccagatattctggtactagaacttcagtttggctgggggctctgaaaacagccccttaggcaggcttcccatgagctaaaccaactgaaactgagcagaccaaagaatgagccagatgaggaatctacccattctaaccaaccagcctgtttgtcttactcatccacgtacaaaagaaagtgttagcagctgcacagagtccttcctgttgagctagaaggttgcagttccatgatctagtatcccatcacgggctaaactgaggcagggagtgaggccaagtggatcttgaagtctgactataaaagggatccctagcaaagtttaaacaaacaattgcatcaaggatgtttctaaatttagccactgggtggattaaagaatgtcttgggtcatgtaaagatatgggcttggcatgggatatccaatgttctatggaagctgatcattgtaaaattctaactacatgtcaccctggacccacacaggtctgaactgcatgggtccacttatgcatggattttcttctgcctctgccatccctgagacagcaagaacaagccctccttttcttcctcctcctcagcctattcaatgtgaagttgatgagaatgaagatttttatcattatccacttctacttagtgaacagtaaatatgttttctcctctgtatgactttcttaataaccctttcttacctctagctttctttattgtacaaatatagtacataatacacttaaaacacaaaatatgtgttcatccataatatttccagtcaacagcaggctaatagtagttatgtttctgggggttcaatgtttatacacagatttttgactgcattgggagtcggtccccttaacccccacctcgttcaaaggtctagcatacaggtgttatcttgccaagtgaaagagggaagcataagcaagaaaaaattaagagggataaggatgtcattgtgaaagggagtcttgtttcaacatcttcagagaagctgtctacaggatgaagtcatcgagttctcattctggcttatagcttgaaagtctgcttatggcttcaggcattgtggtgaactctctgagtggctcacacatcaggcgggagggttgtttgttgacgtttacatgagatgttgagctgcagcttacagaggacctgagcagttcccgttagtatgagacttgcagccagataatggagaaaattagaacaatttagaatcatgtatggcctgcaattagactcgaaaacaacgaacagagctacaagctaataacaagtataccatagtttttttaattttcctgaaacttaatttttctctcttctgtctgcatttctatcaaagataactagagtaagactattttgataaaaaaataagtttagtctcatcaaacttagaatgattacttatgtaagtgcagcaaggatccattagccacataggctcttttaaagtttgctttgttggaacttttagggaggattctcagatttcagttttcaaagcctctttatgctaggaagccaaaccaaggtggacttcagactttgtctgctgcacctatagatttgggtgaatttctctcttctcggggtcccccaaatattttgaggttcctgggctttccaggaagtgactttttttctcactataaatctgggaacacttaaagccatacattctatggacgttctcaaacatggtatcgcagtgacaacctgggtagtataactagtattcccagttgcatcctgttataaagagagcagactgtgattgaacttatgcaaacaactttgccataaaatccagaacacccacaaattgtctctgggaggcaagttttacaaaaaccttttttagaaatttgtgcacatgaataggcatccatgtgggggcctatttcagagggcctaatttttaagcacatttttgggatgaacagtattgttcatctgaaatgtttcacatgatggccattgtaagtctaaattatccttatgaagattgcacctttttgaaaaggtttgctgattctgctgcgtaatacttacgcatatagaaagcaggcatagccagaaggtggagtacacagttgtctggaaagcaaggatcccatttttatgttgattcagagataagatcaaagtctaagaaggaaatgccacgggattgggtcctggtttgctttccagtgaaccttgctgcatggatgctgtcttgaggctgacggtgacatggtatttaacttatttgtttcatgaccagctgatcctaacacagacgtcttatttttaggtggcgagtgctctaatcgctcctaagtgcctaaactggagccaccagtcagtcatggctatggctctgagcttcccctgactaacgtagccagtgaatctctcctaccgaagcatacaagcaaaagaaactggagaacccacatccctgcaaatttccaaaagccagagtcacacactgcatgtgataatctgctcctgccatcagttacctttaaaactacatgtattgtcagtgacttgttagctcccacaaacccccaggtcatgttctctctcacaggacaaatgaatcctggaatcaagagcca

SEQ ID NO: 172 - DNA, 2560 bp, Homo sapiens
  source 1..2560: mol_type = genomic DNA
aaactacaatttctcacaaattctctgctcttgccaaattttgttttcctcttttagcccgtcggttccgcaatttcgggcgcaaataaagaccttctggcatttagtggaaagagcctagttgagcacgatccgcagaagcggaatcaggtggctttcggataggcagcgagatccgaggactaaatcccgaggtcttggcgagcaagcagctgccctccgccaggcatcgaggagcgagctgccgccgcgtttctgtcgcggcgccgcggccgaaccgggtagaggtggtctaccatcggcccttcgtggtgggcccaggggtgtttccccgggcaggggagctgactgcaggccaggggcgccaaggccgcggtgcggtgggagcagagggcagcgcagcggggctggacttcatcttcccacgccagaggccgaggcctccgggaatcgcagggccacctcttcaaagcccttggcgatcccagttctgttccccgagggggctggcgaggtgggcggggcgggcaggcgagactaggtctttccctgtttggcctccgtagccggcgccggcgggtcgttctgtttgaatgaatgatcccagcagccgcgcccaatgggcgtccacgcctgcttaatatgcatgaggcccgcagccaatggccaggcgaggaggctgttttaaacggcagagcccgctggccaatcaggcggctctcgtggaggcagctagcgcgaggctggggagcgctgagccgcgcgtcgtgccctgcgctgcccagactagcgaacaatacaggtacgtctcgcaccgcccgctcccgccgccgccgccgccgccgccgccgccgccgccgccgccgccgccgccgccgcagcgcccgcacaactttccggcccgcgccgccgtgagcgcgccctgccgccgcctccccctgcctctactccccattcccttcccgccccctccgccttccctcctgctaggcggccgggaaggaagaagcaattcaggtgtttcaacttttccaacgcgttccccgagctccccgctttcgggggtcggccccctcggcggacgcccgcccgtggcggccccaggggccgcagccgggaacccagggcccccgaggccagatgtttgggcagctgcggctgcggcggctgggcgagcagaggggcggctgcgggctgtgggcgctgggcggcggcagcgggaagggggccgggagttccccggcccgcgacggactccgctggggaacgggcggccggtgcccgccgggggctgcgcggctggtgcccgccgggggccgccgcacgggcaaacttcgctcccgggcttggcccggcgccgcgcgggcccgcaggctacgccgctggctctgcgttaacatggccgtcgcggagcgcccggtggcccgggggggcgcgggccggccgcccccctctcgcctcccgcccgcccggcgccgccgccgccgctaacatggctggcgcggcgctggcctccggcgagggcaggggaggcgggcggagcggtcggcggggcgcccggcgggctccggcctcggccccggcgcccgcggcccggggcgggcggctcggagggccgggggcgccgctgcgggccctggagcggccgagcgtcatggctgcacgggcgcctttgttatcccgaggagtgcgccccgcgccggggggcggggaggtccggcccgggcccccgagcccccgggcggcccgggcggggcggggcggggcggggtgggggccgacgggcgggcggcggcggcggggcccgggccgctttgttcgccgctgtcgccgccgcccgcgccggccgcgcgcggatcagccattttagcgagtgggactccgaggcgcggcggacgccgccaccagtgccgcggctgccgccggcccggccgcacaccccccgcgcaccgccaccgccgccgcccccggccccgcgcgtcccccggggatgacagcggcggatttcaggggcactttctttcatcaggaggcttttgacaaaatggaaggtgaattacgggtgtcccggtgacccggcacgggggccgaggcgggctgcctgctgccggccgggactcccccgctcccggtcccgccccgcccgggccgccgctgcgggtctctgttgggcagcctcctgggcggctgctgccaaggggagctctttagttttacatgatgaccttgggtgtgggaaaaggaaaagatggcgggaagctggggggtgggacagggacgatgacatgccgcagctgcatttttatttggaaactttggagaaagtgttctcggctggacctgcattctgggttacagatgagcacgactagccctttttatacaccctccccctttagatagtgacgaagtgatgaattgaactaatagtacgggggtacctgctcactttccagatctcccgtgttgtaaagccgtttttttagtaagccaaaacacatcaacaatagtgacaatttcagatgtcccctacgtatagttctcctgctttggtcttgtg

SEQ ID NO: 173 - DNA, 95 bp, Homo sapiens
  source 1..95: mol_type = genomic DNA
ccagctcgggcagccgtggccatcttactgggcagcattggatggagtcaggtctctaatactgcctggtaatgatgacggcggagccctgcacg

SEQ ID NO: 174 - DNA, 90 bp, Homo sapiens
  source 1..90: mol_type = genomic DNA
ccgggcccctgtgagcatcttaccggacagtgctggatttcccagcttgactctaacactgtctggtaacgatgttcaaaggtgacccgc

SEQ ID NO: 175 - DNA, 83 bp, Homo sapiens
  source 1..83: mol_type = genomic DNA
cgccggccgatgggcgtcttaccagacatggttagacctggccctctgtctaatactgtctggtaaaaccgtccatccgctgc

SEQ ID NO: 176 - DNA, 24028 bp, Homo sapiens
  source 1..24028: mol_type = genomic DNA
aggaccttgtgggctgggcaggtaagaagcgccggcggccaccagctggggtccagtgggctcggccccgccctcctacgccctgcctgcgggtcccctcgggaggctgctcaggagaggaggaggctggggaggggactggacagggatcgggtagggtggggccaggctgagcctgctctgcgggtcccggaccccagcgccaccgtgcgagaggctcgggtccaggccaggccggggaacggtgtgtgtacccggtggggtgggagggctgggcagccctgggacgagctccgtggcctgggaccaggtctgcctccgcagagcaagtcctggacggacggctgcttgagcccacaggtcgtgcgtcctttgacagcggcctccggccgggaggcaccagctcttcgaacaatgtcagtaccttcctagggccccacgtggccaagcttggattctggggggagaactcgcagcaggacactaacatgtggtcgctttttggatgatttcttcaggtttaaaagtctcttctgttcatcctaccggggtgccgtctcctgccggtcttttcatctcaccaggtaaaacgcttattttacaatttattgtaaggtcgtgcaccaagtttccacgccgcctttacaccgtgtccccaccgaggggcgtcacaaccgtcctccacaccgggcgtcaccggcttcccaagtcccaccgctataaaggacacgtcagtcagcatctcggagtgagacgctttccttctggattcagaatcgcgtccgtcagagactccaaagcacatttgctagatcgacaggcgtgaggagccagcggctcccggcgcttgggaggctgcgtcccacctgcattcaggccccgggttcaccacacacacagcgggcagctgcttaagaaacctttgatttcagtccggggcggtggctcacgcctgtaatcccagcactttgggaggccgaggtgggcggatcacgaggtcaggagtttgagaccagcctggtcaacatggagaaaccctgtctctactaaaaatacaaaaattagccgggcatggcagcaggcgcctgtaatcccagctactcaggaggctgaggcgggagaattgtttgaacctgggaggcggaggttacagtgagccgcgattgcgccattgcactccagcctgggcgacagagtgagacttcgtctaaaaaaattaaaaaaaaaaacacctttaatttcaatgacaagaaataacagctcacaacttatttagttatttgtgaacatcataaggacataaagttagaaaagcccaaaggaggcctcaggcttacgatgaaatcagcacctggctgcctcttccagctgctgcttcttctgcagcagaagagacggaggcagtttcctgggtgggggggtgggtgctgtgcttccgctttctaactgcctgtttccaaaaagcacctgatgctgctgcttctggagcttccagtgcagaaattccccgtggacggtgaaaggggcttgtcttccacacgctgccctgtccatatcatcccggcacgaatgatgtttggggcagagctgcccggcctccccgggtggtgcccatttgttttcctcagagttggcgatcgccttgcttttcacatgtgcttgtgttcccgcctatcctgagctgtccctgagctctctgcctcccgtcacccccacagtcaccatcaccacagccctgcagactgcgcagtgtgtggcgggtgctgtcctgacattacatgtggaaactccatctttgcagcaaccctgcgaggctgctgctcccagctgctgtgcaggtggagagaggctgctgttgtgcaggtggagaggctgctgctcccagccgctgtgcaggtggagagaggctgccaccgtgcaggtggagagaggctgccgctgtgccggtggagaggctgctgccgtgcaggtggagagaggctgccgctgtgccggtggagaggctgctgctcccagccgctgtgcaggtggagagaggctgacgctgtgcaggtggaaagaggctgacgctgtgcaggtggagaggctgctgctcccagccactgtgcaggtggagagaggctgacgctgtgcaggtggagaggctgacgctgtgcaggtggagagaggctgccgctgtgcaggtggagagactgctgctcccagccgctgtgcaggtggagagaggctgacgctgtgcaggtggagagaggctgacgctgtgcaggtggagagaggctgccgctgtgccggtggagaggctgctgctcccagccgctgtgcaggtggagagaggctgacgctgtgcaggtggagagaggctgacgctgtgcaggtggagaggctgctgctcccagccgctgtgcaggtggagagaggctgacactgtgcaggtggagagaggctgacgctgtgcagctggagagaggctgacgctgtacagctggagaggctggggcacacagtcatcaggtcagctgcaagctcacagctgctgcatcttttccctgacagctcactcctgtgagagtcttccaggcttcccggagggacggatgtctcctcaccttttcccacctccacaccttttcccacctccacacctggtaggccaggtatggaattcctggaattcccggctgggagcctcctgggccggttccagccctgtgtgtccccaggaaggctggagggctgctagtggcctcggtgggcacccagggctggccaggaccacacctccttcctccggctctgtgcctgtatctccccgggcctcccctctcgcctggggctccacggtgaccctgctgtgcggcacctcggatttacacccacagtcccatccccagggttcccttctgggcagtttccttgacttaaatcccaaccccggtgttgcatttttaattcccaccggctcttttgtattctctgtgcctttgctttaaaagcacgcggctctctgaggggtcctgtctccatcaccccagccttttccaggctggtttgtttccctgtttctccccttttctcttcctctgtgtgcgtctgtgtgtctgtgtgtctacatgtctgcgtgtctgtgtgtgtcagcgtctgtgtgtgtgggtgtctgtgtgtgtgtgtgggtgtctgtgtgtgtgtctgtgtgtacgtgtgtgtgtagacgtgtctgtgtgtaggtgtctgtaggtgtgtctgtgcatgtttataggtgtgtgtgtgcatgtctgtaggtgtgtctgtgcatccatgtgtctgtgtgtgtaggtgtgtctgtgcatctgtgcaagtgtcgacatgtctgtgtgtgtctgtgtgtagctgtgtgtctgtgcgtgtgtgtgtgtaaatgtgtctgtgtgtcattctttttttttttgagacggagtctcgctctgtcgcccaggctggagtgcagtggcacgatctcagctcactgcaagctccacctcccaggttcaagctattctcctgcctcagcccctcaaggagctgggactacaggcgcccaacaccatgcccggctaattttttgcatttttagtagagacaaggtttcatcatattagccaggatggtctcaatctcctgacctcatgatctgcccgcctcagcctcccacagtgctgggattacaggcgtgagcctccgcgcccggctgtccttgtgtcactcttcttcacacttgggagtccctctgatgatgcctgttgggcctgggcagcccctttggctgagagtcagtactttagaggatccccttccccagcaggaatcctgggtgctgagggcccatgagaaggagctgaggtctcccatttaatgcagagtcttgcacgcacacacctgctccgtgcctgcgcagggtccagcctcttccaaaagtcctcctgttctgggtggggaggggtctcagggctcctgacttcttccattcttgcccagcccaccctaggaagagggcgtgaggctctcccagacacaggtggggggcccagcctgtgttccgctcctccctgaggacgggtcccagtggccccacccgactgggtcatcgtgcagacggctgcctcagtttccccaccttcccctgcccgtgggcttcctcgttgtctccttccctcctgtcactcaggcggggcagggaggggcagacacaaaggcttcctgcgggtgagattggtgccgagctctgtgcccagcctggagcctcaggcctaccccagccttctccagcctcagagcccccacagcctctgcccaacactgccgtgtgctcccctgtctcctgggcgagttccttcaaacccttgaaagccctcacctaagccgggcacagtggctcacacctgttatcccagcactttcagaggccgaggcaggcggatcacctgaggtcgggagtttgagaccagcctgaccaacatggagaaaacccatctctactaaaaatacaaaaagttagctgggcatggtggtgggtgcctgtagtcccagctacctgggaggctgaggcaggagaatcgcttgaacctgggaggcagaggttgcagtgagcctagatcgccccattgcactccagcctgggccacaagaatgaagctccgtctcaaaaaaaaaaaaaaagttctcacctcccaagcagccccaagatgggtttgtttgctggagacagaggtagaaagatctgtcgaggaactggctgaaaattcctaagttgcaacatgggaaggtgttgctggagacagtgtcctgggggtcgggcctggcacccaggggcggccgcagaggaaccctgatggcaggtaccaggcggctgcacacagcccacagctgggctccggggtcagcagcggagacagagaagacccctgctcaggccaaggagccctcccaccctccattcttcaggcaggcgccccacccagcaggcctgacgctgcccctccttccagccggcacccaggccgagctcagccacacctgaagagccgctccggccagggaggacatgcccggcagagacagggtgcagagacagcctcgcccccacacggcgccaggccccacagctgccacagagacgggagccagccgcacgcagaggctcaagcccacggccctgggaggcgccctttcctgggcagggtgggcctgactgcctgctccatccaagcactggggcctcgggccgcgcggaggtcccacaggagggtcagagcggcatcttcccttcagggccctcgcccgggcaccccccggccaatggaccacagctgcacccggttcatccaccgccggggaccacccactcggacccgagccggcttcaagaggggcaagaggccaaggatccagcagaggcctcgggctcgagtctcaggtgaatagagcagccctgggtggcctcctacctctccaaggccaaggcctccctgggacgggtgccccatacccaaggaagtcagtcggcctcatggggcaggggcaggatccacacatggccatgccccgctgctccgagagaggggccagctgtgggcgccgggctctgcaggcacagaggggagctgtcgcgctccgcggcccagggttccgcctggctggcaccacccctggaagggcagcccctcgtctcccggcctgacaatggccccttgggtcacccatgacatcatcatggacattgtgacccctgccctccagggaccatccctgcgtcacgtctgcacccagcaccggcctcacagcccggcccctgccctgcaccaggccactgccctgttggtgaggagggtcggaggggcgacctccctgccccctgctccaagctccccacccccacctggaacctgccggcaggaagcctggccctggagggtggtcacggcccctccccagatgtaagcagtccccaggccgcctggtggggccagagctcgggctgaacttgagccccagacgggccagggggattgtccagggtattggagaaatgggctgggagcaaactggctgagccatgtccgggctgagtgggcagctcccgtagccaccccggtgggaccccaccccgttcacaggcccggcccacgagaggccaatggggagcagccaggaggagggactccggtgtcagccaagccagccagaccacgacgcagatggacactgtgggccggacctggagggggcagaaagagcctctgccacacccggaccccctgggctcctgaacagccaccggcctgcagactcggatgacactaacgccgccgggccctcagctgccctcctggaggggctcctgctggggggtgggaagccatcgccccacagcacccggccggggcccttcttctacattggaggcagcaacggggccacaatgtgagtagcggccctgggcgcccgtggtcccactgaatacccaccgcctgctcccggggcccagcccggcctccgctggccgcccgccatccccaaccccttgcctcggcccccaggtcacccccgcccccacccctcgcagcatcagctcctactgcaaaagcaagggctggcagcgcatccatgacagccgccgggacgactacacgctgaagtggtgtgaggtcaagagccgagacagctacggcagcttccgggaaggtagcgggagccggcaccagaggcgggcagcctgcaggggcctcctgggccggagcacagggcaggttggaggggtggggaccgaggtcctgcgctccctccacacgagccctggcctctgacctccaggagagcagctgctgtaccagcttcccaacaacaagctcctcaccaccaagatcgggctgctcagcacccttcggggacgggcacgggccatgagcaaggccagcaaggtgccggggggggtccaggccaggtgagtctgcccctgcccctgcccccgtccctgcgcccgcccctacgcctgcccctgcccctgcccctgcacccgccccacccctgcccctgcgcccgcccctgcccttgcccctgcccctggccacccaggctcccaggctggctccagcccctgcccctgcccttgcccctgcccctggccacctgggctcccaggctggccccagcccccacccgtcagcacctgcctccaccttccacctgtcctttaaagggccaaacccctgtcccataaacccaccctcttcctcgtggctgaacggggaagatcccacacgtccccaacccactgggcctgacacccacccacctgtccatctcacagacccacccaggtacaacccacctgtcaatctgccttcaccccaaacatccatccaatccatccacaatcccacaccgtgcccaccgtcacctgtgggtgccctgagtgaggccgtccatcgctcacccaagtctgggccatccatcctagcgacttcgtcctcctgctcccagccctgcccactgcccttctatggacccacctatccctcctcacttcatttggcccagacatttttgcaccaagcacccgcccagccaaccgcagctgcctccatctgcaccccccgcccctggttgcctgtgacaccagctttacaccatgtccagcgtccacttccagcctagagcaacacagctgtttcccccaggcaccgccgtccacccagccacctccttccaccacaactcacagtccgcccactcaccacccatgccccatcccccagtccccacccgctccaagcaccatgagctggcccctcagtccaggccctctgtcccctgggctgcaggctggaaaaggacgcagcagcgcccgccctggaggacctcccgtggacaagcccaggatacctcaggccacagaggtagactcagcccagctgtgaggggcccttcagaccgaagttcagacctaaacctggtgtcgtctgaaaaggagaaagcggggcgggggtcccacacaaaggaaaaccacgagctagagtcagaggttcagccaggccaggccgagatccacgctgaccccccagtgcacacagagctggggcagggccaggggctcaggccacgctctccgcccatcccagccgtgaggacactgccatgaggtggtggctcacaaatggctgagacggtgccagccgggagagcaaccatgagggaaaaagcagccagcgggaggggcccgggtgggggtcagcggccagaaggatgcagccagcagcacagcccgttgggggggtgctgcaaaggggcaggaaacgcaaagtccccacaaggagaacggccgcgggcgccaggtgccactgcccacactccctcccgccgggccacaggctgggcctcaaaccgcccacccagccaggggcgaagggacagcagctcatcctcctgcctccctgccctgcagggtcctgagaatggaagagtttttcccagagacctaccgcctggacctcaaacacgagagagaggcctttttcaccttgtttgatggtgagacgctgctggccggacaccaggctggccctggggagacagggtgagggctggaccaaggcgggggctgatgagggcagggctgggtctggaggggctgcgtggggctgggacgagacgaggtggtcaggaaggggccagggctgggcctggtctgggtggggactgaggagttggaaaggggagggtctggccttcgtggaggttggggtatgagggcactggggccagggctggagcttggtccgggtgagcgtggtcgaggcacgggcaggagctggggccaggcgtgtggttagcgcagggccaaggttggaatggccgggccgagggtcgcagcctggaggggagggtcctggtcgggccctaggaggggcgtggctgggttgggggcgaggccaggggctcaggccgcgctctctgcagaaacccagatatggatctgcaagcccacagcctccaaccagggcaaaggcatcttcctgctccggaaccaggaggaagttgccgccctgcaggccaagacccggagcatggaggacgaccccatccaccacaagacgccgttccgggggcctcaggcgcgggtggtgcagaggtgcggcggcgggtgcccggaggggtgagggtctgggctggctgacccgggccccactggtgcagtcagcagggccgccgaggagcccttggtcgtggaaagcagccgcaccaccagcccctgtgcagaccacagccgggcccccgtgtagccagcagaggggaggggtcacaccaggccggggtcacagacacaggatccagggttgaggggttagtcagtttgtccttcagctggggccccctctgtcctgcaggtggcctggcctgggtggcctcccggctgccagcccccctactccccggcccagccagccagctgcagccttcaggcctatggccaagctgaccactccttccctgagtgggaaggcttcctccagaaagccccgtggctgcacgaggctgaaggtttagacctgtcgacctcacccccggccctcgtagagcctcactctgaccacagctgccgtctgccgtccccagcttccatcggctcctccctcgcgtccctccacctggcgagctctccgcctggcgcaccccctctgcctgctgtgctccctctgcctagcgcccgcctggcgcgctccttcccttcctctccaaagccaccttcatgccctcctcctccaggcagccctccaggctcctactgcggttatgccctggagcacccatcagggtgccaggcctttcctcccaattcccctgacatattcaggcccagaaatgccccctttccctggaggtcacacctgggacagaggcggggcgctgaggaaatggaacaggcccggggtggggtgtgaggggatgcaggccaggctggccccgtggctcagcccagcagccccgacatggtgcccccaggtacatccagaacccgctgctggtggacgggagaaagtttgacgtgcgctcctacctgctcattgcctgcaccacaccctacatgatcttctttggccacggctatgctcgcctcacccttagcctttacgacccccattccagcgacctcggcggccacttgaccaaccaggtgagtctgccatgggtgagggccctccctgcagccttgggatgagattagaaggaggttctcactgctagggggtgcagagggggtgcagctacagaaggaggtggcccaggccgggaggtgtctcaggcctggaagtagcctgggctgcccccgctggcagtgagcactgcctctcacctcccgcttttggccacgtcagaagaagggcgtggcagggaccccgttagctggtgaaagggctcagagccctgtagccctcagcgtgcagcctggctcccaagccgcagctgagttttctgaggatggggtgcgggtgggcgtcggaaccgaggggattctgaggctgtcagaggaggggccctgtgggcagagatttctggggacgggtcttcatgggagagtccagggtagggaccttctgagaagatctgtggggtcctcacggctgaaggggggtctcagcggatgaaggtttttgtgggagggtctttgcaggcaggtcagggtggggccgggggagcaaggttaggggcggctgtctcagggacccccagagaacaggccttctaggttagggggatgttctcttggggacccccgtgaggacaggccctccggacagtctgggagccagtctccaggcaccgtgtgcccccagttcatgcagaagccttctaggttagggggatgttctcttggggacccccgtgaggacaggccctccggacagtctgggagccagtctccaggcaccgtgtgcccccagttcatgcagaagccttctaggttagggggatgttctcttggggacccccgtgaggacaggccctccggacagtctgggagccagtctccaggcaccgtgtgcccccagttcatgcagaagaagagccctctgtacatgctgctgaaggagcacacggtgtggagcatggaacacctcaaccgctacatcagtgacacgttctggaaggcccggggcctcgccaaggactgggtcttcaccaccctcaaggtgcgtccactgtgccctccagtctgggagtgagatccctcggggcgggggtgtgtggtcaggctgggcaccaggcacacagatgtccgtggcgtgcgtgggcggctgcgctgaagtgtgacctgaccgtgtggaaccaaacccttccagcgtctctgctcacttagctggcagtgcctgtccccagcagccagcaaaggcccggacggaaagcccagtcgggggtctgtcggcacgagtcccgcgggcagcctcgccgtagggtcaggggacagctcggcttcagtgacagccaccatgtgaagagtctttgttcctttcagatcctccacttggcaggcagggccaacagcagcccccgggccaggtgtcctggagcagcagcagctgcccgtgcaggcccggactctccctagctaagggccatgtgcggtggagtgtcctaattttgcagggttcctttctgtgggggtacctgtggggtacttcaaacagccctagcagcaaaggcccttgagcagcgcggtgtgaaactgggataaaaacggggcttggccgaaggacttttatctgtcttggtcaccccggccaggccccggaagcagcagccagggatggtccttcctcacccacaggcgtgtgtcactgtggctgggacggcagcgctcagaggagcctccagttactttcctcacatctcccaaactctctcttaattgcgataattcacagaacataaaattcacgatcttaaagtgtgcagttcagtggcttttagtatttcaaaagttgtgcaattatcaccaccaattccagaacatttcatcacctcaaaaaagaaacactactaacgagccatcacagctacattgccggccattcctggtcaccgctgatggaccttctctctctctcctgtctcctttctcttaccgtggtgttttcagggttcatccacgtagttcacgtatccttttcttttcttttttttttttttgagacagagtctcactctgttgcccaggctggagtacagtggcacaatctcagctcactgcaacctccacctcctgggttcaagcaattctcctgcctcagcctcccaagtagctgcaactacaagtgcccgccaccacgcgcggctaatttttgtatttttagtagagatggggttttgccgtgttggccaggctggtctcaaactcctgacctcaggtgacccgcccgcctcagcctcccaaagtgctgggattacaggcgtgagccactgcacccagccatgtatccctttcatacaacgttccgtcatatggatggaccatattttgccatcagctggtggacacagttttattattgagctgttatgaataatgttgctataaatattcacacaaaaatgtttgtatgaatatatattttcagtgctcctgggaaaatacccaggaatggagtcgtgggtcacagggtgacacacttaactttctgaggaaccaggaatcacttttccagtttctccagatctcgccaacacttgttattttcctttctttattaaagaatcaccatctggtcggtgtgcagggatatctcattgtgggtttgatttccattttgctaatgacaaataacttcatgtgttcactggccagctatgtatattctttagagaaatgtctattcaaacgctgtggctgttctttaccatccagttgtgaaagttttttttgtttgttttttgtttttttttttttgagacagaggctcgctctgtcgtccaggctggagtgcagtgatgtgattctcggctcactgcaagctccgcctcccgggttcacgccattctcctgcctcagcctcccgagtagctgggactacaggcgcccgccaccacgcccggctaattctttgtatttttagtagagacagggtttcaccgtgttagccaggatggtctcgatctcctgacctcgtgatctgcccgcctcggcctcccaaagtgctgggattataggtgtgagccaccgcgcccggccaaaagttctttacatattctaaacactaggcctttatcagacatatgatttgccaatatttttctggaatattgtggctgtcttttcactttcttgataatgtcctttgaccacaaaagcttttagttttgatgaaatccagtttatccatttttttcctttggttactcatgcttttagtatcatatctaaaaatccattgtgccaggtgcggtgactcacgcctgtaatcccagcactttgggaggccatggttgttagatcacctgaggtcaggagttcaagaccagcctgaccaatatggtgaaaccccatctctactaaaaatatgaaaattagccaggcgtggtggtgggtgcttgtagtcccagctacttgggaggctgagaaagaagaattgcttgaacccgggaggtggaggtagctgtgagccaagatcgtgccactgcactctagcctgggcaacagagcaagactccatctcaaaaaacaaaaaaataaaaatccattgcactttgggaggctgaggaaggtggatcacctgaggtcaggagtttgagaccagcctggccaatgtggagaaaccccatctctactaaaaatacaaaaattagctgggtgtggtggcgtgcacctgtagtcccagctactcaagatgctgaggcaagcgaatcacttgaacccgggaggcagaggttgcagtgagtggagatcgcactgctgcactccaacctgggtgatggagcaagactccatctcaaaaaaaaaaaaaaattgccaaatccagcagagtgaaaattacacttatgtttctttctaaaatggtatagttttagctcttatatttaggtcttggatccattttcagttaatttttgtgtatggtgtgagttagggatccaacagcattctcttgcatgtggctatccagttatcccagcaccatttgttgaagagactattctttcccccatggaatggtcctggcatagtatcaaaaaccaattgaccagagctgcaagtgtttatttttggactctcagttccattccattagtgtatatgtctgtctttatgccagtaccacatggttttgattgctgtagctttgtagtaagtcctgaaattgggatatgtgagtctttcaatattgttctttttcaagattattttggctattcaggggccccttacaattccacaattccatatgaattttaagattggcttttccatttctggggaaaaagtccaatgaaattttttttttttttttttgagacagagtctcattctgttgcccaggctggagtgcagtggggcaatctcagctcactgcagcctcgcctcccaggttcaagcgattctcctgcctcagcctccctagtagctgggattacaggcacccaccaccacgctcggctaatttttgtatttttagcagagaccaggtttcactgtgttggccaggctgatctcgaactcctgacctcaggcgatctgcccacctcagcatctcaaagtgctgggattacaggtgtgagccaccacacccagcctcatcgaaattttaataggcattgcattgaatctgtaagtcacgtagcagtggcatcttaacaatatttagtcttccgatccatgaatataggatgtctttccatttttctaggtcttcttccatttctttcagcaatgttttctagttttcagcatacaagtctgtcacctacggtaaatattattctaggtattttattattttgacacttgtgaatagaattattttttaaatttcctttttggattgtccattgctagtgtataaaaataaaactgatttttgtgtgttgatcttgtatccttcaactttcctgaattcacttattagctccgtgtgtgtgtgcactcttcaagatttttatataaggatcatgtcatctggaatagaaacagctttacctcttcctttcaaatttatatgcattttatttcttttcttacatattgccggctacttccagaacaatgttgaatagaagtagcaaaagcagtcatccttgtttgttcctgatctgaggaggaaggccgtgggtttctcataaatgccctcgtcaggttgaggaagttcccttctgttcctaattggttaagtgttttttgttaatatcctagaaggatgttgaaatctgtcaaatgctttttctgtctccactgagatgagtgtgtcttatttccccttcattctattaatgtgttgtatcgcactgattaactttcatatgacaaaccccgcttgatgatggtatagaaccatttaaatttaaatatgctgttggatttggtttgctaatattttaatgaggatttttgtgtctgtgcttataagcaatactggtctgtagtgttcttttctcgaatgtctttgcctgggtggtattaaggtaaccctggcctcatagcatgttaggatgcattctttcctcttttatttttggagtctttgtgaaggattgctgttaattctttgtttgaaataattcaccagtaaagccacctgggttttcctctgtgggaaagtttattattattattactaatactgctgcaatctttacttgttataggtccatccagattttctaatctttagtctgctttattttgctaagaatttgtccatttcaccaggcacggtggctcatgcctataatcccagcactttgggaggccgaggaaggtggatcatgaggtcaggagatcgagaccatcccgggtaacacggtgaaaccccgtctctactaaaaatacaaaaaattagctgggcgtggtggcgggcacctgtagtcccagctactcgggaggctgaggcaggagaatcgcgtgaacccgggaggcggagcttgcagtgagccgagatcgcaccactgcactccagcctgggggacagagcgagaccccgtctcaaaaaaaaaaaaaaaagaatttgtccatttcttctaggttatctaatttgtttagtgtacaaagtattcccttgtcatccttttaatcaatataaagtctttctcccctgattttagtaatttgattcttctctcctttttttttttttctttttggtcagtttctctaagtccttatcaattttgttgatcttttcaatgaaccaactcctggtttcactgattttctctactgttttctattccatttatttccactctatctttattatttccttcttactacttgccttgggtttagtttgctcttcttttactaattttttttttttttgagatggagtcttgctctgtcgcccaagctggagtgcagtggcacgatttcagctcactgcaacctctgcctcccgggttcaaatgattctcctgcctcagcttcccgagtagctgggactaagggcacgtgccaccactcccagctaatttttttgtatttctaatggagatggggtttcaccatgctggcaaggctggtctcaaactctctttttctaatttcttaaggtcaaaagttaggttatgatttcagttttttcttcttgcttaaggtaggtgcttagtgctatacattttcctctgaccaccacttttgctgcatccataagattttgcgtgttgtcttcattttcatttgtctcaaagtatttttatttttattttttattttatttgagatggagtttcgctcttgtcacctaggctggagtgtaatggcgcaatctcagctcactgcagcctctgcctcccgggttcaagcgattctcctgcctcagcctcccgagtagctgggattacaggcacctgccaccacgcctggctaattttgtttgtattattagtagagatgggggtttcaccatgttggccaggctggtcttgaactcctgacctcaggtgatccgcctgccaaagtgctgggattataggcgtgagccatgatgctcagctgcaaagtattttaaatttcctttgtaagcttttctttgacccattggttgcttaagggcctgttatttaatttccacatatttgtgatttttccaattttccttctgttattgacttctaatttcattccattgtgtcagagaacatactttataatttcaaccctttaaaaattattgaaaaattattggagctggtgtgttggcacatacctgtaattccagctactcaggaggctgagatggaaacattgcttaagcccaggagtttgagtccagcctgggcaacacagcaaaaccccatctttaaaaaaacaacaaacttactattcattaagtggatcattaaaaaacaaaaacaaaaaacacttgaaacttgtttatgtcccagcatatggtctatcctggagaatatccatgtgcactggagaaggaggtgtatcctgtttttgggtgtagtgttctgtagatgtctgtgccgagaccagctcggtcggggagaccctaacccggcggcgctagaggaattaaagacacacacagagaaatacagaggtgtgaagtgggaaatcaggggcctcacaaccttcagagctgacagccctgaacagagatttacccacatatttagtaacagcaaaccagtcatagcattgtttctatagatattcagttaactaaaagtatcccttacgggaaacgaagggatgggccaaattaaaggaataggttgggctagttaactgcatcaggaacacgcccttaagacacagatcgctcctgctattgtttgtggcttaagaacgcctttcagcggttttccgccctgggcgggccaggtgttccttgccctcattcccgtcaacccacaacctcccagcgtgggcgttagggccattgtgaacatgtcacagtgctgcagagatttgtttatggccagtcttggggccagtttatggccagattttgggggggggcctgctcccaacatgtctgttaggtctgtttggtttataatgttgttcgagtcttctatttactcgttaatcttctgtctctgtattgaaagcgggatattcagttgtctacttctcccttcagatctgtcagttttttgtatatttcgaggctctgttgttgggtgtgtgtatgtttatgattattagatcttcttggtttatcgttataaaaattttcctttaatctgcagtaataatttttgtgtaaagtctattttctgtgatatgagtgtagacactccagttggtataagtgtagacactccagttgatatgaatgtagacactccagttggtatgagtgtagacactccagttggtatgagtgtagacactccagttcgtatcagtgtagacactccagttgatatcagtgtagacactccagttggtatgagtgtagacactccagttggtatgagtgtagacaatccagttgatatcagtgtagacactccaattgatatcagtgtagacactccagttggtatgagtgtagacactccagttggtatgagtgtagacactccagttcgtatcagtgtaaacactccagttggtatgagtgtagacactccagttgatatcagtgtagacactccagttggtatgagtgtagacactccagttgttcatatcagtgtagacactccagttggtatgagtgtagacactccagttggtatgagtgtagacactccagttggtatgagtgtagacactccagttctactttggttaccgtgtgtggtacatctttttccatccctttactttccacctatttttgtctctgaaactaaagtatcttttgtagatggtatatcatgtttttttaagaaactccgtcaatgtctattaattggaaagtttaattcacttacatttaatataattactgataaagggccgggcacggtggctcacgcctgtaatgccagccctttgggaggccaaggcaggtggatcacaaggtcagggattgagaccatcctggctaacacggtgaaaccccgtctctactaaaaatacaaaacattagccaggcgtggtggtgagcaactgtagtcccagctgctcgggaggctgaggcaggagaatggcgtgaacccaggaggcggagcttgcagtgagccaagattgcgccattgcactccagcctgggtgacagagcgagactccgtctcaaaaaataataataataataattactgataaggtaggatttacatatgctattttgttatttgttttctatgtctgtctttttttgttcctcagtttctccattactgcctcctattgttttagagagatattttctagtgtagctttttttttttgaaacggagtttcgctcttgttgcccaggctggagtgcagtggcgtgatctcggctcactgcagcccccgcctcccggattcaagcgattctcctgcctcagcctccctagtagctgggattacaggcgcatgccaccacacccggctaattttttgtatttttagtagagacggggtttcactatgttggccaggctgatctcaaactgctgacctcaggtgatctacccgcctcagcttcccagggtgctgggattacaggcgtgagccaccacgcctggcttagtgtagcattttaattaccttgtcatttattttactatatgtttttgagttattttagtggttgtcctgaggattaccattaatattgtatcttaatttactacaattagggtgagtgtggtggcttatgcctgtaatcccagtgctttgggaggctgaggcaagaagatcatatgaggccaggcatttgaaagcagcctgggcaacatagtgagaccccatctctaaaaaacaaaattagctcagcatgggagtgtgcacctgtagtcctcctagctatttagggggctgagatgggaggatcacttgagcccaggaggtcaaggctgcagtgagccacaatcaaaccacattaccccagcctaggtgacagaacaagaccctgtttctaaaataaaaaatgttttaaaataaacaattcagttttttattaataccaagttaatttcaaaagcatacaaaaacacactgctcctaaaagtatacaaaaacactcctcctacacagccccacccctctcatgctgttgtcacaaattacagctcagtatatttgtgtccatcaacatggattcataattattgttgtatacagttgtcttttaggacaaaacaatcacatacaaaaaaatacatgtatgctgtctcttatatttaattacacaatgaccttttctggggctctttatttcctcctgtgagttccagttactgtctagtgtcttttcatttcagcctgaaggacggtagggcgggtctacctttgtttatctgggaatgtcttaatctccccttcatttttgaagcagcttttgctagatgtagaatttttggtcaacagtatttttacttttgggaatttgtgccatcccactgcctgcccacctcacgacctctaatgagaaactggctgttcatctttctgtggatgcctcatacataacgagcggcttctctcctgctgatttcgacgttctctgtcttttggaagtttgctgatgaggtggtggatctctgagtttatcctactttgagttcattgagcttcttgaatgtgtaggttgtttttcattaaactgggaagttttctgccattattttttcaaatattgtttctgctcctttctcttctctccttctgggactcccattatgcatatgttggtccatttgacagtgtcccacccacaagtctctgaggctttatttttcttccctctctctctctctttcattttttgttttgagacagggtttctgtcacccaagatggagtgcagtggtgcaatctcagctcactgcagcctcctccttctgggctcaagcaatcctccggcctaccagcctcccaagtagctgggactacaggcacgcaccatcacatctggctaatttttgtatatttagtagagacgaggtttcacaatgttggccaggctggtctcaaactcctgacctcaagcgatccccctgccttggcctcccaaagtgctgggattacaggtgtgaagccactgcacccggcctcctttttctttctgttcctcagactaaataatctcaattggcctatctgcaaacaattcaaatctgctgttgagcacttctagtgcatgttttatttgttctacttttgttctacttttcaacttcagaatttctatttgattctcttttataatttttctctcttcaccagtattctctattatttgataagacatcatcgtcatacttttttttttttttttttagttttagtagaggcagggtttcaccatgttggcaaggcttgtctcgaactcctgacctcaggtgatccacccacctcagcttcccaaagtgctgggattacagacgtgagccactgtgcccggcccatacttcttttttttagacagtctcactgtgtcacccaggctagagtgcagtggcacaatctcagcttaccacagcctctgcctcttgggctcaagcagtcctcccacctcagcctcccaagtaggtgggactacaggcatacaccaccacgcttagctaattttgctaattttttggtagagacaaggtctccctatattgcccaggctgatctcagactcctgagctcaagcgatcctcctgcctcagcctcccaaagtgctgggactacaggtgtgagccacgcgcccgaccaacttgtgtatttctagtagagatggggtctcaccatgttggccaggctggtctcaaactcctgagctcaagcaatcctcctgcctcagcctcccaaactgctgggactacaggtgtgagccacgtgcctggccctcacactttctgttagtcctttcaaatgggatcttccaaggaactactagacataagaaaacaaataatgacaatttttttttataaatgaggtctattttgctatctccagttctggggatgcatgctgttggttttttgaggcaaccattgagctggggagcagaggatgaaaccagagcacgttaaaatacaacataattcacagttcttaccaagattcgagattttacgtatcccatttgctatccgtctcttctgctcaagggcagagatttcctgtgagttttcctcactctcgtatctccagtgcctgacacaggacaggagctgcacgagtttgttgagtgagtttctggctgtgaacctgtgaggctgagtgcacgaacgtgtgggcaggtgtggctgtacaggtgcgggttcagatgggagtgcaggtgagggatgtggctgtggctgttcagacctggggtgtgatcagggcctacgggccgcagccaggatgcctccctgcctccctgcagaagcggatgcagcagatcatggcccactgctttctggccgccaagcccaagctggactgcaagctgggttactttgacctcattggctgtgacttcctgattgatgacaacttcaaggtgctgtcctgggcggcggggggcacagtagacagatgcaaggaggcaggggccatctgtacaccctgaccacactggcaggccccaggcagaatctgcagtcagcccccaccctgcctgcatgcagccctggggatgggtgtatccatgaggctcaccccctgtgcagctaggatggaactgcaccccctcctcagagcagccccctcaggccagagcttcagaccctcagagcttcagtggacaaacaggggagcaaggctataggaaggaagcaatctcccagagccatctgtctgaatgaggaccagggcctctgcctcctgctggcccagtgggctcggggtgaggagggactgactggcgtctggggcaggtatggctgctggagatgaattctaacccagccctgcacaccaactgcgaggtcctgaaggaggtcatcccaggtgtggtcatcgagaccctgggtgagcctccaagcccccaccccacacccccacaacctgcccagtcttgaatgcctacctgccctcttcccaagttcagacccccacagatggggctcttccacctcccgagggcctgtgtggcagcgccgccccctgccccaaccttccccacacctcagctcacctgggtcccacccctcacaccctccccaccccctccagccccagcctctgccccccactcaccctctctcccccacccgcaccagacctggtgctcgagaccttccggaagagcctgcgcggccagaagatgttgcctctgctgtcccagcgccgcttcgtgctcctgcacaacggtgaggccgacccgcggccgcacctggggggctcgtgcagcctccgccgctggccgcccctgcccacccgccaggccaagtcctccgggccacccatgccgcatgccccagaccagccgggcgcccgcaggcctgcgccacctcccttggtgccgcagcgtccccggccacccggccccgacctggacagcgcccacgatggggagccccaggccccgggcacggagcagtcgggcacaggcaacaggcacccggcgcaagagccttccccggggacagccaaggaggaacgcgaggagcctgagaacgcgaggccctaggggcagccacccgcgcccagcgccccgcgccccgcgccccagccgtgctgcctgccctcagggacctataaagcccactttgctac

SEQ ID NO: 177 - DNA, 6167 bp, Homo sapiens
  source 1..6167: mol_type = genomic DNA
acagcccggcccctgccctgcaccaggccactgccctgttggtgaggagggtcggaggggcgacctccctgccccctgctccaagctccccacccccacctggaacctgccggcaggaagcctggccctggagggtggtcacggcccctccccagatgtaagcagtccccaggccgcctggtggggccagagctcgggctgaacttgagccccagacgggccagggggattgtccagggtattggagaaatgggctgggagcaaactggctgagccatgtccgggctgagtgggcagctcccgtagccaccccggtgggaccccaccccgttcacaggcccggcccacgagaggccaatggggagcagccaggaggagggactccggtgtcagccaagccagccagaccacgacgcagatggacactgtgggccggacctggagggggcagaaagagcctctgccacacccggaccccctgggctcctgaacagccaccggcctgcagactcggatgacactaacgccgccgggccctcagctgccctcctggaggggctcctgctggggggtgggaagccatcgccccacagcacccggccggggcccttcttctacattggaggcagcaacggggccacaatgtgagtagcggccctgggcgcccgtggtcccactgaatacccaccgcctgctcccggggcccagcccggcctccgctggccgcccgccatccccaaccccttgcctcggcccccaggtcacccccgcccccacccctcgcagcatcagctcctactgcaaaagcaagggctggcagcgcatccatgacagccgccgggacgactacacgctgaagtggtgtgaggtcaagagccgagacagctacggcagcttccgggaaggtagcgggagccggcaccagaggcgggcagcctgcaggggcctcctgggccggagcacagggcaggttggaggggtggggaccgaggtcctgcgctccctccacacgagccctggcctctgacctccaggagagcagctgctgtaccagcttcccaacaacaagctcctcaccaccaagatcgggctgctcagcacccttcggggacgggcacgggccatgagcaaggccagcaaggtgccggggggggtccaggccaggtgagtctgcccctgcccctgcccccgtccctgcgcccgcccctacgcctgcccctgcccctgcccctgcacccgccccacccctgcccctgcgcccgcccctgcccttgcccctgcccctggccacccaggctcccaggctggctccagcccctgcccctgcccttgcccctgcccctggccacctgggctcccaggctggccccagcccccacccgtcagcacctgcctccaccttccacctgtcctttaaagggccaaacccctgtcccataaacccaccctcttcctcgtggctgaacggggaagatcccacacgtccccaacccactgggcctgacacccacccacctgtccatctcacagacccacccaggtacaacccacctgtcaatctgccttcaccccaaacatccatccaatccatccacaatcccacaccgtgcccaccgtcacctgtgggtgccctgagtgaggccgtccatcgctcacccaagtctgggccatccatcctagcgacttcgtcctcctgctcccagccctgcccactgcccttctatggacccacctatccctcctcacttcatttggcccagacatttttgcaccaagcacccgcccagccaaccgcagctgcctccatctgcaccccccgcccctggttgcctgtgacaccagctttacaccatgtccagcgtccacttccagcctagagcaacacagctgtttcccccaggcaccgccgtccacccagccacctccttccaccacaactcacagtccgcccactcaccacccatgccccatcccccagtccccacccgctccaagcaccatgagctggcccctcagtccaggccctctgtcccctgggctgcaggctggaaaaggacgcagcagcgcccgccctggaggacctcccgtggacaagcccaggatacctcaggccacagaggtagactcagcccagctgtgaggggcccttcagaccgaagttcagacctaaacctggtgtcgtctgaaaaggagaaagcggggcgggggtcccacacaaaggaaaaccacgagctagagtcagaggttcagccaggccaggccgagatccacgctgaccccccagtgcacacagagctggggcagggccaggggctcaggccacgctctccgcccatcccagccgtgaggacactgccatgaggtggtggctcacaaatggctgagacggtgccagccgggagagcaaccatgagggaaaaagcagccagcgggaggggcccgggtgggggtcagcggccagaaggatgcagccagcagcacagcccgttgggggggtgctgcaaaggggcaggaaacgcaaagtccccacaaggagaacggccgcgggcgccaggtgccactgcccacactccctcccgccgggccacaggctgggcctcaaaccgcccacccagccaggggcgaagggacagcagctcatcctcctgcctccctgccctgcagggtcctgagaatggaagagtttttcccagagacctaccgcctggacctcaaacacgagagagaggcctttttcaccttgtttgatggtgagacgctgctggccggacaccaggctggccctggggagacagggtgagggctggaccaaggcgggggctgatgagggcagggctgggtctggaggggctgcgtggggctgggacgagacgaggtggtcaggaaggggccagggctgggcctggtctgggtggggactgaggagttggaaaggggagggtctggccttcgtggaggttggggtatgagggcactggggccagggctggagcttggtccgggtgagcgtggtcgaggcacgggcaggagctggggccaggcgtgtggttagcgcagggccaaggttggaatggccgggccgagggtcgcagcctggaggggagggtcctggtcgggccctaggaggggcgtggctgggttgggggcgaggccaggggctcaggccgcgctctctgcagaaacccagatatggatctgcaagcccacagcctccaaccagggcaaaggcatcttcctgctccggaaccaggaggaagttgccgccctgcaggccaagacccggagcatggaggacgaccccatccaccacaagacgccgttccgggggcctcaggcgcgggtggtgcagaggtgcggcggcgggtgcccggaggggtgagggtctgggctggctgacccgggccccactggtgcagtcagcagggccgccgaggagcccttggtcgtggaaagcagccgcaccaccagcccctgtgcagaccacagccgggcccccgtgtagccagcagaggggaggggtcacaccaggccggggtcacagacacaggatccagggttgaggggttagtcagtttgtccttcagctggggccccctctgtcctgcaggtggcctggcctgggtggcctcccggctgccagcccccctactccccggcccagccagccagctgcagccttcaggcctatggccaagctgaccactccttccctgagtgggaaggcttcctccagaaagccccgtggctgcacgaggctgaaggtttagacctgtcgacctcacccccggccctcgtagagcctcactctgaccacagctgccgtctgccgtccccagcttccatcggctcctccctcgcgtccctccacctggcgagctctccgcctggcgcaccccctctgcctgctgtgctccctctgcctagcgcccgcctggcgcgctccttcccttcctctccaaagccaccttcatgccctcctcctccaggcagccctccaggctcctactgcggttatgccctggagcacccatcagggtgccaggcctttcctcccaattcccctgacatattcaggcccagaaatgccccctttccctggaggtcacacctgggacagaggcggggcgctgaggaaatggaacaggcccggggtggggtgtgaggggatgcaggccaggctggccccgtggctcagcccagcagccccgacatggtgcccccaggtacatccagaacccgctgctggtggacgggagaaagtttgacgtgcgctcctacctgctcattgcctgcaccacaccctacatgatcttctttggccacggctatgctcgcctcacccttagcctttacgacccccattccagcgacctcggcggccacttgaccaaccaggtgagtctgccatgggtgagggccctccctgcagccttgggatgagattagaaggaggttctcactgctagggggtgcagagggggtgcagctacagaaggaggtggcccaggccgggaggtgtctcaggcctggaagtagcctgggctgcccccgctggcagtgagcactgcctctcacctcccgcttttggccacgtcagaagaagggcgtggcagggaccccgttagctggtgaaagggctcagagccctgtagccctcagcgtgcagcctggctcccaagccgcagctgagttttctgaggatggggtgcgggtgggcgtcggaaccgaggggattctgaggctgtcagaggaggggccctgtgggcagagatttctggggacgggtcttcatgggagagtccagggtagggaccttctgagaagatctgtggggtcctcacggctgaaggggggtctcagcggatgaaggtttttgtgggagggtctttgcaggcaggtcagggtggggccgggggagcaaggttaggggcggctgtctcagggacccccagagaacaggccttctaggttagggggatgttctcttggggacccccgtgaggacaggccctccggacagtctgggagccagtctccaggcaccgtgtgcccccagttcatgcagaagccttctaggttagggggatgttctcttggggacccccgtgaggacaggccctccggacagtctgggagccagtctccaggcaccgtgtgcccccagttcatgcagaagccttctaggttagggggatgttctcttggggacccccgtgaggacaggccctccggacagtctgggagccagtctccaggcaccgtgtgcccccagttcatgcagaagaagagccctctgtacatgctgctgaaggagcacacggtgtggagcatggaacacctcaaccgctacatcagtgacacgttctggaaggcccggggcctcgccaaggactgggtcttcaccaccctcaaggtgcgtccactgtgccctccagtctgggagtgagatccctcggggcgggggtgtgtggtcaggctgggcaccaggcacacagatgtccgtggcgtgcgtgggcggctgcgctgaagtgtgacctgaccgtgtggaaccaaacccttccagcgtctctgctcacttagctggcagtgcctgtccccagcagccagcaaaggcccggacggaaagcccagtcgggggtctgtcggcacgagtcccgcgggcagcctcgccgtagggtcaggggacagctcggcttcagtgacagccaccatgtgaagagtctttgttcctttcagatcctccacttggcaggcagggccaacagcagcccccgggccaggtgtcctggagcagcagcagctgcccgtgcaggcccggactctccctagctaagggccatgtgcggtggagtgtcctaattttgcagggttcctttctgtgggggtacctgtggggtacttcaaacagccctagcagcaaaggcccttgagcagcgcggtgtgaaactgggataaaaacggggcttggccgaaggacttttatctgtcttggtcaccccggccaggccccggaagcagcagccagggatggtccttcctcacccacaggcgtgtgtcactgtggctgggacggcagcgctcagaggagcctccagttactttcctcacatctcccaaactctctcttaattgcgataattcacagaacataaaattcacgatcttaa

SEQ ID NO: 178 - DNA, 3202 bp, Homo sapiens
  source 1..3202: mol_type = genomic DNA
tcactggacaagtgtttattgaaggtcccctgcagccgggtcccgtgctgggcactgcacacccacggacacagcctcccgtcctaagaccccaccccatcagggccagcaagggaggaagggggccatgactgtgtctctctctccctcctgcagggcccagccgcggccgccgaactgcatggtccagggcgctggtcactgccaccttcctgcacccacttctgctgccaggggagcagggcccggcccagagcagaacgcagagcccctgcggcctggggagctcctggggaggggctggctgcggtcggtggccccggaggacggccaggctcacacccacaggtctcccagccgccccttctcctctgccgatcgctcgccccgctcttcctcggggaactggcagcttctggcgtcttcggtcgacggcggcacctccagcagcagctgggtctctgcaggggggccacggtcagcaggcagccatgctcccacctccccgcaccaggctgtgacagacctcggggccacatgcactgactcctcagctgccagatgtgcagtccaagctgggccgaggtcaggaggaggacgcaggcggccacggccaggaggacgacggtcagccacccaagcggctctgccggcggggaccctgggacgcacacagcgttgtgggtcttgttcccagggaacacagtgagaaacccgaactgggtgcagctggaatacatggacgcggcctcctatcagcccccggacacggcctccgatcagcccccggctgctgccctccgtgctgtctggggcaagggacaggagaggacccttcctcagagtgggcctggaccacccggccaccggcagggcccacccaggactcactctgtccaaggtttgcagtggccttcgtggcccccggagaaggtccccgaggcacagtcgatacactggaagccaaaactgaatttccctggtgtggggtgtggggggagggagggagggaggctggtggagttgctgggatggatgaggagggcgtcaggccagtgcaggggtccatctggggtctgggtgctgagtagaatgccccccccatcatccattcaacagagttcttcatggcccaggactggggcccatgtctgcccgtcccaggtggggcgtctggggtggggcccagtgagggcacctgggggaggtgcgcagagtgcagtgggcctgccagggaggggaaaggcctgcccattgggggctgagggtgggcagaagccaggcaggacccagtagaacagagggtggagaacagtgagggtcccagagagagtgaggctgggtcccagttgaccccagaccctgccccgtccaacctgacacaacctccccagttgtaccttctcccagctctcatgtgcccagcctgacctctcctgtcaggtaaacaagccgctaagaggacttgagctgctccttccagaacagggtgcagccccaggccccagacaggactccggggggcacagggcaggctctttcagtatgtggtgaggacagacaggatgggtgtcccgggcctgagagccagacagctcctggaacccgcccccacctccccgcagggttctcacagccctcgtgctggatggagaagcccaggctgagaaagcagggacaggacacccccagagcttcatggcctgtggtgcctgagcatggcctggcctgcccggcctcacaggactccggaccccacacaccacatgtcctcgccggacacctgtgcccacgagctctgcctcgggccctagtggaacccctggcctgtgtggactcccagaggcacctccaggacttaccctgggactgtaccccctggcctgggggacaagggtggtgccggcaggtcgtgcagcaagggtctccgcagtggaattcaggctggacacacatgcagtcccactcggaacagcactcctcgcctgggcaggagacaggccagccccccagcagctgggctgaggccccctcctccccaggcctcccctcggccctccaggggagtgaggttgtccgttctccacccacagttggctccagggagcagagggctcctggctgggagtctggaccctgggtttatccagctgtctctttctcctggggccatgtggcctggctactccccctttgcgccccacagctgcccctgcccaggtgctaactccatatgcaaccaggagctgcccctgcaggacccaggggtggcccccaacagtgcacagtcccctggaggcccgtcgacacctcagaggccgcctgcctggtgtctgggcgctgctgtccccaccaccagccacactgggcctccggacagagcctcccttcccaacccacaggccctggaggaagaagctctggggtgacttccctgccagcttcctctccagaccagccgtgtcagctgaaccctcatccccaggtgcaggtcagaggcaggcagcaggccagacggtggtgcaggggggccctcaactgggcaggagggggctgggcgatggccaagggctcacgacccgcccagcaggacctggaacagccgtcctccacctccagaccccagacccctcttgagggcgctcccacctggctcacccctgctcccggccggggccactggctggagctggcacacctccgcctccctctgggatcctgcctccctccggaaggctcccgctgctggcggctctgtgcccaccctccttagacctcagcaacgccggtctgagcacgggaaggggggcgcccacccatcccggcttccgcgggacgccttggccggtccgcgttaagtaaacgcggtttacttacccgggtaatcgcggcagcagcgcgtcgtgtgaacccggcagcagcgcgcgtccgttcccgtcccaagcaggaggcgcccagggccgcacccgggacccccggtggggcgctgacccaggctgagcgcgcacagcagcgccaggccgcacagggcccgaaacgcgcccatcgccccgtgctgtgccatgctcgggtttcaagagcccacagccagttggacacgccccgtccccgtcctcacccgccctgcccggaggtggctgggaccgttcatgacctgagaatcccgacccaggtgaagtgcgtgtgaggagggggtgtagac

SEQ ID NO: 179 - DNA, 3202 bp, Homo sapiens; identical to SEQ ID NO: 178
  source 1..3202: mol_type = genomic DNA

SEQ ID NO: 180 - DNA, 3202 bp, Homo sapiens; identical to SEQ ID NO: 178
  source 1..3202: mol_type = genomic DNA

SEQ ID NO: 181 - DNA, 77383 bp, Homo sapiens
  source 1..77383: mol_type = genomic DNA
ctcgcgcccagcgcagtcgctccgagcggccgcgagcagagccgcccagccctgccagctgcgccgggacggtaagcgatcgccgctggctgcgtcaggggaggtgggaagaggaccgcggccaggggctttgggagctgcggctgcgctcgggggcgcggggctggctggcgggcgtctctccggcacacacagcccgtgcgccctggccctgggcgcctccccgagtctagcgagccgggtcctgggagccccgggggccgggctgctgggacctgggcgggggctgccctagaggcccggggccgtcccccgtgggcccgccgagaggggcgtgcgcagctccccggcgcctgcactgcgcgccttgcccgcctggcccggcagcggggtttcagctgcgctcacagcggcggtgcggcctccggtgcgccggctgaggcgcgaggatactggaagcgctcagcgcgtgcgcccgctccgagcgctgactagaggaccaggggcctcctctgtacggcagcggggtccacagagagcgcgctggtgatgtcgcccgagtgccctggcgcggagagagggctgcgcacagttcgccggcgcccgggtcctgtgcgcccttcccagcctgggcaagtggggagcggggctgcagaggggccggggtggaagttttcggggcttcctcccggctcgtggacccgcgccccgcctcccagtcccgggcctcccgcgttgctcgccgcgtttgctgcagcggcgcaggcgagatcagctccggatctgcggccgagccggggttacgccggcaaaaccgcccccagctttgcatttccggactttttaaaaaaatactcttacccgtaattcagcctgaatgaggctttttaaaaaaatcgagtttcctgtttttatttaggcttcctcatttgcacctcctcctttgaggtagagaagaggggaactgggacgacctttcgtgggcaccaggatgggggcgttgcagggcggggagacgggggtccagagaaccggggaagggccgctgggaggtcccgaaaagtgcgctgtgggtggggcgagggtgaagcaggtaggggcgagatttccggggtcgcgggtggggggcgccctggagcggccaaggtgcagggtcctcgcgtggcacccttgggatctgcccagtttgcggatggagcgcggggctgatcgggcaggtctcacttgtgcaggtgttccctggaaggtgggacctgcagatcttgaaccccaccagactccatcaagggggcttcttcccgccgattcctgagaagtcctacctctgagatgctgggcacagccgcacgtggatgtgggcgggtgtgccgtgggttggagtgggaaggggcaattattcctctctcagggctctcggaggggaaggtttactgctccctagggactttgaaaccaagggctaaccccctgctctcttccaggagagtgggataccgcccgggtgcctgacggtgccttggtgttcttgacaattgaatggtaccatcgggacattactccccaaagaactggtcgttcttacctaggtgatttcagctggacaactgtaggagctgagtggtgttgtcttcattttacagttaaggaaacgaaggctcagaaaagttaaataactcaccaacccacacagtttacaagtagtttctccaggatcccagctctttccgacgccagcgcgtttaatcatctgggggtgccgttgcttgcgggggaaggagaatgtcctagtaattctcttgggggggatttggaggggacgactgttcagagaggcaccctctaagatacccttgagactcctctgtaacacccgctgctgctgttcacaccccctccccaatttgattgatgtgttgagtggggcggaaggttcttttggttgatgaggctgcgaccaaacgcaaggagatataaatagagctttctctttggctctctctagagcagaaatgccaaccccttagcatttccatggcctgctggagtttcatttcttgatattaggattccagccatcttggctggtgagaggcctgctggcggcttcctgggcttggtcctcttttggtgctttcacagaatgatggaagacactggagtgggctggaggagtgctcttaaaacccagttgtggctgagagcggtagctcatacctgtcatcccagtgctttgggaggcccagacgggaggatcacttgaagccaggagttcaaggttgcagtaagctattacagtgccactgcgctccagcctgggtgacagagcaagagcccatctctgagaaacataatacaacaacccagttgcctgctccagagacaactaagctagcctccttctgagccccacttcccccgcccttcagcccctgttcagaaacagactacattggccacactactcacttagatgtttctggaattagggcacgtgccccagaggtactcccgaccacgcagatgtccccttctggcaggaaaagcgcgtttctgcgtttctgcagcctcagtccacgccgccaggtctttgcactaagctgtgggctccgtttctcctccgataccatgtttagcaagtgtttcctgagatcacacggggtgccaggggctgtgctaagaacagggcaggcagactgggagggcatcagcccctggggggcttacaggacagacagtccaccaatggttgtgcgaaagccagcccgctttcgcacaactgtccgatggaattcatggaggtgggagtggggatggtgagagtcggttcctgcttcatcttgttttacttaaattgcacagtgaaagggagaagtgaatgtgcaacggatgaagcaattcccctttggctgggttattttcaaaaccatttttgtgtagagagcagttcccgccctccctgaggccagctgccggtgtgggcctgatggtggggtttggggccccagcaaatgtttccttaacgtgggaccttcagaaggctctttcaggctgggcgcggtggctcacgcctgtaattccagcactttgggaggccgaggtgggcggatcacttgaggtcaggagttcaagaccatcttggccaacatggtgaatatctgtctctacgaaaaatgcaaaaaaaaaaaattagctgggcgtggtgatgagcacctgtaatcccagctacttgggaggtggaggcaggagaatcgcttcaatccgggaggtggaggttgcagtgtgctgagattgtgccactgcactccagcctgggcaacagagtgagactacatttcaaaaaaaaaaaaaagaaaaaaaagctctttcagccaggagggtggcttcagctactccccaggggacaagtgtgtttttcagcaaagctgttagagaagatggtctagaagcagtaccccgggatggaggagacaaggaagggccctatccactggaggatggcagagcctggcttgtttgaaagggaggaaaatattgtcatcttggtaccggtgacagtgtttcataaatagcgaaggtggcaaaacgccacctctctccctacagttaacgctaagactgagttgtctttagtttggttggtggaaatccccggcaatcatagcagaaatgctgccagtttcaagatggaaaaaataaaaaacccaggaaccccccgccccccccccttttttattgcagctaaacactgtgacttgctgtgggtcctaccaaaataacggccattctcccctccctgagggccagcacagtccctagggcctgtgaaagttccccttccagctgcactggctggatatgcgtgaaactcccctccctccccagaagtcacaaccttaccacctcggataagggtcagggctcctggaaatgggtcccttttcctattactttctttcttttttcttcttttttttttttttttttgagacggagtctcgctttgtcgcccaggctggagtgcaatggtgtgatctcggcccactgcaacctctgcctccaggttcaagcgattctcccacctcagcctcctgagtagctggaattacagatgtgcgccactatggccagctatttttagtatttttagcagtgacggtgttttgccatgttggccaggctggtctcgaactcctgaccttaggtgatctgcccaccttggcctcccagagcgctaggattaaaggcgtgagccaccatgcgcggccttcctattacattctgagcacagggggagtgatcagagtgaagggtgtggcatttccaaagtggtatttcggttggcttctgtttcactcatattgggggaaattgcttccacttagagaaaatgccggaagagtgggcggtgccaggagtagggtgggggaggaggagatgcagaaagggatagacctatttgggatttttggtcctggagggatgctgtacgggttaagtatcccttatccaaaatgcttgggaccagaaatggggtggagtttggattttggaatatttgcattatatgcttaccaactgaccattccaaatccaaatatctgacatctgaaatgctccaaggagctttgtatttgatcatgatggcactcaaaaattttggattttggaacgttgtagatttcagatttgggatgctcaaccagtgttaacctcctgtggttgctgtaacaaatgacctcaaactttgtggcttaaaacagaaacgtgcatgcttatagtttcagctacttgggaggctgaggtgggaggatcacttgtgcccaggagtttgaggctgcagtgagccatgattgagcctgtgagtagccatggcactacaacttgggcaacattgcgagatcctgtcactaaaagaaaacaacagcaatgggccgggtgtgatagctcacgcctgtaatcccagcactttgggaggctgaggcgggtggatcacctgaggtcaggagttcaagaccagcctggccaacatggtgaagccccgtctctactaaaaattcaaaaattagccaggcgtggtggcacgtgcctgtagtcccagctattcgggaggctgagacaggagaattacttgaacccaggaggcagaggttgtagtgagctgagattgtgccactgcactccagcctgggtgacagagcgagactccatctcaaaaaaaaaaaaaaaaaaaaatgtattctctcacagttctggaggccagaagttaaaaattaaggcatcagcaaggcctcgctccctctgggggctgtagggggagaatcctgctttgctcttccttctgggggctccagcgtatcttggcctgtggctgcatcactccagtctctgcctccgtcttcacaagggcatctcctccgtgtgtctgggtctccgtctgtctcttttaaggacacttcttgttggatttagggctccctcagataattcagatagaaatcatttcaagatccttaacttacttacatctgcaaagacccattttccacattattatttttccagataatgtccaggtcctgggggttaagacctatctttgtgggggccaccaatcagcccgcttacagataaacaggaatgtctttctgtattttctggggacggtgggaagtgcggttatctttgcagggaagccgccctgttctgccactttcccctgggtgactttaggcaaagatgtcagagtccctggtggtctctgctggaccattgaccccagcctccttcctgctttccgttccccaacttttatgaactggcagtccccacctcacccccaacctcctggggtcccaggagcagaaaacttctggagctcaggaggagaaatgcttctcttactttccctccccaacaaactcctccctctttatcttcaacaacagtccctgccctccgcagcccattcccagcccagggctactctctctctctctgaggtcacacagcccctcacattttgaaatttcatctgttgggcagaggtggggggagggctcagatggtgacacagacactgctctgttcccacctcttaccccaggacatggtatggggctggtggcactgggaggggtttggggagccccattaatcattgaagtttgtaggaggggtggataaggacatgggagaatgattgggtgaggtgctccagggctctctggaagggctgggccccccccttgcatcagccacagtgggggcattgctcttttctatgttggtcatgaaatctggaagaagtgctttcttatcaatagagaagcataatcagccttgtttttgaaactttggaaaaccatttatggctgggcatggtggttcatgcttgtattcctaatgctttgggaagctaaggaaggaggatcacttgagcccaggagtttgagaccagcctgggcaacatagtaagacccccatctctgcaaaaaataaaaataaattagctgggccttgtgatgcacgcctgtagccccagctatgtggaagactgaggtgggaggattacttgagtccaggagtttaaggctgcagtgagctatggttgcaacactgcactctagcctgcgtgacagagcgagaccctgtctcaaaaaaaaaaaaaaaaaagtcatttatgtccaggtgagggtggggctgggtgaggtggtggttttagggggattgccacgtgggagaaaatgtactgtctttggagtcagctgaactgggttttttcccagccacatttttttttttttttttttttttggtgaggcagagtctccctgtgtcacccaggctggagtgcagtggtgggatcttggctcactgcaacctctgcctccaaggttcaggagattctcctgcctcagcctcccgagtagctgagattacaggcacatgccactatacctggctaatttttgtatttttagtagagacagggtttcgccatattggccaggctggtctcaaactcctgacctcaggtgatctacctgcctcggcctcccaaagtgctgggcctggccaccaagccactttttatctgctgggtgaccttgggcaagtcacttaacccatcagaacctcagagtccagttgtaacactgagacagcaatacctacctgttagtcttgaggattttgtatattatcctgtgtaaagtgccaggcacatagcaatccatgcagtgtctgcaaaggagctggtgtggagtggattagaaacagaagtcatgtatcatcatccctctagcccaacacagcggttgcccatttgggtatcctttccattaacttcttttggatgtgcattttaacttagttgtaattatgagaacacatggacacagggaggggaacaacacacactggggcttgtgagggtggggtagggggtgggagagcatcaggataaatagctaatgcacgcggggcttaatacctaggtgatgggttgataggtacagcaaaccaccgtagcacacgtttacctatgcaacaaacctgcacgtcctgcacatgtaccccagcacttaaaataaaaaataatttagtcgtaattagtaggcatatgctttttatcttaattttcatgttttaattgtaaaatatacataacataaaatttaccatcttaagcatttctaagagcgcagttctgtgggatttacactattgtgcaaccgtcaccaccgcccaccctcaggcatttttttcatgttgcaaaattgaaattcttttccccttaaacactaactcccctctcctcccagccctggcagccattctgctgtctctgtgcttttgacaactctaggtactgcacatgagtggaatcctacagtatttgtctttttattactggcttcattaatttagcatgtttcttgaagcttaatccgtgtgggggtatgtatcagaatttctttcattttttaaggctggacattccactgtgtgtaggtactacattcttttctttttttgagacagtgtcttgctctgtcacccaggctagagtgcagtggcatgatctcagcctcactgcaacctccacctccctgattcaagcaattctcctgtctcggcctcctgagtagctggaattacaggtacgcaccaccacacctggctaatttttgtatttttttgagacggatttttgctcttgttgcccaggctggagtgcaatggcgcgatcttggctcaccacaacctccgcctcccaggtttaagtgattctcctgcctcagcctcccaagtagctgggattacaggcatgtgccaccacgcccagctagttttgtactttcagcagacgggctttcaccatgttggtcaggctggtctcaaactcctgacctaaagcgatctgctcgctcggcctcccaaagtgctgggattataggcgtgagccaccgcgcctggccaggaccatgttctttcgttccattcacccgatggacacttctgttgctcccactctatggcttttgtgaataatgctgcgttgtgaacatgggtggacagagacctgttgaagtccctgccttcagttctctcaggtatatacccaaattgctggatcatatggtaatccaatttttaatttttttgagcagctaggcatgtgcttttgtagtttgctttttttcacttaacattggctcattaacagttttccacattgcttcataacctacgcatcctttttagtggcagtgtaagtgccattgagctgctattgggaagcaagaaaaaattacagtcattataccagtcttagcaagaattatagtcataccatcgtccttcccacccttcttgcccagatccaccgggaaaacagaggaatagcacatggggatactccttggtgcctcccaggctgagcgtgggcacacactcgggaaggcagctgagccaccccttcatgcctttgtctccccacttcagacagccagcctttcagtcgccagttctacttttttgggtttttttttccactttagcagttttaaggaacatttgtatataaaatgactttattcttgcatcttgttaattatttcttccttgtattttcccctttcatttcctacatggtgagatttggctttccattcaaggatttgttcttgctttcttttttctttcttttttttttttttgagacagagtcttgctctgtcgcccaggctggagtgcaacggtgtgatctcggctcactgcaacctccgcctcccgggttcaagcgattctcctgcctcagcctccagagtagctgggattacaggcatgcgccaccacgcccagataatttgtgtatttttagtagagatggggtttcatcgtgttggacaggctggtctcgaactcttgacctcaagtgatccacctgcctcagtctcccaaagtgctgggattacagacctgagccaccgtgcccggccacgcccagctaatttttgtatttttagtagagatggggtttcatcatgttggccaggctggtctctaattactgacctcaggtgatctactcgcctcggcctcccaaagtgctgggattacaggcctgagccactgtacccagccaaggatttttcttttcttttctttttccttatagggtctcattctgttgcccaggctagagtgcagtggtgcaatcacagctcactgcagcctcgactatatgggctcaagtgatcctcctgccttagcctctggagtagccgggactgtaggtgcatgctaccacccctggctcatttaaaacattttttttagtagaggccgggtgtggtggctcacacctgtaatcccagcacttttggaggccaaggcgggtggatcacttaggatcaggagtttgagaccagcatggccaacatggcgaaaccccgtctctacaaaaaaatacaaaaattggccgggcgcggtggctcacgcctgtaatcccagcactttgggaggccgaggcggacggatcacgaggttaagagatcgagaccatcctggctaacacggtgaaaccctgtctctattaaaaatacaaaaaattagccgagcttggtggtgggcacctgtagtcccagctacttgggaggctgaggcaggacaatggtgtggacccaggcggcggagcttgcagtgagccgagattgcaccactgcactccagcctgggtgacagagtgagactctgtctcaaaaaaaaaaaagttagccggacatggtggtgcatgcctgtagtcctagttactcaggaggctgaggcaggaaaatcacttgaacccttaaccagggaggcggaggttgcagtgagccgagatcatgccactgcactccaacctgggcgacagagcgagactcgatctcaaattttttttttttgagagacaaggtcttgctatgttgcccaggctggtctcgaactcctgagctcaagagatcctcttgtcttggccttccaaagtgctgggattacaggcgtgagctaccacgcctggcccattcacggatctttttgtggtcattgtccagtgttagcctaatgataacagcctggctgggatgaatgccagcgtggacagtcgtgccattagacttttccccctgcactcgttcagtgtagatgacgtatttcttcctttaaacctggacccgctttgctggtttgctggcctctgtggtgtcctcacacaacctgaacttaggcttctgcctcagctctttggaaagagggaaagacaatctctcttcctgcgaatatgggaaggtgcatagaaatgccttttgtggttcttgctgtggttctaagtcacgaaggtattgaacttcattttggccactccggcttcggtgatggccacaaaagtgaagagcggttccattacttttttctttcttcttttttttttgagacagcatctcgctctttttcccaggctggagtgaagtggcaagatctcggctcactgccatctctacctcccgcgtcctagcaattctcctgtctcagccatctaagcagctgggattacaggtgcatgccaccacgcctggctaatttttgtatttttagtagagacggggtttcaccatgttggccaggctgatctcgaactcctgacctcaggtgatccacctgccttggcctcccgaagtgctgggatgacaggcgtgagccactgcacctggcagcggttccatttctttatcaaactattgctctgcggaggctgtctctctgtccagcccatagctggacattatgggctgtacagcgtgttctgtggtctgaagaaatgacagccatccaaacccacacggtgtcttctgttctggtttggctctggcgctctgagcatttgcactttccactgggtaagcaaagcccactccaagtcagcgtctattcaagacccagtcgtagtccccagggctaccagcctcagtttcacttgccagccatgttcagggcctcccaccagggaagctaccccacagccctgtgcagtgtctgtctctctcactggcacacaggacagttcttcctggcattatgtgcccgagagggtgcggaggaacatgctagatccagcccatctctgcaccgctgtggggcccgtatcccctcatttcacggacccagatggccatctcaagggagcatgtgggatatctacctgttgatatctacctgttgattcctgtcaccttccaaacctagaaggctcttctggtgggcattaagaggtctgactttatttactttatttttttatttttatttttttaatatttttttattatactttaagttctagggtacatgtgcacaacgtgcaggtttgttacatatgtatacatgtgccatgttggtgtgctgcacccattaactcgttatttacattaggtatatctcctaatggtctccctcccccctccccccatcccaaaacaggccctggtgtgtgatgttccccttcctgtgtccaagtgttctcattgttcaattcccacctatgagtgagaacctgcagtgtttggttttttgtccttgcgatagtttgctgagaatgatggtttccagcttcatccatgtccctacaaagcacatgaactcatccttttttatggctgcatagtattccatggtgtatatgtgccacattttcttaatccagtctatcattgatgaagaggtccgacttcaatgcacccctcgttttctttctttctttttctttttctttctttcttttttttttttttttttgagacggagtctcactctgtcgcccaggctggagcgcagtggcatatctcagctcactgcaacctccacctcccgggttcaagtgattctcctgcctcagcctcccaagtagctgggactacaggcagacatcaccatgctcggctaatttgtgtatttttagtagagacagggtttcaccatgttgcccaggctggtctcaaactcctggcctcaggtgatccacctgccttggcctcccaaagtactgggattacaggcgtgaaccactgcacccagcctaccctcattttctatagggctgtgtcccaaagaaatatccgtttaataggtcaggtttgcattgccctcctgtctaaatgtatggccaggctgttgaccaccacccacaaggggagggtgaactggcacccaaagccctgcacagatacagggggttttaccactgttcaagtctcccatcactgctgggaaaacagcatgcaattcgacccttagagctgatttgtttttaccatctttgatcagattggcatctttgcaaacgaggcattgttcaccttggaactgctagccaccaccccagcagctctcgtttggtcagggagagttgtttgttgggcgctacagaatccagctgctcatcatagtgccagagtcagtcctaggggaaaagaggatccctgctcatgtgagtatctcctccttgccttccccaggtaatgccatcgtgtataaatgatttctgttttattagggaactcttctgggcattgtcatccctgttagagtgtttccttgacatcacctgagatgtcctgggtatttcagtcttaagattattttatgtcctagctgggtgcagtggctcacacctgtgatcctagcacactgggaggccaagatgggaagattgctagagcccaggagtttgagaccagcctaggcaacgtaagggagaccctgtcctacaaaaaataaaaacagttagctgggtgtggtggtgtgcacctgtgattccagctacttgggaggctgaggcaggaggattgcctgagccctggaggtcaaggctgcagtgagccgtgatcgcactaatgcattttagcctgggtaacagagtgacagcctgtcaaaaaaaaaaaaaaaaaaaaaacctgaaaaagtaatttcatgttcttcagtcatatccatcataggggtagctttggtgaatgtcccatggcaaggtagtaaatgcctctcaagaggaaatgctctactccaaagccccagtagttacctcatctctgggagatttgggtgccagttcaccctcccctactacaggcgcacgccgccatgcccggctaattttttgtattttggtagagatggggagcgctcacaagctcttgccgtagctctggtttacattccgcacagggctgtggaacagaattcgctcatgccagtacatgccggcactgcagcttctattctacactgtgtgggcttggtgtggacattgacatgtccaattaatactgcttgaggaggggatttacacgcttcctggtttccaatagtaggcaggggaaatattccgcagccagatattatatccattctcataaaatatttaggtaaaggagacttctttctgtttaaacatttcagctttcgtcatcctataaaccctttcattctttttttttgtcccccaagacggagtctcactctgtcacccaggctggagtgcagtggtgcgatctccactcactgcgacctccgcctcctgggttcaagctattcttctgcctcagcctcccaagtagctgggactacagctgcccaccaccatgcccagctaatttttgtttttgtttttgttttttgacgcagagttttgctcttttgcccaggctggagtgcaatggcacaatcttggctcactgcaacctccttctcctggcttcaagcgattctcctgcctcagcctccagagtagctgggattacaggcgcccgccatcataccctgctaattttttgtatttttagcagagatggggtttcaccatgttggccaggctggtctcgaactcctgacctcagttgatccacccacctcagcctcccaaagtgctaggattacaggcatgagccaccgcgcccggtctttttttttttttttttttttttttttttttgaggtggagtctcactctgtcaccgaggctggagtacagtggtgcaatctcggctcactgcaacctctgcccccccaggttcaagtgattctcctgcctcagcctcttgagtggcagggattacaggcacccaccaggctaatttttgtatttttgtagagacagggttttactatgttggccaggctggtcttgaactcctgagctcaagtgaaccacctgccctggcctcccaagtgctgggattacaggtatgagccaccatgcctggccgtattcaaagattttctgattggcaactcgttgaaagagttaagctttgtcttgaaatcagtagaaataaatgcttgaggtcaggtgtagtggctcacacctgaattcgagaccaacctgggcaacatagtgagaccctcccccatctctacaaaattcttttttaatttttatttacttatttattttttgaggcagagtctcgctctgtcgcccaagctggagtgcagtggtgcgatcttggcttactgcaacctctgcctcccgggttcaggcaattctgcctcagcctccccagtagctgggattacaggcttgcgccaccatgcctgctatttttttttttttttcagagatggagtctcgctctgttgccctggctggagtgcagtggcatgatctcggctcactgcaacctctgcctcctgggttctagtgattctcctgcctcagcctcctgtagctgggactacaggcgtacaccgccatgcctggctaattttttgtattttagtagatacggggtttcaccatgttttccaagctggtctcgaactcctgagctcaggtaatctgctcgcctctgcctcccaaagtgctagcattacaggcatgagccactgcgcccagccaaaaattgtttttaaaaattagctgggcacagtggcatgcacctgtaatcccagctacttgggaggctgaggcgagaggattgcttgagcccaggaattcaaggttgccaagggtgatgatcacaccattgaactccagcctgggtgaccaatttatcccagtgacatataatagtttcataacatccttgccagcattgaataatattgaaagaatttttttttttttttgagatggaggctcactctgtggtccaggctggagtgcagtggcgcaatctcgactcactgcaagctccgcctcccgggttcaagtgattctcctgcctcagcctcccaagtagctgggaccacaggctcacgccaccacgcccggctaattttttgtatttttagtagagattgggtttcaccgtgttagccaggatagtctccatctcctgaactcgtgatctgcccgcctcggcctccgaaagtgctaggattacaggcgtgagccaccgtgcccggccgaaataatgttttgctaataggctcagaggtaattatttaaaacatatctttcttttctttttctttttttttttttttgagatagggtctcactctgtcgcccacactggagtgcactggagcaatcacagcttattgcagccccgacctcctgggctcaagtgatcctcccaccttagcctcccaagtagctgggactacaggtgctgccaccatgcctggctaatttttgttttttttttttttttttttttttagtaaagacagggtttcgccatgttgcccatgatggtctggaactcctgggctcaagtgatcttcccgccttcgcctcccaaagtgctgggattacaggagtgagccaccacgcctggtgtaaaacctagttcttttattgccaatgagtttaaatagctttctttctctttactggctggatgtatagcatgaggtctgcacttccttagttgtccagtgaaccaactccccgggagttggattcatcttgaaattcagtaatgcagtagttaaacccatgaactctagtggtgggcagattcagattcaaaccgtagctcttccacttcccagctgtgtgactctgaggtgcctacttaacttctctgatcctctatttccttgtctgtaaaatgaaccttaatgggcccattcctaggtttgtctgaaggattaaataaggtaaatagataatgaacatcaccttccacatagttgatgctctgtaaatattagctgttcttattcttttttttttttttggtttggcaaatactttatttttatttttatttcagtagtttttggggtacaggtggtttttagttatacgagtaagttctttagtggtgatttctgagattctgatgcacccgtcacccaagcagtgtacactgtaccaaatgtgtagtcttttatccctcaccctctcccatgcttcccctcattcttattatatattaatataaattaacaagtctctgttctccctcaagattgattttgttttaatctatagcagattgatttttctgccttagaggtagatggtcccagaaggggagctgacaacctctttctgtccaaatagactgtgtcctcggctggctgactggatctgggtgtgagcctccctgagcaagccggtgaacctctcccatgtggtcttagctccctgagcagatgagtaggggctgacggggctgtgtctccaggactctgagtctgctgtggtcctgcagcctctggagcatggaaatgggggctaaggactcactaatggtttcattcaagtccagaatttgtcttggtgactgttcgctgctcacatccagatgaccctatatgctgtttgggaaactgaggcagccaggtggattcctcaggtatttcaggggacagaatctggggctttgactccagcttgggttgctgcccataatgcctgctcttgaaaccttttaattatttttatttctaattaactttttttgagacaaggtcttgctctgtcacccagggtgcagtgcagtggagctatcatagctcattgcagcctcagtctcctgggttcaagtgatccgcccacctagtagttgggacaacaggcatatgccaccacacccgggtaatttttgtagctttttgtagagatggaggtctccttttgttgcccaggcttattctgagtcaacatgagtgaccatggcccaagaaacagtctcaagaggtcctgagaaagtgtgcccaagacgattgggttacagtttggttttatgcattttaggaagacaggaattgtaggtaaaatcataaatcagtacatgaaaagtatacattggttcaggtctcaaactcctgggctcaagcgatcttcctgcctcggcctcgcaaagtactgggattacgggcatgagcctgcgccagacctcttaaacccttcagagtggccttggcattcgttttgagggggcttcagggagccttaagggaggagaggaaagtcacgcaaacagggtgtgcttgatgcctgcattttcctctttactgctgacctgctgttgaggaggaagttaagaacatcaggatattggtctcaaatgaactacttcatgagaattttcttctaggaggaaaaacaaaaacctcaactttctcgttacacatccttctaaaaaagtccattaaaaatgtttcttgccaggcgcggtggctcacgcctgtaatcccaacactttgggaggccaaagcaggtggattacctgagatcaggagttcgagaccagcctggccaacatggtgaaaccctgtctctactaaaaatacaaaaattagctgggcgtggtggtgggtgcctataatcccagctaattaggaggctgagacaggagaatcacttgaacctgggaggcagaggttgcactccagcctgggtgacaagagagaaattccacctcaaaaaaaaaaaaaaaaaaaaaagttcctcatattcagagccaaggaaaggagatgtactcccagaccacaacttctgtttctgatggtttcaagcatccaggagccatgaccaggtcatgaatctttttttccctattgtgtggtgtgatgagtatttgaataatacagcccatctgctgtcatttggaaaccggtgatgatgtgtggtctatttgtaaattgagtgcagcacatctaatatgtgatagtttcctaagatgtgaatggctccatttctccagcaggaccgtgttttgaaaatgaataaaaggttagcttcagattagcattaaaagcaagagttttagaattacaggcttcatatcttggctttgacacttaacatgtaggggaccttgacaagttatttaagtttctgggttctcatctgagaattaggatgatagtacctctttgactggattgtcgtagagatgtcgtaaagattggaaataatgaaacacctggaccaagttatgggtacccaaaaagttgcagtttttaccattggatgaatgaatctttgaggcccacactgtggtagggagtggatttttaaaaaacaatttgtttttggtttttttttagatggagtctcgctctgtcaccgaggctggagtgcagtggtgcgatcttggctcactgtagcctccaccttcctggttcaagcgattctcatgcctcagcctcccgagtagctgggaccacaggcgcccaccaccacacccagctaatttttgtatttttggtagagatggggtttcaccttgttggccaggctggtctcaaacttcttacctcaagtgatctgcccgtctcaacctcccaaagtgctgggattacagatgtgagccaccgcgtctggcctaaaaatttatttatttagaaacgagtctcactctactgtccaggggctggtctttttttgagataaagtctcactccgtcgcccaggctggagtgcagtggtgcaatcatatctcactacatccttgatctcctgggctcaagcgatcttcccaccgcagcctcccaagtagccaagagtacaggttcatgccatcacaccccgctcattttgtatttcaatggaagacagggtttcaccgtgttgcccagactggtctccaactcctgggcccaagagatccacccaccttggccttccaaagtgctgggattataggtgtgagccaccaggcctggcctgtccgggctgctcttgaactcctgagcacaaatgatcctcccacctcagcctctcaagtagctgggactatgggtgagccctgctcagcctagctgagtggattttaatgacaggtgttcctgtcatgagttcttgaggtttgcagggtgtagtaagctttattcatccattaccttatttgatcttcccatgaatgactcagatggaatgcacagagcatgtgtcaataaataccccattttgctatgttgcccaggctgctcttgaattcctggactcaagagatcctcccgcctcggccccccaaagtgctggaattacagacatgagccactacatctggccttgtcagcgttttctagcctttcaaggtaggaaggagcttgggtatctgaggcaaatactgctggaagtgagatcttgagcaggccattttcttcctctcccagggtggtggcaagagccgcccctggccccactcaaggggcctggactggaaggtatggcagctcacagtgcggtctgccctcaggtgaccttggccacagcagtggattctggtgtcacctgtgaggctcacaaggcagcaccccaggagcccttgtgctgcgggttcccagggggagtgggtaggagatggccgggcagctggcagtaaccttgaccctgatgggctgtgtttctccaactttcccaccatccctccagcctgaagagatgggatgtgcagctcttgacctgcagccgcccaccccaactgcgacctcgctttgaagcttcaacttctatttttaaagctaatgttaattttacattcgattccatgatatatccatgtttattttactataaagcatattttcccctaactttagagtcaaatgggtgctctgggaagatgtttatgttttttctgtggcttccgctactcccagcacagcgactccaaccagttttaaaaatgtggattagtaccaaagaggatgatgaaccattagacacaattaggatgagaaatgccgagattatttatttatttatttttagagacagggtctagctctgtctcctaggctggactgcagtggtgccatcatagctcaatgcagccttgaactcctgagctcaagtgatcctcccgcttcagcctcctgagtagctcccaagtgcacactgccatgcccagctaatttttttcattttcggtagagacaggggtcttgctgtgttgcccaggctggtctccaacttctgggctcaagcaatcttcccacttcggcctcccaaagtggtgagattataggtgtgagccaccgtgcctggtggagaaacgaatagtttaatagcacttttatccaatgtgctttgttggttgagtaactgactttggttcaggtagagaattattaagatgcattacctcaaatgtaaacattttattttatttttttccgtggctagccgcacagagtcctatatacctctccagcagcactcacctggagaagctgctatggatgccagctactgttatttctcccttcccaataaatatttcattttcacttaaaatatgtcagtgtacattggttccctgatctgctctcagatggccaagggcttatgtttgagtaggtcacaggttcatctttctgtatgaggcgtacatgcaacgtataatccacttttttaatcctactttttttttttttttttgagacagggtctcgctctgtcacctaggctggagggcagtggttcactcacggttttctgcagccttgacctcctgggcttaacccatcttcctgcctcagcctcctaagtaagcagggatcacacacacctggctaatttttttatttttttaattttttgaaacagagtctccctctgtcgccccggctggcgtgtaatggtgcgatctcagctcactgcaacctctgcctctctggttcaagcaaacctcttgcctcagcctcccgtgtagctaggattacagtcgtgcacaacgccacatctggctaatttttgtattttagcagagattggttttcactatgttgttcgggctgatctcgaactcctgacttcaagtgatccacccaccttggcgtcctaaagtgctgggattacaggcatgagccaccatgcctggccttggctaatttttttgatttttagtagagacgaagtctggctatgttgcctaggctggtctcgaactcctgggctcaagcattcctcccagctcagcctcccgaagtgccggaattgcagatgtgagccacagcgcccggccttccttctacattttaataattcctgctgagattttacagttgtcttgcctggtctaattccataattctacaggaagtttgttttattgggtgacttgtcttttactaggtttctgaagcactcagctttgttttcttcatggaatcagctcctttcacacccagggtgcaccctcttatgtaataattacattatatgattacacaggtaaacaactgccatccgattggagcaggcatggcgacctctgtgggcatgcagagacaggaaggaaggctcgactccatggcaccccgggggtggtcagcacgtagaggccattggccagggtgtttggtaagggcatggagagcgccattcacccctgattctgctaggtaggagtcagggtaagtcgtagggatcacagagcctgggccagaggcaggttcaacttagaaatccctccgggactaggggaagccctcactctgagaatgagcacatgctccagaaagggggcatcaggtaaagtttcttttcccgtgggtcctgtcagtagcatttgtacttaggagctttgccgtttgccagctgaaagttgccattttcattaacgtagcttgccgtttctgtatctaataacaacaaacacttttgtaatatgtaccctgtgccaggcagtgtactgggcactttgaaaatacgaaggttggccgggcgcggtggctcatgcctgtaaccccagcactttgggaggccaaggcgggtagatcacctgaggtcaggagttctagactggtcaagaccagtctgaccaatatggtgaaaccttgtctctactaaaaatacaaaaattagccgggtgtggtggtgggtgtctgtaatcccagctactcgggaggctgagacaggagaattgcttgaaccggagaggtggaggctgcagtgagctaagatcatgccactgcaccactccagcctgggcgacagagcgagactccgtctcaaaaaaaaaaaaaaaaaagaaacaaaaagaaaagagagaaaaggaaaatactaagctagccggacactgtggttcatgcttgtaatcccagcactttggaaggctgaggtgggcagattgcttgaactcaggagtttgagactagcctgggcaacatggcaaaaccccatctctacaaaaaaatacaaaaattagccaggtatgatgatgcacacctgtagtcccagctactccagaggctgaggtgggaggatcgctgcttgagcctgggaggcagaggttgcagcgagccgagattgcaccactgcactctagcctgggcaatgtaaaaaaaaaaaaaaaaaagagagagagagaaagaaagaaagaaagaaatgctaagctaattagccttatgacaaccctgtttgaggccgggcgcggtggctcacacttgtaatcccagcactttgggaggccgaggcgggcggatcacgaggtcaggagatcgagaccatcctggctaacacggtgaaaccccgtctctactaaaaatacaaaaaaattagccgggcgtggtagcgggcgcctgtagtcccagctactcgggaggctgaggcaggagaatggcgtgaacctgggaggcggagcttgcagtgagccgagattgcgccactgcactcccacctgggccacagagcgagactccgtctcaaaaaaaaaaaaaaaaaaaaaaagacaaccctgtttggtaagtactactgtgattcccactttacagatggggaaactgaggcacagaaaggggaagtaacttacctaagtcttacccagccagaaagtggcagaggctgctcctaaccctgcaccatgctgcctccaaacacgggcttgttcccaggaagaagtgctgggttgggggaggggagtccagatcccagggaggaggactcaggaggcctctgggagtcaggcggctatgcaggaggggcttcctggctctttttcacttgtcccctcacccccaccccccgtccccaccttcccaggacttagttggacttccaggcagagttccttgtttgtttttgttttgttttttcctttttttagaaacagggtctcgctgtgtcacccagtctggagtgcagtgctgcgatcatagtttactgcaacctcaacctcttgggctcaagcaatcctcctgcctcagcctcctgagcagttaggactactgtgtgcaccgccacaccaagctaatttttttttttttttttgagacgaagtcttgctcttgtcccccaggctggagtgcaatggcacagtctcggcccactgcaacctctacctcccgggttcaagcgattctcctgcctcagcctcccgaatagctgggattgcaggtgcccaccaccatgcccagctaatttttgtatttttactatacatggggtttcaccatgttggccaggctggtcctgaactcctgacctcgtgatccacctgccttggcatcccaaagtgctgggattagaggtgtgagccaccgcacccagccacaccaagctaatttttagattttttgtagatatggggtcttgctaagttgcccaggctggtctcaaactcctgggctcaagtgatcctcccgcctcagccccccatagtgcgtaagccaccgtgcccagcctagttccttgctcttgaaggtccttgtgtctgatggagttggcgtcttggactctgatcctctacagcaagagtgggcagaaggacgcagctctggtgcctggcccttccccagttggcctggggtggtgcccattctccccaatgccaggggcaagcaaggcctggcctctacaatctcaatggcctccttgcccaacccctaggcctcttttgggaagttgacctaggtgtccttgagctggcagttgataccatctggctccagtgcactggcctgggagaggcagtggtacggtggtaaagagcaggctccagaataaacctaaacccacttccttccccgtcacctccttgagtcccactttcctcattcataaaactgaatggctgccttcggggcttgtcacaatgtttaatgagaaaatggacatcaggtgcctagtcatgggggctggccgctgtagccttgaagatgagcctgttgaaagatgaagaggctgtgctatgggacagagtctgaaccgatcccagaggctccaggggcaggagtggcccagagacctgctctgagaatggaagcattgtcacgggccccctgccaaggagagagtgtgaccaggacaatgactggtgggatgaggtgtccagagccctctatgtcatccccaggatttcttcctctttggttcagagcttacagggttgtctgcagatctcacgaggataggtggaggaggacccctaagctgacagccgggtagggaaggagggcctgagtgccgagtgcctgggcagagagccagctgcagatctcaccccaggagaatggggcgaactaccacatagctgacacttgacggggggactgccatgagtgtgtgtgtgtgttttgggagggaggttgtttgtttgtgattaagttgaggtcaggacagaagaaggaaagtggaatttgtagttttaagagatattatatggccatcttaagattgcagcagcagaccaggtgcggtggctcacgcctgtaatcccagcactttgggaggcggaggcaggcagatcacttgaggtcaggagttcaagaccagcctggccaacatggtgaaaccccgtctctactaaaatacaaaaattagccaggtgtggtggcgtatgtctgcagacctagctacttgaggagatgaggcaggaggatcgcttgaaccagggtggtcaaggctgcactgagccaagatggtgccactgcattccagcctgagtgaaaaagtgagaccctgtctaaaaaaaaaaaaaaaaaaaaaattacagcagaggctgcatctgggaattataggccgtgatcttccagatcgtgcatgcggatgttttaaatatatatgccatatgttttataaatgtgtttattcatgcatactgtacgtttttaattacatggaatcaacacaagttagttattaaaagtttataaaatatagatttggcagagtaagaaaaaaaagaatctgggccgggcgtggtggctcatgcctgtaatcccagcactttgagagatccaaggcaggcagatcacctgaggtcaggagttcgagaccagcccatggtgaaaccccgtctgtactaaaaatactaaattagctgggtgtggtggcgcctgcctgtaatcccagctgcttgggaggctgaggcaggagaatcacttgagcccgggaggcggaggttgcagtgagccaagatcgcgccattgcagtctagcctgtgcaacaagagcgaaactccatctcaaaaaaaaaaaaaacaaaaacaaaaaaacaaaaatccggccgggcactgtggctctcacctgtagtcctagtactttgggaggccaaggcaagaggatcaattgagaccaacctgggccatatagggaaaccctgtgtctacaaaaaacagcaacacaaaaactatccaggcatggtggcacacacctctagtcccagctgctcgagaggctgaggcgggaggatcgcttgagtccgggaggttgaggctgccatgagcctattatggcattggactccagtctgggtgacagagccagaccctgtctccaaaaaagaaaaagaaaaaaactccatcttccacctaccccagaaccacgtcacccagtggttcctaacctgtctcagattttaaatccctttgaaaacctgcagaaaagcatggactctctccagaaaaaggctctttcatccacagactctgttggtgtgcagggaaggactgtttaggtccaacctctagcttctctgtcgtatgagattctgactctgaaaccaacctcaaaggggcaaatcattctgaccctgtgacacctctgtaagacacacttgccagcaacctattcaaagtctgtcttgaacctgtttctattttctttcttgaccacctcttaaagaagacattgcacaagtttgcccctgccatttaaatcctttgtcctaaatttacagcccctttctggggctttcagcaaggatcgactttcctgcgtctttgggtgactctccactgtatcatcggctcatttctggaagaggaccatcctttggggcatgtgtaaggccccttttgtgggaagggccttggcttaggcacatggggaagcatgcctgcgagagctgggtgtgtgaaccttctttccgggtagtcaggagaaacttttttttttttttttttttttgagatggagtcttgctctgtcgcccaggctggagtgcaatggcacgatcttggctcactgcaacctccgcctcccaggttcaagtgattctcctgcctcagcctcctgagtagctgggattacaggcacgtgccaccatgcctggctaatttttgtatttttagtagagacggggtttcacggtgttggccaggctggtcttgaactcctgacttcaggtgatccgcccaccttggcctgccaaagtgctgggattacaggcgtgagccaccgcgcctggtctgggggaaatttctatagaggatgagaagtcagggatgttgacttctcatgctgggcctcaggtgcttgagaccagtcaggctctccctgtgaaattagcaagaactcaccctttggccaagtaggctgagcgccccacacccacatcgcctgtttacctctcaatattctcccaggccttggttagccgcccttagcccatgtcctgtttctcaggcatgaagaaggcccctgatgtcagcatcacagagctctcccagccctacaggtggccagccttcctggagaccactcctggtgccattccttgggcaccagtgactttgcctcttctcctcctcctcttcttcctcgtcatgttttagcataagaagctttattgagctagaattcacataccatacaattcatttaatgtgcacaatgcaatggttttttgttgctgttgttgttattgttttcgtttttatttttgagatggagtttcactcctgtcacacaggctgaagtgcagtggcgtgatctcggctcattgcaacctctgcctcccgggttcaagtgatccttctgtttcagcctcccgagtagctgggattacaggcgcccaccaccacaccgggctactttatgtatttttagtagagatggggtttcaccatgttggccagcctggtctcgaactcttaacctcaggtgatccacccgcattggcatcccaaagtgctaggattacaggcatgagccatcatgcctggcctaatggtttttatttttatttttaaattttttgtagagatggagtcttgctatgttgcctaggctggtttcaaactcttggtgtcaagtgatcctcccacctcggcctcccaaagtgctaggattacaggtgtcagtcaccaaaccccgcctcagtggtttttagtatattcacagttatgcaaccatcagcatcataaattttaagctgtgcatggtggctcatgtctgtaatccaagcactttgggaggctgaggctgaactcacttgagcctagaagttcaagaccagcctgggcaatatagtgagaccctgtctctattaaaaaaaaaaaattaaaacattttcatcactccaaaaagagatttcacaccattagcagttactctctacttttcttccatctctcagcctctggcaaccactaatctgctttctgtctctatggatttgcctgttctggacatttcatataaatgggatgatacactatgtggtcttttggggttgagtttgcaccttagcatattgcctttagaaacctgtctgcctcataccattacagaggagctgttgtttgtactgaccatttagtccatcacaggtattgatggagcctctaagcatggaatagtgctggccccacagcaggaacgcggcagccatgggtggcgtattagttactggttgctgtttaacaaatcacgccaacacttggcagactgaacagcaagcatttatgatcccgtagtttctgtcaatcaggaatacaggagccgcttcgttgggtggttccggtccagggtctcatgaggctgccattgagctttcagtggaggctgcaggtgtctggggctggaggtacctgccacagcgtggttggcaggctcagtgactggctggctgttggccagatatctcagttcctcttcatgtgggcttcttcatagggtggcttgagtgtccttatagcatggccactggcttaccccagagcaagagatgagagcactggagagagacagagagagagagagaagaggggaggggaggggagggggtgtataagcccaagactgaagccccagtgatgtttcataacctaattttttcattaattaattaattaattttagagatagggtctctgctgcccaggctgaggtgcagtggcacaatcagagctcactgcagcctccagctcctgggctcaagcaaccctccagcctcaccctctcaagcagctgggactacaggtatgcatcaccatgcctggctgctgctgctgctttttttgtttgtttgtttgagacggagtctcactctgtcacccaggctggagtgcagtggcgcaatctcggctcactgcaacctccccttcccgggttaaagcgattctcctgcctcagcctcccgagtagctgggactacaggcgtgcgccactagtttctgtatttttagtagagatggtttcaccatgttagccaggctggcttgaactcctgacctcaggcaatctgctcgcctccccgcctcgggctccaaaagtgctgggattacaggtgtgagctaccaaacctggcccggattcttttataatctaatgttaaaggtgctatcccatcactgtgccatattctttaggtcacattgactgtgaatgtgggtgggggctacacaacggtgagaatctcaggacggaagtaactgaatgtagtttcatatggagagtgatccagcttgttctggaagggactgcagtctccccgggacttagctttggagaatgagccagcttgttctggaagggatttcagtctgcccaggacttagctttggaccagctatgagttctctgtgatgaaatctcagcttttcccaactgcagcttcaacctcctgagttcaagtgatcttgttgcctcagcctcctgagtagctgggactaccaccacgcctggctaatttttgtattttttgtagaaatagggttttgccacgttggccaggctggtctccaactcctgagctcaagcgatctgcctgccttggcctaccaaagtgctaggattacagacatgagccaccacacctagccaaggctgcgtttttattttttattttattattagtattatttgagacagagtttcactcttgttgcccaggctggagtgcagtggcgccatctcagctcactacaacctccgcctccagggttctcctgtctcagcctcctgagtagctgggattacaggcatgccactacacttggctaatttttggtatttttaggagagacgaagtttaaccatgttggccaggctggtctcgaacttctgacctcaggtgatctgcccacctcggcctcccaaagcgccgggattataggcgtcagccaccacgtctggcctgggtatttatttatttatttcgagacggagtctcgctgtctcactctgttgtccaggctggagtgcagtggcacgatttcagctcactgccatctccgcctcctgggttcaagcgattttcctgcctcagcttcccgagtagctgggattacaggtgcacaccaccacaggtggctaatttttgtgtttttagtagagacagggtttcaccatgttggccaggctggtctcaaactcctgacctcaggtgatccaccctccttggcctctcaaagtgctgtgattacagtcatgagccaccactggggttttaaatgtgtaacaatggatgtccattttagtgggaactgaccctgtccctcagggacactcatgggccaaccaggaaaggagatgtctctgctgacttctgttagatggtgtaacccatcataggggtgacccagtgccatggtgggacgtgtcaaacgctttccccactgggattgggccctggaccttttttttttttttttttggggggctgggtctcgctaagatggcaccactgcatgccagcctgggtgacaaagggagacattgtctcaaaaaaaaaaaaaaaaccaaaaaaccaaaacaggctgggcatggtggctcatgcctgtaatcccagcactttgggaggcagaggcgggcggatcaccaggtcaggagattgagaccatcctggctcacacggtgaaaacccatctctactaaaaatacaaaaaattagccgggtgtggtggcgggaacctgtagtcccagctactcgggaggctgaggcaggagaatggcgtgaacccgggaggcagagcttggagtgagccgagatcgcgccactgcactccagcctgggcgacagagtgagactctgtctcaaaaaaaaaaaataaaaacaacaacaacaacaacaaaaaaaacgagccttgtgccttatagcagtgggacaacttggtgttagaagcagttttaggtggtggttccaggtgggttctgattcctgctctgtcacttcctgcacggcttcggcgtcagtttcctcatgaagatgactattgtaactatttagtggggttgttttgaggattttatgagatcttcagagttctagggatctcttgctacataacagcctgtcccaagctcagcggtataaagcaacactgtgatgctcacggtcccaggggccaggaattccgacagagctcagcaggacggcctggctctgctcccatgatatctggagtcagctgggaagactctcaaggggttggtaacaacttgaacaggtggggtctggaatcatctggaagtttcatcactcatgtctggtacctgggtgggatgacgaaggttgggctcaggtgggactgtcaacttgagtgccttcacatggtttctccttctggcttgcttgggttgtgtcactgcatggcagcgtcagggtagtcagacctctaacttaatgctcagaattccaagagccagcattctaaccaaggaggaagcggcatggcttctcatggcctcacctctcaagtcacttagcatctctgctgccatactctcttggcagtcacaagcccactagatttaagaggaggggacacagaggccatctctcaatgggaggagtccctgcaaccacgagccacacgtgctttttggctgatacttgaaagaatgagcaatgcaggctgggcgcagtggctcacgcctgtaatcccagcactttgggaggccaaggagggtggatcacctggggtcaggagttcgagaccagcctggccaacatgatgaaaccccatctgtactgaaaatacaaaaattagctgggcatggtggcaggcccctgtaatcccagctacttgggaggctgagacaggagaatcgcttgaacccaagaggccgaggttgcagtgagctgagatggtgccactgtactccagcctgggcgacagagagagactccgtctcaaaaaaaaaaaaaaaagaaaaaagaaagagcaatgcagttgggtgtgatggctcacatctgtaatcccaacactttgtgaggctgaggcaggcagatcccttgagcctaggagtttgagaccagcctggacaacatagcaagacctcaagacctcatcgctacaaaaattaaaaattagttgggcatggtggcacacacctcagctactcgggaggctgaggtgggaggatcacctgagtccacaaggtcaagcacctgtgatagcgccactgcactccagcctgggtcacagtgtgagaccctgtctcaaaaaaaaaaaaaaaagaaagaaaaaagaaaaaagaatgagcaatgcaaacccaagctttttttttttctctctctgcttatatccccaacccctcaactcctgccccaggtcacaaactcaggaagcctcaattaagacagacttttagtctaagcttggagaattgaggaaggaaagaaggaagtgccagatgctaattaactttgctttttaactacagatgagccactttttgagttacccaggggtgagagtctcaaagataaatgaaaatatgtaaggatggcaggagagcatgggcctcttataattaggtccctcattcttgtgctttgagaataaaaatatcaagggtggaatatgtgagtaaatatggaaactcctttgaggatttttttggagccctcctgtttattctaatagaattaaaagcaaacatgtaactggtttttttgtttgtttgtttgtttttggttgttgtctttagttgcttttttttggttatacttaatttatttttttattttttgagatggagtctcgctctgttgcccaggctggagtgcagtggctcgatctgggctcactgaaacctccgcctcccaggttcaagcgaatctcgtgcctcagccttctgagtagctgggatcacaggcatgcaccaccacacctggctaattcttgtatttttagtagagatggggtttcaccatgttggccaggccagtctcgaactcctgacctcaggtgatccgccctcctcagcctcccaaagtgctgggattacaggcgtgagccactgcgcccagcagttataattaaaaattttttaaagagatgagtatctcactgtgttgtccaggctcgagtgcagtgactattgacaggtgctatcaatagcgcactgcagcctcaaactcaagcgatcctcctgcctcaaactcaagcgatcctcctgcctcagcctgtgagtagctgcaactacaggcgccctcagtcgtgcctggctttgcctctgatttttttctgactttagccttcctggtcttgtccccactcagcagtggtgtcttacctgaccacacctagaaatgctgaatgccaatttgagttagaaagagaatagcagaattccagccaggttggaggctaggatattggtgagcatttgggagaagctgagatttcatcacagcaaaagtgtgatgaaatcacacatcacaaagtgtcaggagagggagaagtgactgatgcagcaaatactcttccatcttctagggctccttgaagggaacaagggctccaatgagtgggagcagaggctcatttggtttcctgccttatgttttgggatttaacaagaggattggcccttttagtagcaagtagaggagcaggaatctaatttcttggctccatcatagctcaccgcagacttctgggccaagcaatccttctcccttggcctcctaagtagctaggactacaggcaaatgccaccatgccaggctaattttcttttttttttttttttagtagagacgaggtctcactgttttgcccaggttgttcttaaactcctggccttaaatgatcctcccacctcggcctcgcaaagtgctgagattacaggcgtgagccaccgtgcccgccttaatttactctgatttttcttttctttttaaaatagagacgggggtctcactgtgtggcccaggctggtcttgaactcctgggctcaagtgatcctcctgccctggcctcccaaagtgctgggactacaggcgtgagccactgtgccaggtctactctgatatttaacagtggtaaaattcatttatccactaaatgactttatttatactctcacttaatttcagaaaggactgaaggtacctgagctgtgaacaaagaatcagagactggtttttcctccatctctgccactaactagttgtgccacctggggcaagtcacttggtctccttgtgtctgttatccatgtgtgagagccaatacttaatatgagtgccaggcactgttctagagattttccatgcatctgtattcactcttttaattcttctctacacaatttattaaggtctctatctttttagagtttgtcagggcagttccagttcatcgtggcaatacaagaaagtcacttttgggggcttttgccatttcaaagaatcttggatttttctctgggctccagagacacccgtgcctgacacccccaatttgaacccccagcggatcattgggttccattgctgatggggaccttgtgtttgagcttgactttccctccatccatgctggagataaacggaagtcttcgcgcagggggacgattgcaggacggggccgctagggaggagggctcccacacgtggggaatgggggtggaggaaccgctgaagctcgtctgccctttggaaaatctcgttggtgtcctagccctgggatcattgtacttaccaggttggggggctctgcacccagaactcctcccagcctctgtctgcccgtccaaggtccggcgtgacttccggtggctgatttctcatcttggggaaatccccgccctgggggggtccggtgtggcctgcagggagcctgactcacccgtcggctgagtcagggggtcccagctgccctcggatgtctgctgcaccgctcccctccctcaggcgggggacggcaggaaggagggagagatgggagggcgtgggggcggggccgggggcggtctccagcccccggcccgggctccgccctctcccgggatctgtgaaagcacagccagggtgcgggcgggtgagtgcccacctggtgcagggtgtgaagagcgagagcgcgtgtatgagcacgagcgtctgtggtctctgtgtgtccgtttacatgattgcgcctgtgtctgtgtgtgcgcatctgcatgcgtgtctttttgagtgaatgtctgtgtgtgacttctagggacggccagggaagaggagtgtcccctcccaccctggccccccgtcttctcatcctggactccctctcttctctctcctccttggggggtgctctgggcatccgggacccctggcaaggctgccgggtgctgggaggacgcagaggccgccgagggcggagggaagcgtcaggcctggctgcgcgcgccctggctagggagctccgagtcccggccgcctggtcctttcattctgggcttcttcgagattctcgagggcttccagccggcagtgttttctccttgccgtcttctcaggcacgaggaaggctcctggagctcatctgcctgggatgggcggccctgccttgacctcacgtgcagcaattaggaccaccaaggagtgttcttcaaaccaccttctaccaccccgcgggacacgccagggctgattctggtgctcgcaccccgcttcctcctctgcgttcccctgtggcaaaggtttgtcttgggctgtggacccgaaagaatattctaaggggagatgggctcttgcagagcaagaggggtatggtttcagcaccaaactaaactggtgccagcgctagctctgcccaagaggctgtgcagacagtgtttgtgtgagtacgtgagggtgagagtccctgcccgcctagcttcggcttccccacttacaaccaagggagaacaacatctatcttacagtgtagatgcctggataaaaactggagcgcctggccgagcactttgggaggctgacgcggtaggatggcttgagcccaggagttcgagaccagcgtaggcaacatagttagacccccgcctctacaaaaaattttaaaaaattagctgagtgaggtggtgcgcacttgaggtctcagctacacgggaggctggggtgagaggatcgattgagccagagaggtagaggctacagtgagctatgatcgcaccactgcaccccagccagggcaacagagcaagaccctgtctcaaaaacaaaaacactggagcgcccagagttttttttaagtgcgggacaaggattgtctcggtgttgttactgcacgcacaccgcccgttgtaatggatagatgcattagtgaaagtgctaggtacactcatttattttctaaatctcacatataagggaacccccgatggaaaggcccatcagctagggaacagccagcaggctggatttgagcccagagcccgggctggccaattactcgagtgagtctggctccggctctgtgacctgggtccagtaccccgccctttctgcggatgccttgcaaagcggggagcggaaagcagtttggtggacgaccagccctcccttgctttgcaggtggcgctttctatttattgattgtaaggtgaaacctaggccagagccagcgtgcgcgcgccgtcggggtcccgcggctgctctggggctcagggtgcgaaccccaagggccccgcctggcagcgtcctgggcctccgggcgagaacagcgggggtcggggaggatttgcagcgtccactcctctctccgccgcccgtgtgagctcgggcgcttctcccggctgggggtgtgagaatttgccgacggtgcccgcgccgccgccggccccggccccgccccagccccgaggacgccccgcccccagccggcgccccgccccgcctgccagtagtcccagccccgccccgggccgcgcccctccgccgagccccgcttgcctgcacctcgcgcggcgggcctgccctccggcccccgccggccccgcgccgctgcccggaggctggcgtcttcccgtcactccgggacccgcccgctgtgtcccctgggcaactgtctccagggagatcgggccccgcccccggcagcgacacccggtacggagcccacctgtgcgggcgtctgcggggtccccgtgccccgcccccagccccgccgggcgtcccaccccgcccagccccgggctttgtccgcctggggcggggtgggcagggtcggtggaggcgatcaggggtccggggccgtgggggcttggggggccgaggcagggggttgcgttcgcggtgggattctcagctatgggccgcgcgacgctctcctctcctaatctggttgcttccttttgtgccccccgggggtcaggaatcccaggtttctccgctgccgcccttgatgggatccgtgaggcctccagcgggcttcgcacgaggacgcgcctgttcggggcaggctgtttacttgtcggggacccagcagtggctgtgcgcgtcctcccctccccctgccccctattcgggacggagcctcctgcgctctgtccctcccgagctgtgcccttgagcccaagggggctagagggtggcagacccagatcctgaggtcctgcggcttcctccccgggggagcgccttctccctggccgccctcttgtggattttgtcctggctccttatttcctgacccgaattcctgaggatgaattctctccttctcttccttctcggctccctctgcttttggctttgtttttcctgttttgaaagggctttccttatgatcctgtctcatttccctgtgccagagctactataatttgtcgtggtaacgggtattggccagtcacttaattggtcagcaatggaagggatttcttccttagcctttggtgctgacctcctgtttctctggtggcagtgccttgcgaagtgcttgccactgtcccctggattttgagggaagggagcatccgagcccgcatgcctgggctcccgcagcagggtccccggagcatctttgcagggatagaggccgcagggaggactccagcttggtccttgggagatgtgttcctgcaacccatgccttttccagcgggttcctagggctctgctgtttgactcatggagaagccggtggttttggtgttgtgctaaatcgaagcccacctagtgggctctgggccgaaggctcccagctgtggaggtagctatgcccagggcctggggttgggagaaggggttgggtctttagactgggctggagctctagtgtcttttttccctctttggggttctgttatttcctggagcggctgaggtgggggaagaagcaccacagatgcaaggagtgggcggcccctcccctcacactcttcctttttatctccagcccaatagggcatgaattttcctttagacctgggccttgaaaacagatccacatggggaataaagatttcaagttcaccaacctgctttttgcatccatcgaatggaactcgaacccaggcttggctcagatcaattactttgctttcaaaaaaccaaacaaaaccaacaaacagctctaaaaacgatctgagtcatctgagtgcacattcctgctccaggcactggaaatgctcctgtggttggtttcagtaccaccaaagggagctgggggtggcattgacgcagatggcaagaaaggccgatcaagtggaatgtgattggtttgcaaaaaggagagacctagatgaagcagttgattttgagctaacgtcctgtaagagaatgcacaggtttctgaaattctctcttgttaaaatagttttctttctttctttctttcttttccccaacagataaggagtcaggccagggcgggatgacactcattgattctaaagcatctttaatctgccaggcggagggggctttgctggtctttcttggactattccagagaggtaggttgggggaacgggccaagtgtgtgggggaagggaaaggagatgttattttgtagataggttaagaatgtgaacaaacccatcctccccgactctccagccaaaggaagacttctctgtaggactagcacacccagaggaagagagtgacccaaattggtgctaggagcgaatgaatggggaagtgaactagacctcagccattcccaggagagagatgctgctgcctgggaaaagaaggaatggctttgctttgaggagtcctggagcccattactaagctgcagcatttggtatttgactcacactggccacggtagcgttggactcgcctgactggggagagaaatattaaaagttttctggaggaaatggattgaatttttataattcagtgttgcttctcaaggagtccctaggtggggccgttctgtgtcttcagagagctggcagtcactgtctcagtaagaggatgctcttcagagtttctaggacattagcttagaagatgaatgcagtcctttcatggtgcaaatgaggacactgaggccagagaccgacactggctggacgttggctaccacacccatctgggggcctggaatagctgggtctggcttgggagctccatgactgcgagacctgccggtccccttgcaagctctctgggtgcataacatattctgtgtgtacccagaattccactggagacgctactgtcatttcaggatggaaaggggcaggggttagagcgcggtggcgtccttaaaggctttttccccaacctcagcctcattttctctagatcttcattggtactttccaaacttgtttgatgattgcggatctctttttaaaaatcaaaatataggccgggtgccgtggctcatgcctgtaatcctagcactttgggaggccaaggtgggcgaatcacgaggtcaggagttcgagaccagcctggccaaccaacatggtgaaaccctgtctctactaaaaatacaaaaaattagctgggcgtagtggtgggcacctgtaatcccagctactcgagaggctgaggcaggagaatcacttgaacccaggaggcggaggttgcagtgagccgagatcacaccactgcactccagcctgggtgacagagtgagactccgtctcaaaaaaataaataaataaaataaatcaaaatataaagcagaattttaacctataaaccagatcaaaacagccactgtaagagaaactagcccagaactccttctgctcagcaccctgtcccactcccacctacctctgaaggcctggggtgcttctttggaaccccagcgctcccctgcacataagcaaaagccatagatcatgtagacccctgttggaggattagaatttcttccacacatctatttatactgacttgatctttgtctcagaaaatgccttttaataatatttttaatcctcatgcttttttatttataaaaataggaaattagtgtcaagtttggaaaataccaaaaacatacaagcatactcgtctatcatcttaccgccaccccaccccgcaccagagaaaaccactgtttcctcgttggagtatcctcccccaaacccctcagagagaattctgtctgtagcttttatttattatttatttatttacttaatttttttgagatggagtcttgctctgtcacccaggctggagtgcagtgatgcaatctcagctcactgccacctccgcctcccgggttcaagcgattcttctgcctcagcctcccaagtagctgggactacaggtgtgcgccaccatgcccagctaatttttgtggtttttttttttcagtagagacatggttttgccatgttggccaggctggtctcgaactcctgacctcaagggatccacctgcctcagcctcccaaagagctgggattacaggcgtcagcctccacgccctgacctgtgtctgcaccttttaaaacttgacttttatttattagtaagtattattatagactttgacataaacataacaatcgaacatatatgtatttctctgctctgtttcaaaatcccactaaaatgaaagtaaaggaataagaaaaaatgtaaattcttaaaaaaaaaaaactagaaaagtaaatggttgaggagggtggtatgaacaaaacctttgcaggacaggaaaccgataggcgagagggaagctgagtggagaatgtccaatgtcttgggccatgggggaggcaggtggaaaaggcaaaggaatgggggctctggggatggagtgcttcgaaaggtggtgtgtgcagggtgggctggaagcaggaagattacttgaaagagcatggtagggtgacagaccacccccccaggccacatagccagatggttcccttccccaccccagcaggtggcaggtttccggcaggcagtgttttcagagaggttggcccagcccagggcagcagaggcactgcatggagaacgaaagggtcaagcgagttagtttgccaagcagtgagaccatatcctgggtagctccccgaacaccgcagcttccatacagcctctgggcagacccttggaggacttctgtctgaccagactgatctcacgagaaaaataactgtcacatattgacattgagggggaccttgttgaaaagccagcttgttgctaggcacggtggctcccacctgtaatcccagtcctttgggaggccgaggcgggaggatcatcacttaaggccggagtttgagaccagcctggccaacatggcgaaaccccatctctactaaaaatacaaaaattatctgggtgtggtggcgcgtgcctgtaatcccagctacttaggaggctgaggtaggagaatcgcttgaacctgggaggtggaggttgcggtgagccaagatcacgccactgcacttcagcgtgagcgacagagtgagactccgtctcaaaaaataaaagtcagcttattgctttgtcatttcacactgaagcctaccgagcagctagccctacctgtgtacaagcagggttagtgcctttcccttagatttgaatgggcagccaagggccatcccacatggaatgagatttacaggctaaatgtggtggctcatgcctgtaatcccagcactttgggaggctgaggcaggaggatcgcttaagcccaggagttcgagaccatcctgggcaacgtagggaaatcctctctctacataaaataaaaaacaagccaggtattgtggcacatgcttgtgatcccagctacttgggaggctgaggtgggaggattgcttgagcctgagaggttgaggctgcagtgagccatgatcataccagtgcactccagcctgggtgacagagtgagaccctgtctcaaaaacaaaaaagagagagagagagagagacagagagagacttctagtgtgaaagacagagacccaaatgaacagaaaaaaaaatttgagaagtcacaaacagggtcgtatggggaaaaaaaggcacattcataaaataataagctgttaggtattaagatagcagaagtaaaaatagaagaagtaaaaatttcaacagaagagttggaagagtgaaaaacaaatttccagaaagtagaacacaaagacttaagagatggaaaataggaaagaaaatatagaaaaatttgacttcagtccaggagacccagcatgcaccacataggagctcaagaaaaaaaggcaagagaaacggaggaaggaaaagtatgtaggaaacaattctagaactgaaggcatttctacttttaaacagtctcgaagtagtacccaataccatgaataataaaaggcccacgctataggacatcatcatgaactttcaaactccagagatagagagaagttactaaatgtcatcagagaaaaaaaggccacatacagatcagagaatgagatggctttagacttttcaaaagcaacagtagaaactacaagacaggccaggcgcaatggctcacacctgtaatcccggcactttgggaggccgaggcgggcagatcactaggtcaggagttcaagaccagcctggccaacatggtgaaaccctgtctctactaaaaatacaaaaattagctgggcgtggtggcatgtgcctgtaatcccagctacttgggaggctgaggcaggagaatcgcttgaacccgggaggcggaggctgcagtgagccgagattgtgccactgcactctccagcctgggtgacagagcgagactcagtctcaaaaaaaaaaaaaagaaaagaaagaaagatactacaagaaaatggtcagtgcttttaaatttctgagaattaattaattctgagggaaattaattctgtaattgtcattcaaataaaaagtacattaaagacttttttttttttttgagataaggtgtttctctgttacccagattggagtgcagcagtgtgatcatggctcactgcagcctcgacctcctaggctcaagcaatcctcctgcctcagccccccgagtagctgggactacaggtgtacgccaccatgcccagctaatttttatcctttttgtagagatagggttttgccatgttgcccaggctggtctcaaatttctgggctcaagcaatccacccaccgtggcctcccaaagtgctaggattacaggtgtgagccatggcacttggcccacaaactcattttctaaggtaagaagttaaaatttgacagtggggtggctcgtgcctgtaatcccaacactttggagcccaaggcaggaggatcacttgagcccaggagttcaggaacagcctgggcaacatagtgagaccccatctctacaagaaataataataataaaatttaaaaatattaaaagaataaaattggctaggtatggtggcccacacctgtaatcctagcactttgggaagctgaagcaggagaattgcttgagcccaggagtttgaaagcagtctgggcaacatagtgagaccccatctctacaagaaataaaaagttagctggcgtggtagcatgtgcctgtagtcacagctactcgggaggctgaggcaggaggattgcctgagctagggaggttgaggatttcaccactgtactcagcctggatgagaccctgtcccaaaaaaaaaaaaagagagaagaaaaaaataagttgaaagttgaaaaccaagaaatattaccataaaactgttatttagaaatatcaaggtcaggcatggtggctcatgccttgtaatcacagcactttgggaagccaaggcaggaggatcgcctgagcccaggagtttgcatccagcctgggcaatgtactaagaccttgtctctacaaaaaatttgaaaattagccaagtgtggtggtgcatgcctgtagtcccagttactgaggaggcggagattgcagtgagctgtacttgtgacactgcactccagcctaggggacagagtaagatcctgtctcaaaaaaaaaaaaaaaaaaaaattgtaggctgagcacagtggctcatccctgtaatcctagcactttgggaggctaatgtggggggatcacttgagcccaggagttcaagactagcctgggcaacatagcaagaccctgtctctattttcataaaagattttttaaaaattttgcctgaggtataaaaacacacaaaaattttaaataaaaaatggaaatatagagataaatacttaagcaactgaaatttattgggtgtggtatatatgtggaagtggaggtcggaggactgctactttgtactgtaagagttttagttttaattaattttaaaaatcatggacttgtggccaggcacggtggctcatgcctgtaatcccaggactttgggaggccaacatggaaagattgcttgagccctggagtttgagaccagcctgggcaacatagtgagaacctatttcaagacaacaaaattgtatttcattattatttaaaaaaaaaaaaaagtttttttttaattagctgggtatgtggtgtgcacctgtagtcccagctactggggaggctgaggtgagaggatcacttgagctcaggagttcaaggctgcagtgagtcatgatcacgccattgcactgtagcacgggcaacaaagtgagaccctgtctctaaaacaaaaaaaaagtgctgagcgcggtggctcacacctgtaatcctggcactttgggagactgaggcgggtggagcacttgaagtcaggagttcaagatcagcctgagcaacatggcaaaactctgtctctattaaaaatgcaaaggagtatctgggtgtggtggcgtgcacctgtagtcccagctatttgggagctgtgatgagaggatggcttgagcctgggacgtggaggttgcagtgagccgagattgcaccactgcactccagcctgggaaacacagccagaccttgtctcaaaaaagaagaagaagaaaaaagaaagaaaaccacgtacttgtataactttcctagaaattaaaataataaagttattatgacatccatattcattcataacatttcattttttctatgctttttttttgagacggagtttcgctcttgttgcccaggctggtgtgcaatggcacgatctcggctcactgtaacctccgcctcccaggttcaagcaattctcctgcctcaccttcccaagtagctgggattataggcatgcgccaccacgcccaactaattttgtgtttttaatagagacggggtttcaccacgttggtcaggctggtctcgaactcccaacttcaggtgatccacctgcctcagcctcccaaagtgctgggattacaggcgtgagccaccatggctggcctttctatgctttctaaaatgctttatcaacaagcatatgtcacagtgataaatgtctgtgcacttaatgtgtggaatatttgcagtgttgtgtagtgtgcccaggtgtcattttgatgactgcattcagtttcattgagttaatgcatcatttagccatttccttatcactttcacaaacaataccacattgaatatctttgtgtatatagcttttttgacttttgaattgcttctttaggataattcccaaattcccaaagttaccaggtctgagaccatggatgtttctttctcttgattttgatgtgtagtatctgaggcctccacctgggtgcaggcctgtggcctccctggtgggccgtgacctaggatgatgatgagatggtggggatagcattttttttcagggtagttagcttttttctgatggcagcagtagaggtcagaaatctttgttgcggaggccaggtatggtggctcatgcttgtgatcccaacactttcagaggccgatgcaggaggattacttgagcccaggagtttgagaccagcctgggcaacatagggaggtcccgccccctacaaaataaataaataaataaacaaagctctgcacagtgatgcacagtgcagtgatttgtgtcatattcccagctacttgggaggctgaggcaggaggatctcttgagcttacgaggtcaaggctacagtgagctatgatgatgacactgtactccagccagggcgatagaatgagaccctctctgcgaaccgtgccaaaaaaagagtaggctgctgggatgagttcgggcatttcggggcatgtgagcccagcacttcccctcatcaacccagccctgccagctcttgctgtacatgtcctgcacacgtctcctcattgctttcctacttccattctggcctcgccccttccattttcccacagcagccaaagccatctttataaagcataaaatcaggccgcctcagtcctctgcttaaaaccctccagtgatttctccttgtaatgatactggactcctcaccatggctacggggccctgcagggtcagactcaccgtctctcccagtcaccctctcccagtcacgcccttgacttcaggcacctgcctcctgcctcagggcctttgtactttctttttttttttttgagatggagtttcactcttattgtccaggccgaagtgcaatggtgcaatcttggctcactgcaacctctgcctcccaggctcaaggattctcctgcctcagcctacttgggattataggtgtgtgccaccacgcctggctaatttttttgtattttttaaatagagacagggtttcaccgtgtgggccaggctggtcttgaactcttggcctcaagtgatttgcccgcctcggcctcccaaagtgctgggattacaggcgtgagccaccgcccccggcccaggcctttgcactttctgtccccactgcccggaaccctattttgtggatttttgctggatccttctctcacttgagcctcaacttcagaatgatctcacccgaggacccttccctgacccaccatccaaaggaaacgctgcctgcaagcccctttttattatattccagtgcttttactacctgaagcatcttgtttatctatttgttttctttttaactttgtatttaatttttaaatatttatttattgatttttgagacagagtctcactcttgcccaggctggaatgcagtggtgtgatctcggctcattgcagcctccccctcgcaggttcaagtgattctcgtggctcagcctcccaatagctgaggtcagatccctcagacgttcacagctgggacgccgttcttccaccttgggctccagaaagagcaccaaggagaacatttcaggacagactgtaagggtggcgtggtgtcctggccagaaccccatgtgcgggagggctccgctttgcacagctgtttctgtggatcatgctggccaggaggtgggaaggtgaaaggaattgtgttcttatcctgtttccttggatattttatgagtgacttagatgtggacacaactcatgcctcaggattctggatgagtaagtgaggagggattggtcaccgtccatcactgggtgacgcgaccccagctccccgctctgtgtctaggccgtctcacctgcccctccccggctccacatctgtctgtagcctgctgactccacagatctgtcccccgccctcccacctggggagtttgcccctggcggtctttacgtggctattcattaagcagctgagattcatttggtctaaaatggggctccggctgtcttatcccaccagaaatctcttcctttcctgtctcagtaaattcccaccaccactcccatctcccaagcccaaacctggctgtcatcctcacttcctcctgcaccgtcccccaagggtccctctgatttaagtatgtctggattccgttgctctccagtgctgtctccttctgggtcaagccactgtcattagtggcaccggcctccttcccctgccccctactccccttcctccctgcttctccgcagtccttccacaccgcagccagcagcatagttgtggatgaaaatcgcatccctcactccctcacctaaaatcctccagggctgtccatccgctcagcacaagccccaggtgccagcccttgttctgaaggctctgcaagacccagcccagttgaagtcttcaacttgctcatgccacaccctcccctccgtgcccaccaccccctgctccagctgtagtggcccgttctagaagacttgagtccctttcccacgagatcccctgcacctcgtgtaatttctggcacttaatcaggctccatagatactggtgggataaatgaatctacctcggactgaatgatggagacaaaacataaaatcaaagccgggcgcggtggctcacgcctgtaatcccagcactttgggaggccgaggcaggcagatcacctgaggtcaggggttcaggaccagcctggccaacatggcaaaaccctgtctctactaaaaatacaaaaaatcagccaggcacagtggcagacacctgtaattccacttacgaggctgaggcaggagaattgtttgaacctgggaggcggggattgcagtgagcggagattgtgccagtgcactccagcctgggcgacagagcaagactctgtctcaaaaaaaaaaaaaaaaaaaaatccaataagatatgagagccaattatgttcacaagatgaaactaccaaggataattgtgaattccttcatttagatcaggaaattcatgttcctgtacaggcagggagaacctggcttactgtgaaaaatccctggagggctggcagccaatgagttcatgatgtggccaccaaaaatctgccttggggtgagagtaggggagcatgaaatactctcaggctaagcaaataggagctcggtgcccagaacattcttctacagctcgacctgccaggccctgtctgtagcatcttgtttttgtttttttggtttttttttttttgagatggagtctcactctgttgcccaggctgaagtgcagtggtgcgatctcggctcactgcaacctctgccacctgggttcaagcgagtctcctgcctcagcctcccgagtagctgggattacaggcaagaaccaccacgcctggctaatttttgtatttttagtagagacggggtttcaccatgttggccaggctggactcgaactcctgacctcaggtgatctacctgccttggcctcccaaggtgctgccctggagcatcttgttagcttggagtaccaaactgtggcaaaagggtctaaaaactgtatcacagggagaacattgagtggttttgggaatgcctaggctgaagagagacgccttagggcctgatggggccgccatccagtggtcctgtggactcctctgtgtgcctctagatggcagcacagagatcggagtttgactcttagaggcaggtccacttccaaggaaagaactttcctttttttttttttttttttttttttttttttttttttgaggcagagttttgctcttgctgcccaggctggagtgcagtggcgccatctcggcccactgcaaactccgcctcctgggttcaagcgattctcctgcctcagcctcccgagtagctgggattataggcatgtgccaccatgcccggctaacttttgtatttttagtagagacggggtttcaccatgttggtcaggctggtttcgaactcctgacttcaagtgatccacctgcctcagcctcccaaagtgctgggattacaggcatgagccaccgtgcccggtcagggaaagaactttctaaacactagaagcttctaaaaatggaagtgcagctgcagtaatgaaaatagatgtttttagctgtaagcggccaaaaactcagctcaaactgctgtaagttaaaaaagaaaaaaggctgatgagactgaagagtccagggatagactgtagcttcaggcatggctggatccagggaatcaaagttcgtcctcaggacccaggcttgtactgtctgctttagccccactttcctctgtgttggtctcttctcaagttctgcccctaaagacagcaaacagttgctagcagctctaggtagacagtctgtcgtttctgctaccccaagaagaagtcccagagaagcctagatgtcaaaacccactggactgacttgatagtcatatggccatcctggaatcctatagtcagggagataacgtgtagtgataggctgcgcctaagtctcattcccacctccaagccaatccccatggcctgggcaaactcaggcccctgattggctgtgtctgagtctcaggctatccagggagctaggggtgaagtcagcttatccgaaccacttggactgagtgtgttgagtttttgaaaagtccccagctcccagattaaaaaaaaaaccaacaaaaacgtaaagttactagcacccagaagcctcccatgcgcccttctagtcactcccccaaacctggggtaacccctatttcttttgccaccatagatttattaattctgcctgtgtttgtttctttgtacagttggaatcatgaacacatattttttttgtgggcagctgcttttgcccagctttatgtgtgtgagagtcatcgatactgttgtgtggacttgtagactgctcattctcattgctatataacattctgctcagaaagagtatcacacattattttgccattccccattctgttgatgtgcatttgggaagtttccactttggagccatcatgaatagtgatgccatagacactcttgcccgtgtcttttgataaatatacatgtatttgcatttctctggggtgtgtactttggagcggaattgctgggtcctagggcataggcatgttcaactttagtagatattgtcaaacagttttccaaagcagttgtactggtttgcgttcttggggcatttctgaagtccctgtactcactggcatctctgtcctgtacatatcagagagctatggttctgggcttcattcagggaagagttagggctggttggccactgtgctagagagaggttcttagcccagagagacggaaggcacttccactttctcctgtcctgtctcactggtgacaggacctggcatttgatgtcctgtgcagaccagtctgatactttctgtattaggaatgaggttttctgtgaaagtatttccctacatcccatttaggtaaggtgtagttgaagacttcatttccagagtgctaaggggcaggagagtgaggggtgtattttcctggaacccaggctgtgggttggagtccctgggagctcatgcctcatgtgctcatcttgggcctcaccagactgagtggccaaagatacccctgactttcaaagcccatggtcaaagcccatttcatgtcataagtggattctccaggattcctgactctctcccaagttgtttttttgttttgctttgttttgttttgttttgtttttgagacagggtctcactctattgcccaggctggagtgcagtggcacaatctcagctaactgcaacctccacttccctggctcaagcaatcctccagcctcagcctcccaagtagccgggactacaggcgtgagccaccatgaccggctaatttttgtattttgtgtagagacagggttttaccatgtttcgcaggctggtcaccaatgcctgagctcaaagtgatccactggcctcagcctcccaaagtgctgggattacaggcgtgagccaccacgcccagccggtcccccaagttttgaaacaaaaggaagactttggcttggccattctcagcaagaggaacccaaagtaggatgtggttttgcaattggaggaagtggcgaccagcagtggcagtgcctagagatgtgcagctctcgctcctcagggcagctggggtccagctgacggtgaggcctgggcccagccggcgctgccacccaatcaacacctgccttcaaccaaatatttcttttcaactgtttttacaagtctttaaaatccaagagaatgtgatctttaagtagagaagtctttgcttaaagaataaaaatcataaatcataaaggcaaagattgataatttgaccgcatcaacattaaaaacttctactcaccaggctgggcatgatggctcatgcttgtaatcccagcactttgggatactgaggccagtggatcacttgagcccaggagtttgggaccagtctctactaaaaacatatatttttttaaagtctctattaaaaataccaaaaaaaaaaaaaaaaaaggaaaaaaaaaagggtgtagtggcatacgcctgtagtcccagctacctgggagcctgaggttgggaggatcacctgagcctgggaggttgaggctgcagtgagctgtgattgcgccactgcactccagcctggatgacagagtgagaccctgtctcctaaaacaaaacaaaacagcaacaacaaaaaaccttctactcaccaaaaagacaccataagcaaagcaaaaagatgactcagattagaaaatatttcccgctcattcaaccaacaaaggaatggaatctagaatatataaagaaatcctacaaagcattaaaaaagattaagtaaccccacaggaaaatgggcaaagtttatagtaagtaggctatttgtagaaaataaaggttttatggaaaatcagggaaatgcaaattaaaacgagataatttcattcacatcaaattggcaaaaatgagtaaatttgacaataccaagtgttgaccaatatctggagattgatctccataccacagttctgagattgctgacgggcaccaccgtcttgaggacagtgtggtgatatttagtaaagttaatggtgtggttataccgatcgtaggttatgccacatgtgtctcttgagcacttgaaatgtggacagtgtgaggaatggaattttaaaacatttaatttaatttaaaattgctgttgattcatttattggaattttttttttttttttttttttttggtagagacagagttttgccatgttgctcaggctggtctcaaactcaagcaatccacctgctttggcctcccaaagtgctgggattacaggcatgagccactgcgaccagccttaagtgtgtttagaacaaactgggtctggctaggagctcacacctgtaatgccagcacttagagaggccgaggtgggaggatcacttgagcccaggagttcgagaccaacctgggcaacatagcaagaccctgtacctcaaaaaaaaaaaaaaaagttagcagggcatggtggcacaagcctgtagtctcagccactcaggaggctgaggctggaggatcgcttgagcccaggagttggagggtgcagtgagctatgattgtgccactgtactccagcctgggcaacagagtaagaccctatctcaacagaaaaaaacaacaaaaacctgggtctgtgaacctacttttcacctgtagattggataaaatctacattcagatcaagtatttctgatgataatctagaaatgaaattgcagtacacactaaatgtaaaacacacaccagatttcaaagattcgataccaaaataaatgtcaaaatatctcattagtaattttctctattgattatgtgttaaaatgactatcttgtggctatattgggttaaataaaatacataatgaaacttcattttatctgtgccttttcactgtttttggctttttttgatttcttttttttttacttttttcttttttttttgagacatgattttgctgtattgccaagctggtgtgtagtgatccatcatagcatctcaaactcccaggctcaagtgatccttccacctcagcttccaagtagctgcgactacaggcacgctccaccatgcttggctaatttttaatttttttttttttttgtagagatgggctctcactatgttgcccaggctggtctctaactcctggcctcaagtgatcctcctaccttggcctcctaaagcactgggattacaggcatgagccaccatgagcccagccttttcacactttttaaagtggcttctggtaacctggacgttacctatgtggttcccgttgcctttctcttgggcaacactcagcactctccgatgagcacaaggggatggattcaagaacatacattgtagcatcattaaaagtaactaagaaaagtagaaaccagccttcatcttcatcaacaagagagagggtaaattgtggtttctttttttttttttttccttgagtgttacatttttcttttttttaatttaacttttattttaagttcaggggtacgttgcaggtttgttatataggtaaacttgtgtcgtgggggtttgtcatacagattatgtcgtcacccaggtattaagcctagtacccatgagttattcttcctcatcctctcccgactcccaccctccaccctcaggcccccgtgtgtgctgttcccctctgtgtgtccatgtgttcttatttagctcccacttataggtgagaacatatggtgtttggttttcttttcctacattagtttgctgaggataatggcctccagctccatccatgttcttgcaaaggacatgatctcttctaattgtggcttctttacacaatgaaatattgtgcaagagataaaacgaatgaactaaagccatgtgtgtattcgcctgggtaaattttttttttttataattttgtttttttttttgagatggagtctcagtctgtcgcccaggctagagtacagtggcgcgatctcggctcactgcaagctctgcctcctgggttcatgccattctcctgcctcagcctcccaagtagctgggactatgggtgcccgccaccacgcccagctaatttttttgtatttttagtagagaaggggtttcactgtgttagccaggatggtctcgatctcctgacctcgtgatccactcgcctcggcctcccaaagtgctgagattacaggcgtgagccaccgcgcctggtcccgcctgggtaaatctaaagaacagcacaatgagtgaccaaagcaggtcgcagaagactccgtgtgtacatacaggctttttgtttgtttgtttgtttgtttgtttgtttgagacagtctcactctgtcatccaggctggagtgcagtggcgcaatctgctcactgcaacctctgcctcctgggttcaagcgattctcatgcctcagcctcccgagtagctggaattacaggcatgaatcaccacacccagctaatttttgtatttttagtggagacaggattttgccatgttggccaggctggtctcgaactcctggcctcaagtcatctgcctgtgtcgcctcccaaagtgctgggactgcaggtgtaagccaccatgcctgaccatgcgcagatttaaagcacgcactagtaccaggaattggatgtggatacatgttggtataataaaaatataaaaacatgcatggacgtcgggcccagtggctcattcctgtcatcccagcactttgggagcccaaggcaggtggatcacttgaggtcaggagttcgagaccaacctggccaacatggtgaaacccccatctctactaaaaatacaaaaattagttggacgtggtggcaggcgcctgtaatcccagctactcgggaggctgaggcaggagaatcgcttgagcccaagagctgagattgcaccactgcactccagcctgggctacagagtaagactctgtttcaaaaaaataaaacaaaacaaaaaacatgtatggaaatgataaacaaccagactccaggtactgctaacctgtagtggagtaggctagaggcggggaagggagaaggggacctggaagagggggaacaccaggtcctttgtgtttgtaacattttgttactaggggtgggtatgactggagggtttggtatgattcaaattttttcttttttttttgagacggagtttcgctcttgttacccaggctggagtgcagtggtgcgatctcggctcactgcaacctccaactcctgggttcaagcgattctcctgtgtcagcctcctgggtagctgggattacaggcatgtgccaccatgcccggctaatttttatatttttagtagagacagggtttcatctagctcagttcatcatattggtcaggctggtcttgaactcctaacctcaggtgatctgcctgcctgggcctcccaaagtgctgggattacagatgtgagccactgcacccggcctgactggaatattttaacaaattattggatgaccaaagccatttttaagccttttggtttctagtcagaaagtttcagagaggctggatatggtggctcatgtctgtaatcccagcactttgggaggccagagtgagaagatcccttgaacccaggaggtcaagaccagcctgggcaatatagtgagactgtctctacaaaaaattaaaaaattagccaggtgtagtggtgtgcacctgtaggcccagctacttgggagggtgagatgggaacatcgcttgaacctaggaatttgtgttacagtgagctatgatggcaccactgtactccagctggggcaacagagtgagaccctgtttcaaaaaaaaaaatctatttcacagctgggtatggtggctcatgcctgtgatcccagaactttgggaggccgaggtgggcggatcacttgaagttaggagttcaagaccagtctggccaacatggtgaaaccctctctctacaaaagtacaaaaattagccagatgtggtaacgcatgcctgtaattccagctatttgggaggctgaggcaggagaatctcttgaacccaagaggcggagattgcagtgagccgaggtggtgccactgcactccagcctgggtgacagagcaagactccggctcaaaaaaaaaaaaagaatgtatttcaaagaactgcagccttcggcctctcaggtctcagggcacctgaccagctgtcctgccatctcccttctgtgccagctggtggccatgactggctttcgtggatgtgtatgttcctgaggaaagatgatttgctgtgcgtgctcctgtggggaggacatgcagtgtctgcctgggagaagaggcagctgaggccgtggcccggagtagtaggagccacaagccaccctgggcaggacgaggccctgagggaggtgagctttttgtacccgcaggtcgggaactcactcctgagcttcctgctgtccaaggaccccactgttttccagggagtcccttccaaaggtctcacccagctcagctgaggtaactcattttgccatttcttcatttttaggacaactgtcatctgggaagtaacaacgcaggatgccccctggggtggactgccccatggaattctggaccaaggaggagaatcagagcgttgtggttgacttcctgctgcccacaggggtctacctgaacttccctgtgtcccgcaatgccaacctcagcaccatcaagcaggtatggcctccatccggtcctcagaccttggtgctcagagagagagagagagagagagacacagatagacagacagacagacagacagatggacaggtggacagacggacagacagatggacagatgcactgcttttcagacttgggatcctcagatgagaattttaaaagataaataatggtttgtttgtttgtttgtttgttttgagacggagtttcgctcttattgcccaggctggtgtgcaatggcgcaatctcggctcactgcaacctccaactcccgggttcaagagattcttccgcctcagcctcctgagtagctgggattacaggcatgcaccatcacgcccaactaattttgtatttttagtagagacggggtttctccatgttggtcaggctggtctcaaactcccgacctcaggtgatccacctgcctcggcctcccaaagtgctgagattccaggcgtgagccactgcatccagccgataatggtttttttggtttttgttttttgagacaatctcgctctgtcacctaggctggagtgcagtggcatgatctcaggtgactacaacctctgcctcccaggctcaagcagttctcgtgcctcagcctcctgagtagctgggactataggcgtgcaccaccacacctggctaatttttgtgttttttagtagagatggggttatgccatgttggcctggctggtcttgaactcctgagctcaagtgatccacccgcttcggcctcttaaagtgttggaattacaggtgtgagtcaccgcgcccgacccaaaagataaatcacgtccatgagttgttgaaagacttgtggttgcgtccaattattccaatttcagctttccccatttcacagtgtatgtttccctctactcagttatccaattattcatgactagatgagattaggggctgcctcccacggtgggctttcatcctattcatgactgtgtcatcatttttttttttgagatggggtctcactctgttgcccagcctggagtgcagtagtgcgatcacagctcactgcagcctcaatctccccaggcttaggtgagcctcttacctcagcctcctgagtagctgggactacaggcacgtgccatcaagcccaactaatttttcgtgtctgtattttttgtggagatggggtttcaccatgttgcccaggctagaatgtgcctttcatttttgaaaccacactccatccatggctgcctaagtggtttacaggtcttttgtctttaaagctgttgccatagtaaacaacatctctttttctttttttttttgagatggagtcccgctctgtcgcccaggctggagtgcagtggcgccatctcggctcgctgcaagctccacctcccaggttcacaccattctcctgcctcagcctcccgagtagctgggactacaggcgcccaccaccacgcccggctaattttttgtaaacagcatctttggaaagagattttggtttgttgaataatattcaggatggactactgagtcaaaggattaaatatgtagacaatatttggtggatattgtcttgtgaccttctaaagggcttgtgccccttactaagcatgggacttgagggatcatgccttgggctgtgggagggcaggaccttatcccagaattttattttatttttatttatttttattttttgagacagggttcactctgttgcccaagctggagtgcagtggtgtgatcttggctcactgcaacctccgcctcccaggttcaagcaattctcctgcctcatcttcccaagtagctgggactacaggcacgtgccaccacgcccggctaatttttgtatttttagtagagacggggtttcaccatgttggccaggctggtctcgaactcctgacctcaagtgatctgcccaccttggcctcccttagtgctgggattacagccgtgagccatggcacccggcccttatcccagaattttaaaagctataattgggagcagggaaaaaatacgaaagaagtaatggatcatctttgagagttttttcttcttctcttcctggaagatgtctttaaaaattaagtttctttttccttccattggaagagtaatatggacacattacaatttaggaaaaggcctggcatggtggctcatgcctataatcccagaactttgggaggctgaggcaggagaattgcttgagcccaggagttcgagaccagcctgggtaacatgacaaaaccctgtctctacagaaaatgaaaaataaaaaaattagccagggccaagcatggtggctcacgtctcttatcagcactttgggaggcggaagcgggtaggtcacctgaggtcaggagtttgagaccagcctggccaacaaggtgaatccccatctctactgaaaatacaaaaaattagccaggtgtggtggtagatgcctgtaatcccagctactcgggaggctgaggccgaagaattgcttgaacctgggaggtggaggttgcagtgaactgagatgtgggccattgcattccagcctgggcgacaagagcgaaactctgtctcaaaaaaaaatcagcctgtgtggtggcatgtgcctgtgatcctagctactcaggaagctgaggcaggaggatcacttgagcctgggagtttgaggctgcagtgagccatgatttgccactgcactccagcctgggtgacagagtgaaaccccgtctgtaaaataaacaagcaaacaaacagacaaaaacaaacacaaaaaataaatgtaggaaaagtagaaaaaggaaaaaaattacctctgatccagccatatgagaaaaccacagtgaatactttggctattgcctgttttctcctctatgtacagtgttttttttgtaataattctgattatgacctttcatatctttttttctgagttaacggtataacattttattcatgttattaactttatatagataccattgtattttattttgcttgagaatggtctcactttgttgcacaggctggaatgcagtggcataatcctagctctctgcagccttgacatcctgggcccaagcgatcttcccatcttagcctactgagtagctgggactacaggcatgcaccaccatgcctggctaattttattttttattattattattattatttttgtaacggtggaccttgccatgttgcccaagctatagatagcattttagttttttatttttatactttttttttttttttttgagacagggtcttgctctgtcatccaggctgtagtgcagtggcatgatcacagctcatggcagcctcaacctcctgggctcaaatgattcccccatctcagcctcctgagtagctgggactacaggtgcatgccaccataaccaactaattttttattttttgtagagatggagtcttattatgttgcccaggctggccgtgaactcctgtgctcaagtgatcctcccacctcagcctcccaaagtattgggattacaggagtaagccaccgcacctgacctagatgtcattttaaatcagtcttatttttccatttacagagctgtgcatgtgggttattaaaattcaaacagtgcagaggcaaagcatacacatctcgatttggtcccaattcttcatatttgtatttatcccaggggccagatagtaaatattttagcagttgctggctggctctgttatctgttgcgatgattcagtcccgccaccataggacaggagcagccctgagtgatatgtaaatgaagaggcgtggctttttggggttaaccaggtggcaggtggatttagccaggaaaagggtggtttgctcacccctggtctatgttaattgatatgtttattaggggtttttttgtttgttttttaatggaaatgggcttgacccacacctgctgctctgtatcttggggttttcccctcacttaatgacacaccttggacccctccaggccgggcacatagagctgcttgacagtccctagactgtcacagcttggcgccatcccactgcttgacagaccatagttagccgttgccctttgtagcaacactgggaactttcctcctttcccgtcttctttgtgactcagtggtgaacacctttcaactgcttgttgctgtgggagggctggaggcccgtcaccccagggcacacactccatggagaattctctttgggcccccttgctgtgttaaatatttctgagttcgttgccaacatttaaaaatcagggttgccaggcgcagtggctcacacctgtaatcccagcactttgggaggccgaggtgggtggatcacctgaggtcaggagtttgagaccagcttggccaatgtagcgaaaccccatctctactaaaaaaaaatacaaaaaatttagccaggcatggtggtgcatgcctataatcccagctactcgggaggctgaggcaagagaatcacttgaacctgggaagcagaggttgcagtgagccaggattgcgccactgcactccaacctgggcgacagagtgggactccatctcaaaaataaaataaataggtgaagaactccaggacagttagctgggctgcatgaaggtcatggccccccgtctctggagtgacctagggtggtcctgcactctgggaggggagcctgtaggacgtggtgccagccccagatcccagcacctcccaggtgcccccacagaagggcatcagtggagaagcctgtccacccatggtcagcacccagggggctgcagagagtgcagatcttggggtctgcctctgccctctgggaggtttggacccccaggctggaggccagctctccaccctccctcagcctcccacctcccagtggctgccttgggtggaggggctgaccggtgactgtccctccagctgctgtggcaccgcgcccagtatgagccgctcttccacatgctcagtggccccgaggcctatgtgttcacctgcatcaaccagacagcggagcagcaagagctggaggacgagcaacggcgtctgtgtgacgtgcagcccttcctgcccgtcctgcgcctggtggcccgtgagggcgaccgcgtgaagaagctcatcaactcacagatcagcctcctcatcggcaaaggtagctctgccgagtgggccgtgtggccgggctggccctgcctgccccacccgctgacccagccctccccaccccgcaggcctccacgagtttgactccttgtgcgacccagaagtgaacgactttcgcgccaagatgtgccaattctgcgaggaggcggccgcccgccggcagcagctgggctgggaggcctggctgcagtacagtttccccctgcagctggagccctcggctcaaacctgggggcctggtaccctgcggctcccgaaccgggcccttctggtcaacgttaagtttgagggcagcgaggtgagcccatgcgtggcctgcggcatccaggctgctctgtccatggggagcacttcctctgtgaaactcctcagtcatccgcaagcccccctcccccagtggcatcagatggtgtttgccaggtgtctgtgcatgtgtggggctcaactgaacgtccccccaggcaagctcaacgtggcaggataaccaagtggcgtggggcattgggcatcagtttgttcattctttgaacaaatatttcccagtgtcatttgtgaactccccagaccctacccttgggggcaaataggcaaccctgccctgtgccccagaaccccggggggcctcgagggcagaggactgacctccctcctccccacaggagagcttcaccttccaggtgtccaccaaggacgtgccgctggcgctgatggcctgtgccctgcggaagaaggccacagtgttccggcagccgctggtggagcagccggaagactacacgctgcaggtgaacggcaggcatgagtacctgtatggcagctacccgctctgccagttccaggtgaggccgctgaggccctctgcactctgggctcccaacgccctggatagggcctgggtgggagtcggggagctgacatttgggcgcaccttgagcctgccgagccaggcctttgggtcaccgccagagcatcccctggtagggctggccctctctgagagcacaaggaggggctccgtcttgggaggtggaggtggggcaggaaaaaccagcaggaagccctcccctctcccaaggcctaggacaggcagtgggcagcttggggggtcctgggaatcctggtgtccagggagtggttggggccgccccaccagccgctcaccctgcaccccgtctcagtacatctgcagctgcctgcacagtgggttgacccctcacctgaccatggtccattcctcctccatcctcgccatgcgggatgagcagagcaaccctgccccccaggtccagaaaccgcgtgccaaaccacctcccattcctgcgaagaaggtgagatggcgccttccgcctcccctctgagccaccccttctttccacctggcgtccaactccatgtgctactggccatgggtccaggggcccttggtatggagagctggggctttgagctggggaagccaacacagctgaccagcgtcctgggctgggggcctgtgggactgccgtgggtggggggcagccccatgcctggctcaccggctgcccttcccctctgcagagctcaggggtgttggggccccctggggagcccgcatggcaggttttctgggaaaggatagcattgtggacaggcccaaacctggccgcaaacctgtgaccctctcacccgcccccaagtggtcacgggcctcaccataggccagggagacaagctgcactttgagccgtgttaacagccctgcttccccggcccccagccttcctctgtgtccctgtggtccctggagcagccgttccgcatcgagctcatccagggcagcaaagtgaacgccgacgagcggatgaaggtggggctcctgggataggtgggagagacactgtttttttgcacaaacaaggtggctgtatcctggaggggtagcagaggaaggagggggatcacatgaaagccacctgaccacattacccagcatccctgcctggggcgctgtgagcggcttgaaaacaggaagtggggagggggtgggccagccggccctggaggctgattcgtagaaacttgggccaagcagcgttctgggtatttgactttggtggaggttatggggccaggttcagcccagggatccgggaccgcagagctgggggaagggccgggcatggaagaggggctgggtccagctgggctgggggctgtggtgctccctggaggcaccagggcggtgcctgcagcctgtgagggctgcacctgcctcaacctctaggggctgagcccacctccctgttgtctcttaacactttcacacgctccatcgcaacagcctgcagtcatgggctttattgtcctgtttgctggacatgatacctgagtcctcagaggttggccctcctgcctggagtgtgtttcactggggaaatcgtataagcagggcaggtctgggttccactggcaggaatcgagggggactggatcagagggacttccagggtggtggtgtcaggtggaattggaaggggccggacatcaggtggcaggaaaagtccttccccacccacatgggctcataggaatctgagaagtccagggagccctaggatgttagagcaagggtccctgaagttcttgatccctgatggggaaactgaggcctggagtggggaatggacatgccccgaggtccccagagttggggtagctgagacagggcacccatgcacagcccgtggtaccctccctcaccccagggccgctcatgcccctcaggccttccctgtgctgcaccaccttccttcgtgtgggaagtagagttcagacccacctgaggacattcaagggggagactgacaccttaagggggaggggagaggggctgggcctctgcctcctcacccatcatcccggcaccttctacagctggtggtgcaggccgggcttttccacggcaacgagatgctgtgcaagacggtgtccagctcggaggtgagcgtgtgctcggagcccgtgtggaagcagcggctggagttcgacatcaacatctgcgacctgccccgcatggcccgtctctgctttgcgctgtacgccgtgatcgagaaagccaagaaggctcgctccaccaagaagaagtccaagaaggcggtgggtcccagggccggctgggaggggtgcagaccccggagagccagtacagccccttgctgggccactcaccactctcctcccggcaagcacgcagcctggggatgggggtcctgggattgcttgtggaccccagcctcctcacccaccctagtctggccaccagccctgctcgagggacactctgggctcctgggctcctgtgcatgcggcctcagaatatctggcctgggctgtggtcctgcaggaacctgcaggtagtgccctgggatggaaggacaagcacagtgtcatccctggagcagaaaagcctgagtcagcggctggccgggaggcgtagtggctgggtgctgagtcacggtcccaggatatggctcccctcggagctgactcactccgagctgagctgggctggcctctggggctgggctgtctgtttggggatttctcaagaagccaggagggccaggcgtggtggctcatgcctgtaatcccagcactttgggaggccaaggtggtcggcttacaaggtcaggagtttgagaccagcctggccaatatggtgaaaccctgtctctactgaaaatacaaaaaaattagccgggcgtggaggcacatgcctgtaatctcagctacttgggaggctgaggcaggataattgcttgaaccaaggaggcagaggttgcaatgagccgagatcgtgccactgcactccagcctgggtgacagagcaagactccgtctcaaaaaaaaaaaaaagcctgagtaggggtgaggtgggaacaggagggtgcagcaggtgtcagctggcttcaccactggagccctcagaggaaagaggaaaaagcggctcctctccttccccaagcagggtctcccaggggtctggttgggagatgttagctgggctctgggtcttctcgggtggggtgcctgggggagggcagggaagctgggtctggaggcccctgagtggctgtcctcacctgccctgtccttctgcaggactgccccattgcctgggccaacctcatgctgtttgactacaaggaccagcttaagaccggggaacgctgcctctacatgtggccctccgtcccaggtcggcccaggcccaggagggagaggcgttgggagtgtgagggtcccagagatgctggtcacccctctacaacttcatctgcccctgtgttcagatgagaagggcgagctgctgaaccccacgggcactgtgcgcagtaaccccaacacggatagcgccgctgccctgctcatctgcctgcccgaggtggccccgcaccccgtgtactaccccgccctggagaaggtcagtgggggccccgccgcgtgaggctgaggggctggcgcggagctctcctggccctgctcctggagctcttcagagggtgctccctggccacgtcggggctgggctaccaggcatatctggggccttcccaggggccattttgcctgcagggatgctgcgcagtctgatgacattttcggttgtcacagctgccaggagggatgctcttggcatctcgtgagtggaggccagagctgctgtggatgcgcctccatgcagaggacagcgccccctcaaggatgattggggtggcaatgcccggcctgggggtcctgcccgggctggtccaggcccctggggacgctgagtgcagccgtttgttgcagatcttggagctggggcgacacagcgagtgtgtgcatgtcaccgaggaggaggtgagtggggtgggggtgtggggtggggggcatggagccggcgtggaaccagagccctcactcctgcccacacccctcagcagctgcagctgcgggaaatcctggagcggcgggggtctggggagctgtatgagcacgagaaggacctggtgtggaagctgcggcatgaagtccaggagcacttcccggaggcgctagcccggctgctgctggtcaccaagtggaacaagcatgaggatgtggcccaggtgggtggggaggcgcacctgggggcggagctgggggcagaccacagcctctggctacccaccaccctgaccccggccaacccccaccctcaccctggccaaccttcaccctgaccctggccacccaccaccctgaccctggctggccatcacccttaccctgaccacctccaccctgaccccggccgcccccaagcctgacctcggctccccccagatgctctacctgctgtgctcctggccggagctgcccgtcctgagcgccctggagctgctagacttcagcttccccgattgccacgtaggctccttcgccatcaagtcgctgcggaaactgacgtgagtcccagctgggcgctccccacttctccagagggcagctgtgtcctggctgccaggacgtgggctctgggtggggcctgaaccttcccgtgggcttgctccctcctgcctggcctccctctggctgccgagggagctccctcctgtcctgagtcggggagctccaggccccagcgccttccttccctgcagggacgatgagctgttccagtacctgctgcagctggtgcaggtgctcaagtacgagtcctacctggactgcgagctgaccaaattcctgctggaccgggccctggccaaccgcaagatcggccacttccttttctggcacctccggtagcgggacttgccccagccgttctgtgggaatcccagcccctgagtctccctggaaggccactggggacgtttccagcaggcctgggtgtcctggcctcgctaggtcctgctgggcgggaggggctgcgtggtgctgcctggtgaggctcagccctcccttcaccttccagctccgagatgcacgtgccgtcggtggccctgcgcttcggcctcatcctggaggcctactgcaggggcagcacccaccacatgaaggtgctgatgaagcaggtgaggcccaaggccctggggggcgggcagggggcggccctgagcgtctgggaatccccagggctgggtcgaggctgggacctgcccaccgccgccctcccatctgcccaccagggggaagcactgagcaaactgaaggccctgaatgacttcgtcaagctgagctctcagaagacccccaagccccagaccaaggagctgatgcacttgtgcatgcggcaggaggcctacctagaggccctctcccacctgcagtccccactcgaccccagcaccctgctggctgaagtctggtgagcccaagccccgccacaagggttcctcccacccctgggaggccggtagaggagcccctgctgactgcccgctctctggcctggcagcgtggagcagtgcaccttcatggactccaagatgaagcccctgtggatcatgtacagcaacgaggaggcaggcagcggcggcagcgtgggcatcatctttaagaacggggatggtgagggcctggcctccccacaccccgcctgtactgccctggggggtcctggggtgctcctagagtgggggtggagaagacagaatcctgggacttaagggcttgggtgtagctggaagcagagaacctaccagaaactcacgcttctcctcccaccggccggtggcacagacctccggcaggacatgctgaccctgcagatgatccagctcatggacgtcctgtggaagcaggaggggctggacctgaggtgaggacccccaccccacatcgtcccttggtgtctgtgcccagcctgggagtctgtgcccctggaggggtccttgttgaaggtggcatgaccatctcagccggggaaagggctttcctaggaagacccggaggcggtttaactctaggccaggaggcggcgggcagcaggatgcgtgaaggctgctcctgaggcttagtgtgtaccctgctctgttgctttagttgcccaggtgcccctggcttccccagcccatcttgggaagcagtggcgtcttctcccaaggcctctgtctggttctcttccaagcaaatgtgaactcagctgtggtgctttctgcacctcagatgctggtgccggcatctccaaggagccagcatctctcacctgctttttagcaatgtgggcagcagcatcttctgtggctttttggggcaccatgagtttctggggctcaagtggcctcagggacagcccttgaccatgccatttgcccgtccctcttcccccttgcctaggatgaccccctatggctgcctccccaccggggaccgcacaggcctcattgaggtggtactccgttcagacaccatcgccaacatccaactcaacaagagcaacatggcagccacagccgccttcaacaaggatgccctgctcaactggctgaagtccaagaacccggggtgggtttcaggcccagggataggttccctctcctttccaagaggtgtggagtgggagggcctcgcctgtcagaacaaaggagcggggaggggcctcagaccatctttgtggctacttggctcagttgaggaccagcctgtgtctgggttggggtgaggtaggtctctcttccccaagtatcagtgtctcttgctatgcaacaccatccaaagcgcagggctttaaaaaacagccatttacgattggctcacagatctgcagctggggctgggctcagccgggtggcttttctgctggttccacataatcactcatgcagctgttctcatctggtgccttaactgggccagtggggtctgagataacccatctcattcctggggccttggcgccagctgtctgtgatgcctctctgcatgtggtctcctcatttagcagcctcaccttccttccgtggctctgtattgagggtatggggttcaagatctgcaggggtcttcatgccttggctctggaatagcgtctgcaagcgatgtccagcattgtgtcctccatgttctgttggtcaaagcaagtcacagggccagattcaaggggagagggagtaataacccacctcttgataggcggagctgcaaaatggtatggccatgctttttaatcttccccacccagggaggccctggatcgagccattgaggagttcaccctctcctgtgctggctattgtgtggccacatatgtgctgggcattggcgatcggcacagcgacaacatcatgatccgagagagtgggcaggtacaggggctggtgctggcggctgctgtggggacttggcttctggccccagcctgctggcccctctgcctagcacacagctctgtggcaggggtcccccagccctgctggcttcctgtctcccctggattctctcctgtctgacaccttctcaatcctccccctcctctcccctcccctcagctgttccacattgattttggccactttctggggaatttcaagaccaagtttggaatcaaccgcgagcgtgtcccattcatcctcacctacgactttgtccatgtgattcagcaggggaagactaataatagtgagaaatttgaacggtgagagtgcctgagccccaccagatgcccctcggtgtggggccccagggaacagggcagaggttcccaggcagggtgcaggatggggctcaggtctcaaccccacacctggcccctcaccccaactgttgatgggtttggaacatgcccctgctccaccctgcagtgccccttttgggcaatgtgggcaggtttgtgggtcatgtagcaggaggctggctggggcacgggggtcagttagcagaactggaggccttgtgtccacccattatcagggcaagggcaggtgtccttggggaaggggctggttggatgcagagcggccctctggcctgtggctgggagttcccagagcctcacttcctctgtcccctacctgcaggttccggggctactgtgaaagggcctacaccatcctgcggcgccacgggcttctcttcctccacctctttgccctgatgcgggcggcaggcctgcctgagctcagctgctccaaagacatccagtatctcaaggtatgtgccgggcaggagactgctgtcgccagtggacttccaaggcctgcccccgagcaatgtgacctaggagggccctgaatgcagtaggccccaaagggcactgagctgtgtgtgcctcatgccgtcccaggacccagcagtggagctggtgggcggtggaggggaaagtggctggaccagagttgagccgcccaggcatggttccactcagtggcagatgtgtagtgacctctcctggttggggtgctgtgctcagggctgcggggctttcaggtgtccactagggggccgcgtgagcgctggctccctctgccttctaaaagatattttttggccaggctgggtggctcacgcctgtaatctcagcactttgggaggccgaggtgggcggatcacctgaggtcgggagttcaacaccagcctgaccaacatggagaaaccccgtctctactaaaaatacaaaattagctgggcatggtggtgcattcctgtaatcccagctactttcgggaggctgaggcaggagaatcgtttgaacccaggaggcggaggttgcagtgagccgagattgtgccattgcactccagcctgggcagcaggagcaaaactcggtctcaaaaaaaataaaaataaataataaaaaaagatatttttccaggccgggtgcggtggctcacgcctgtaatcccagcactttggggggctgaggtgggcagatcacgaggtcaggagttcgagatcagcctgaccaacatggtgaaaccctgtctctactaaaaatacaaaaattagtcaggtgtggtggcacgcacctgtaatcccagctactcaggagactcaggcagaagaatcacttgaacctgggaggcagaagttgcagtgagccgagatcatgccactgcactctagcctgggcaacaaaggcaaaactccgtctcaaaaaataataataaaataaaaataaacataaataaaagatatttttccaggctgggcatggtggctcatgcctccgtaatcccagcactttgggaggctgaggcaggtggatcacctgaggtcaggagtttgagaccagcctggccaacatggtgaaaccacatctctacttaaaatacaaaaaatcagccaggcatggtggcacatgcctgtaatcccagctactcatgaggctgaggcagaagaatcacttgaacacgagagactgaggctgcagtaagcctagatcgcgccactgcactccagctcgggtgacagagcaagactctgtctcaaaaagaaaaaattggccgggcacgatggctcaggcctgtaaacccagcactttgggaggccaaggcgggtgaatcatgaggtcaggagatcgagaccatcctggctaacacggtgaaaccccgtctctactaaaaaatacaaaaaattagccaggtgtggtggcggctgcctgtagtcccagctacttgggaggctgaggcagaagaatcacttgaacctgggaggcggaggttgcagtgagccgagatcatgcccctgcactccagcctgggcgacagagtgagactgtctcaaaaaaatgtatatatacagatacatatgtattttttttccttcttgtgtcctctccatgtgagaaggtgggatggggcggtgaggctgctggggccacacatgcttgccaggaccttccctctggtgaccagtccctgcaaaagcagctgctcccatgctcctcccagagccatttctccagtaggggaggcgaggtcacttgggaactgggggctctggggccaagatgtctttggcaccttcatttgagggtgggagcggaatagagagcttttcctgagatgctgggagctctctactaaccatttcattcagtgactctgaagtccccagagagggacgcatcccagagcaaggtccgggcccccttaacgtggacaccgctgtgatttgtttgcaggactccctggcactggggaaaacagaggaggaggcactgaagcacttccgagtgaagtttaacgaagccctccgtgagagctggaaaaccaaagtgaactggctggcccacaacgtgtccaaagacaacaggcagtagtggctcctcccagccctgggcccaagaggaggcggctgcgggtcgtggggaccaagcacattggtcctaaaggggctgaagagcctgaactgcacctaacgggaaagaaccgacatggctgccttttgtttacactggttatttatttatgacttgaaatagtttaaggagctaaacagccataaacggaaacgcctccttcatgcagcggcggtgctgggccccccgaggctgcacctggctctcggctgaggattgtcaccccaagtcttccagctggtggatctgggcccagcaaagactgttctcctcccgagggaaccttcttcccaggcctcccgccagactgcctgggtcctggcgcctggcggtcacctggtgcctactgtccgacaggatgccttgatcctcgtgcgacccaccctgtgtatcctccctagactgagttctggcagctccccgaggcagccggggtaccctctagattcagggatgcttgctctccacttttcaagtgggtcttgggtacgagaattccctcatctttctctactgtaaagtgattttgtttgcaggtaagaaaataatagatgactcaccacacctctacggctggggagatcaggcccagccccataaaggagaatctacgctggtcctcaggacgtgttaaagagatctgggcctcatgtagctcaccccggtcacgcatgaaggcaaaagcaggtcagaagcgaatactctgccattatctcaaaaatcttttttttttttttgagatggggtcttcctctgttgcccaggctggagtgcagtggtgcaatcttggctcactgtaacctccgcctcccaggttcaagtgattcttctgcctcagcctcctgagtagctgggattacaggtgtgcaccaccgtacccagctaatttttgtattttagtagagacgggggtttcaccatgttggctgggctggtctcgaactcctgacctcaggtgatccacccgcctgagcctcccaaagtgctgggattacaggcatgagccaccgcgcccggcccactctgccattgtctaagccacctctgaaagcaggttttaacaaaaggatgaggccagaactcttccagaaccatcacctttgggaacctgctgtgagagtgctgaggtaccagaagtgtgagaacgagggggcgtgctgggatctttctctctgactatacttagtttgaaatggtgcaggcttagtcttaagcctccaaaggcctggatttgagcagctttagaaatgcaggttctagggcttctcccagccttcagaagccaactaactctgcagatggggctaggactgtgggcttttagcagcccacaggtgatcctaacatatcaggccatggactcaggacctgcccggtgatgctgttgatttctcaaaggtcttccaaaactcaacagagccagaagtagccgcccgctcagcggctcaggtgccagctctgttctgattcaccaggggtccgtcagtagtcattgccacccgcggggcacctccctggccacacgcctgttcccagcaagtgctgaaactcactagaccgtctgcctgtttcgaaatggggaaagccgtgcgtgcgcgttatttatttaagtgcgcctgtgtgcgcgggtgtgggagcacactttgcaaagccacagcgtttctggttttgggtgtacagtcttgtgtgcctggcgagaagaatattttctatttttttaagtcatttcatgtttctgtctggggaaggcaagttagttaagtatcactgatgtgggttgagaccagcactctgtgaaaccttgaaatgagaagtaaaggcagatgaaaagaaagaaaaagcctttttatgttcttttatgttctcggctcaaaaagaaacaagggagtgtaggtttaaaaccaaaacaggagagaagacaaaccccgctccggctggagttagttagaaccagaactttattgtagcggatacactttctgacctatcatgagtatacacatctgcgaagggaaaccgcgcggcgaca

SEQ ID NO: 182 - DNA, 145935 bp, Homo sapiens
  source 1..145935: mol_type = genomic DNA
gctaactgcgccccagtttctttttattgatttcttttcttttctttttttaagtatggaggctcaagtataagatgtagatttttttcttaagctttacaaaaaaacaaaataaaacaaaaacctccttttgcattccatagaaattgacagaaaagcacctggccggaagagcggaacggtcggcggcaccccccccagcccccaccccgcggcctccgtgggacgggagagtctgcgcaggacggcaccgagggccacctctgctcccagagctgtcccctgtccccacgacccccaaccccaagcaactcccaaacacacacggaataagatttccagtttttcttctctctttcacacaccacagttagttcataaaatttttttgttttacattttttacaccaatgtaccaaaaaggtgggagggaagggaggctggcagacagtggattttatgcctataaatggggggacagggaggaagacggggggcccgggtgaacaaaaaccacacggtctctatggaaatgtggagagaactgagagcgaggtgtggcagaagcaggctcggagccggaggagggtggctatcggctttattctcagggagagatggcgctgtgcggtcaatgatgcagctgttatgtgacctgtcggggagggaagggacgagggaagggagcagaaaacgagttttctaagaaaggaatctaacgagtgcacggcgtgtctggttagcatgaaacagaggtttagcattgctgctttctcttcaaagcctccaccaggtcattcttcagagcttcttgttttgatttgtctgcaaaagtctgcacagacctgcaagggaggaaaggcgttatcagcagattgaacagggactggtgaggcggtggaggcctgggggccaccatgccagtgcctggctgatttgctgcatggacccgcttcctggggtgaggctctgggtcactgggctgggcatctgcccctctcagaaaggggcaaaggggtacatggccgagacctgcaccctctgcaccttgccaggccctgtgggggtggcatatggcttacatggacaggtgctcatctctgcccctggccaccggtgacccggccatagtccctagaaccctaagttcactcctctgtgtgtaggtccctatgtcaccctaagccacaaggtggcttctgggcttccaaacacaatggaacaaagcccctctgcttcagaacagctaccctgggttgctggctggggactcaggccaggggctaagaggggaggactccggggccatgcgggttcctctataaaagcttctcccttgcccaggccctgcccagcagaagagcctcattcctcatcccacaagtgcaaggtgcagcgttatcccacccttgggagtgggtaagaaccagtgtctctgcgtgtctgagcacactgtgtttatggcccacgcagcaggtgctttcaggcctctgctgtgaggcaccatccgctgttaacttggcccagaaaacccctcagcccggattgcaaagggcggcacaggacagccaagtgcccctgggatccctgctgtcaaattctggatttgtggggaaacgttcagggcgaccgcattcacgtatgtgtggggacgctcatcaacaaagccagaaacaatgaaggcttatggagatttcacagtttacaaaacgcctttcacatatattatctcatttaattttcacgggcatcctggggaagtctcaactatcaacccggccggatgtggtggctcaagcctgtaatcccagcactttgggaggccaaggcaggaggatcatttaaggccaggagttcaagaccagcctgggcaacatagtgagaccccatctctacaacgacaacaacaaaaagcgaagtcaaggcttaaaaaagaaaaaagctatcaacccaatttacagatgaggaaactgaggctcagaggaatgcccccctagcaattctttaatcattttgtcaaatttacccaacatattggttaggcaaagacttcctaaatgtaggttttataacagtttagaagcagtggaaagagtgggtagagggctgctcaagaagagtgctacggagagtgcactcagccggactctcacgtttgattcacaccagccatgggaaggaagaatcagaaaaatcaatccccagaagcaaaaatgggcaaatggaagtgaagcagggcccaggagaagcaacagcacccagactgagttctggctaccgaatccctacaagtcacaggaagagccctcaaaatactcagcaggtgccataagacaagacctggaagcaagctgcatacaactgaaaaaactcccaggagaaacgcagacatttggttcatgctggggaaatacacgtttctgagtatcttcccaggactgtccctggctctgcggcggccaaaggcatcagcccccacggcccccaggctccaaatctcagccgattccccaggggcttcttgccaagctcacagcgggaggtcaacatggccagcgggagatgcggcgggcaaagcagcagcgcacaggacctctagcctgggtggtcactggctcttctgggaaggaagagccaagcccgccaggtcttggctggatcacacgaaggagaaagttccagagctagaatcatgttagacacaggaagttagaagtgaaatggtggaaggcggaaggagcagggggcttatttaagggacaatgcttgggaaggtcacggccaagcaacctcgaatcagcgcttggagacagtgctcgactctgtgggagggaggagtcatcttgagcagacctggctgccagggtttctacgccaggacgcccccagtgggcggccagggaactgcaccatcacggtgtatcttaaaaagagttttttctcaatgccatgatggaaatgcctgatggccacactgtgaggctgacccgagtcgtgggccttaagttggcacacacagaccagactggtgcacttaagtcccacggcctcggaaaagcagctccacctggttttctaagtgcctgaccccacctccaccttggaaagtctgctgcaccccttctggggtgggccttcagtgcgcagcccctggacctgggctctgcagccccagttggcagggttccaaatgccttctttttacaaacaagtttccctcctactctccagggatgctgcctccttccctacatctggatctgtcacaagctcaagtcatggttcttggccattaccaacaagcaagactattttcctttccattagcgaaacctgtttaaaggaacagctgcagctcgttaggggcggaaggttatgctggttgtggccgagtcggcactgggcgtccaggcagctccagcagagcatctgggccagccagggtggagtccagccctgactctgccctccaaccccagagactcagagatcagagagtgaggtcaccccttccaagccagctagccctggacaggcaatgtgccgctgagcagcggggaggcttatgtggcttctgggatccctgcaccagcatcagaggctcctctgaagcatgggggggtggacggcaggcagatccctgccctggggacagtcaggccggtgcacacaagtggctgctgctggagaggcagcatccgtcccttggcctgggcttcttcagaagcaaaagccaaaaaatcagccgtcttccccacacccagcctccacccagagtggaaagcacacacacgtgataggtgccgtgttacatggggccgaggctacacgggaatgtggctgtgcaccgaccgggagcacacgtgggggttagtggtggtttaaatggccgcggagcagcagccggaccggcagggtctcggcgggttggtgagtcctgttttagtggggagggtctcgcggctctcaggcagggtacctggatcggcttaattatcaggctggatgtagatctggcgctgggtcagcacttgagagagctccctctgcaactgcttaaacttttggttgtcagggatagcatcaatagatctacagagagtgttcaagatgagtggagtgggagggaagagaacgacgagaagccaggaacgcagggggccacagctgaggaggaaattcagggagacccacgaggcggaaggggggatgccgtggcggctctggggtgtggagtggtatcgccgctgcagaggtccacgctggcggtggtcgtggtattcaggggctcgccaccaccacccgcaggctcttcggcttctctcccccacttcccagccactgcctggggactgtgcaggttggctgggcgggaaagtgtgtttggtgtatcgggcagtggctgccagtggcaggcctaacgccagggaccactgggctctaaccctgtcacaggtcacgaagaccaagcctcccccaggtgggcaggggatcagaagacaagggtccaaagaggactcctcctctgttttaaaactgtaaagcaggtgactgaaatctgtcgcccaccccagtccacgagctggggcagccccgggactgcagcctgcctctcctctgggctgggctgtgagagctacaccacggcagtgggtgagagggctggccgctaaaggcatagcacagcccgactcacacggtgctgctggactgcagagcgtgttctagattcatcatctcagccgaccgtgcctcctcgactggacaagggcctctgcgaggagtgccagaggccatgcagctcgggatgacagagcttaggggagatcccggcctcctgactctcctgactccaaggccagtgctccctccacagccgtttactgcccccagctgggctctggcctcatgtcagaggcctgcctcctgctctgtccgccgtggacctggagggtccagagagcgcccggcttttgtttgggctgacactgcagagctgagggcacgaggtgggaaggatggtgcaggacactggccactggcagcagagccctggcagaggacgtcagagaggctggggccccctgagaacgcccaggctgagggccctgcctgcatgtggcgtcagggaggctgggggcctgagaaggcccggactgagggccctgcctgcacgttgcgctctgctgtctcggagagcaggccagccagaggcagccgggctgcccggaatgtggtgtcatggctcccctaggcccaggctggagggtggggagatttttgagcggggactgacaaactgcagggctgaggaggctccgggggcaagggcaccaatggctgttagggtgaacatgccccagaaaacaaatggtgcagatagggaccgacagctgctacggagagtgcagatgacacatcaggactttactttccaaaatcaacataatgatcatcccagaagaggggcactgcagcctaccaatgaggacaccgaggcccaagaccacacagctagtaactggcagagccagggttcaaatccctctgtctgcttctaaagcttgtgctttctggtacattacctcagcccattgacgatatcctttgtttttccaaagtagatctcgttcagcgtacttctgattttattttccatgtcctggaagggaggtcggtcagcgcagtggcaaaaggtcaggaaccctgaggcccacgccctccctccacctgccagccctgcagtccccagtgtggccactggagggtggcacacgcctgctctggggcatcagtgagcgcgctccaggctgccaagaccccacctgccatctgtgctcccggcaccttcccatccacagtccacaggcagggaggaagccagtacccagggattggcggccagctctgcccatgcctgggagctgctctaaaccacatcaccaccccttgggctccccactaattttgtgaacaattctgtgaaacccgagagcacctccctgccttcccaaacaacgtggtgacaggagggccaaggcagccgcaactgaagccacaccagggcccactggcattcctgggatctgcttcctctcccagcgcagggccctgttcacacccaggcgatcaggggagacaagacctagtgcgccccagagccagcgcctgagcagtcttctgggagcccaggtctgggggtggagcaggaggtggccctgaagctggagcctgctggcatccaaatcagaggctccaaaaatatgaggccagggcaaaatccaagaagcgctctgccggctgcggtggagctgagagaaagcagcagagaaggaggccagcacagcggctccggggctgcagtgtcactgctgtgggtcactgcaggagccagccagagcccaggtcactcacctctaccaggcgcccgatgttggctatgtgtggggagcagtcactcacagtttcatccttctccatctgcaaaagacagaaacattccaagtcagagaaagccagagatttctgagaacggcagacagcccaccccacctccacggtctgcaaagagcctactgttcccaccgtggagccagctgcaggtatgacaaggccagttttgcagcctgggaactgaagcacaaaccgacttcagtttcagaccataaagagcccagagggcagaagcccagagtcccacttccaagggagaagattttgctgctgcccatggtagagcaggcagatgcccagagccacagcagcagcccttggcaggcaccagctcacccgagccaactggagaagactcactcggtttgtcttcaggcctctactggcaggcccaggcccacgctgggccatccaccccaggttcagggcctgacactgcaggggaagcttctgtgctgctgctgcgccctggcgctcccaaatggtggctttggggtgccatctgctgcagtctcgcagggagggacagacaacctctgacggagacttcaggccagagggattcagtggctcaccctagtcatgcaggtggcaatggcagagcctgggtcaaacccttcctcgcaccagggcctgttcgttctactctgcgaggagagtttgagcaagagagtctcaatatagactctgaggttatgaggggggcagcagcactcaagccccatctcctcttcccaagcccaggaagagctggctctgacccaatcatctcaactcggaggagggaggaaatggaggcaggttagggtagaaggaattcggcactttcccccgaattttttcttatctgaagccttatttccctgacaagaatataaattctttcaggagagatgtgcctgcctcataacgcacagggtacctggaagagtgctaggaacataaatgctcaacgttactacactgaaaacaggaatacgcagctacgatgactaatgttgttgaaataaaatgtggaagctgaaataaataatcaagaaagaggaagaaaagaacagcatcagaaagggtagagtagaaaccatgcaagaagtggccatcaaattataatacaaaaatgcagtactctaaggctaagcatttattgttgagattctaaatctgcttagacattatttataatttttgaagctttattaaaataaaataaaatttgtgagagaagctaaaaaaaaaaaaaaaaaaaaaaaaaagaaagggtagagttcaaaatgagaccaggcccacagaagaaaaaccagcaaaaggtgggttcctctctttggaaccaggagaacagggtggagtctggggggagatactgtctcagagggtacgggctctgttgcttctcacctatttctacatctcctcatcagggagactgactttcaggctgtgaaaggtggaaccaacctggttaagagcggggtgagcagagggcaggagagaaccaagccactttaaacgaccaggcttccagggtcgggcaaaaccgacctgtgattgaaatccttgacactgggggcggcagcactgacccgacttttgtctttttttttttttttttttttttgagacggagtttcgctcttgtcgcccaggctggagtgcaatggtgcaatcttggctcactgcaacctctgcctcctgggttcaagtgattctcctgcctcagcctccccagtagctgggattacaggtgcccaccaccacgtccggcttttttttatttttatttttattttttatttttagtagagacagggttttgccatgttggccaggctggtcttgaacttctgacctcaggtgatccacctgcctcagcctcccgaagtgctgggattacaagtatgagccactgcacctggccgacccaacttttgtcaaaaaaggaagaatggcctctgcaaggaaacgctagctcgaaactgatccagacaacaatttttgatgggatcgttaaaatcatctgctggcacattttaaactcagagatcatgaggagccagccaggctcactgtgaacaagccctgcacgagagcacttcttttcctgttttggtggggatgctgggctggaagaaaacacaactacttaaatagggtcgcatccttctggcaagttcccatctaccatcctgcacctgtggctgagaggaagggcaggatggagcctctgccgataggggtagggacctggccacatttccacagccccccacccactcccctccacacctggtcagggtcagctcgctggcaacaccgacccaccaaaaatagaaccatttgtgcactgcatacactatgtggcaccctgtagcagtctctgcctgcccttggtcaacttgtttgtccaggacttaagtaaaggcccagctgagagaacgaccagcttcctatcgacagtgtcaagggttgagatggtcacagggttaatacggaacccggaaacctgggctagctacagaacgagagcagcaacttggaatggagccaggcggcagccacctttttccatctcagcttcctaggaaccctgttttaaacccaaggaaaccgaagcttaaagaagcaagaatcatacagcactgttagattccgacgcctttgctcctcctacttcaccacgccagttaaatgtaccagggcaaatgcaagccagatatttaggctcaagggtgcatttcatgcagtacaaaatggggaactgctgacttgcaaacagttcctatgaagagacttgtggtttttagataatttcaagtttgacaaggatgagatgtcgctactaggaaagcttttgtgcaactttaaggtgcacagatgacactattccttgtgcccagataaggggcagcattcccaccccatcgcgtgatgaagacactgcagctgccagtttccattgcttgcttgggaaggcagtggttaccctctgttctgtcctggcccagctacatctgcagggctggattcagtttagggcacttttttttttttaattttcttttaaaagacaaggaggtcttgctatgttgcccaggctagacaggaactcctgcaatcctcccacacagctgtaactacaggtgtgtgccactgtaccctgctaaggcactgggttttaaaagccttgaatgagttagcattcatctgcttaaaaggtctgaacaccctgacaccaagaaatgggagagaactagggctatccaggcctggcggtggtgggtggggagggatgtgtgtgtgctaggggagacacaagagattctggcagggctctgaaggcctgctgtctgccaggggaacagacccaacctatgtcgctgtagatggcagaggggggaccgagcagtgagagaacatcacggctcactgggctggactcggtctgttctgatagagctgtccctgacaggcatctgctcacaaagcaatgtggtctgggagaccgacgggtctgagaaaacgggtggcatctgacaaggggggggggcggtctaggtgagggcaacagtccagaacctgctgcctcccaagtcataacagtaaatatctgcagaaaaaagacatctggttctggcaaggctgttttactgaggactagtggaaaagagggagagaaatgctagaaagaccggcttctctgctcccatctgtcttggcatgctctggcaagtcatcctgaggaatctcgaccctcagaccccagggggtctccataaaacaggagtagtgagagtgcccatgagcttgagagtcacagttctcatttcaggtctaataaacacaccaacctcggcagcactggagcgtctgctggaacatcatctttatctgccactagcaaaaccctggtgccaagacgacggggtgggctgtctgctcaacaggagctggggagcaccctcaggagggagggggctccatccacccagcttcaaaaagaacttttgcatgctggcccccggggactgtgtgttctcccagacgtgaaggtggttactgtgcctaggctcagggctgggtggagtcagctcggcaggcagggaagcctgggggttggatggaaatgaatgaggtccttccagcaaatcagagtctctcctcctccccggctccatgtggacggcagattcccggccaccctagggaagggatgagggttttgagctcactgtgggccccattttaaatgggcaccaacagcccaaagagaggccgcggccatcggcaaaggtcctgggtcacctgggcaagtccagtcacatcagcaatttggcctcttggttaccatctttgtgtttcagaatcaagagccatcttaaaacaaacaggcgaaaccccttggccaacaaaggtaggagaggtcgggtggaggagagggctgggtcttgcagtgtgcgacactgtccccaggagcagactgatcccctagaacacaggccccctcagcccatggcagggaagctgagcccacgtaaatggccacgcagcggctggggagggaaggagaaaggtgcttggggagtgaggggcacagggctcggtgcacccggccgtatttccacagcccccttgcccgcccctgctcactcccctccacacctggtcagggtcggctcggtggcaataccaacccaccaaaaacagaaccatttgtgcactgcatatattattacatccttataaaagtggctgccggaaggaaaacattttcatgtgttgtggctgcagatgttccacgaggtggttccaatggcgtctgaagccggagcctggcccgtgtgtccccagcaggcgcctctcctcctccccatggccctaacacaggcaagtgtttggaagctggcagcctttcccccagaggggatgtattacacctcccactgccacgtggcatcttctagcgcgacccgcagggcgtggccctaaggcatgggccccactcaccggcgctgaggccccgcagctcctgtgctgcagcccgagaggaaagggcctgggcttgtctaggcctccatgtctttgccttcacctcgcactaaataaacaaatgtacacaaaaggcctagagcgggacttgccagaatggcagctctcaccgattgtcaaagcacagctccatccccagcactcttctggcctctggcatcctcctggtcaccacactgtgctgtgggttggaggtcaggacccggcgtgcagccaggccagaagatggtggtcagacggcttcccagggaaagttacggttgcccagtttaggaaaattttgaatctagaattgtacatattcaaaaagcctctccttgcaagatatatggtagtagcagtaattgtttttatttttatttttgagacagggtctggctgtgttgcccaggctggagcacagtgttgtcaccacggctcactgcaacctcggcctcccaggttcaggccatcctcccacctcagcctcctgaatagctgggactacaggcacactgctgcctcacctggctaatttttgtattttttgtagagagatggggtcttactttgttgcccaggctggtctcaaactctcgagctcaagtgatctgcctgccttggcctcccagtgttgggattacaggcatgagccatcgcgcctggcaaaagttattatttattgagcataaaactgtgtgtaaaacagttttttgtttctactctacaatgatctttcctttttttttttttgagatggagtcttgctctgtcgcccaggctggagtgcaatggcgcgatcttggctcactgcaacctctgcctcccgggttcaagtgattctcctgcctcagcctcctgagtagctgagattacaggtgcatgccaccacacccagctgatttttgtatttttagtacagatggggtttcaccgtgttggtcaggctgatctcgaactcctgacctcgtgatccacctgccttggcctcccaaagtgctgggattacaggcatgagccactgcacccgatctttccattttttttttttaataaaatttgtttattatgttttttagagacagggtcttgctctgctgcccaggctggaatgcaatggtgcaatcatagctcactataacctcaaactcctgggctcaagtgatcctcccatctcagactcccaagaagctaggaccacagatgccaccctacccagataactttttgttttgttgggaggggtgaaggggtggggggcagtgcaactgttgcccaggttggtcttgaacccctggccaaacaatcttcttgcctcagcctctcaaagtgctggaactattatctttcaaaatgggcattatcaacactgagtttcaaagaggtggaggtctgtctaggtcacacagctggaaagttcctgagctaggatctgaatcaaggtctgggtgattctgaaacctgcttccttttatgagatctctctgctggctcaatttcacatacatcctttaccagaaaactgaaggacaaaccacaatccagggctcagaaaacctgagcagggtccatccctgcctcagccgcctcctgccagggatctccggtcccttcgtctcctgtttccgcccttcacagcacgggatggttgtggggagcctgtctcaggccagctttccttctcagccaggcactggtcactccaccccaggtcatctggcaaaaacccagacgccccttgaagctgcgctgctcaagcatctccacccctgaacccaggcaaccccacaggacacgaggagcgggtgtgcagctgcagccaggcctccccagcgagcgtgcactcctggaactgccaagctgggcccggcccaccctctgttccctgcatctggaagggcaatgggcttcttccctgtgacaaaaatatactgcctggcctaactgccaaacgcaagtcaaagaggatgttcctgctaggatacacaggcaagtgcctctactggggatttactgcctgaagatatattgggggtgtctctgctgagtggggagagactgctcactagccaatgacctgcctgatctccccactcaacaaaacattccaccttcatttctaaatatttagaagctgagaaaatatcaaacgaacatctgcagggcccttccccggatgggaaaccttggatctctttccagagatttacaatctcgcctctttcccacgtctctgctgtcacataggagaagtgacctctcagtacaacttccttttcaacattttggaacttggggcttgcaaccttttttcgcttgctctacaaccctcccatggggggccacgtggcagtgtaccagagggtaccttctgcccgcctttcctcacacacatccacaagcctgggcaggaaggtatgatccggccggcctgcggctcaccttcactccgacagcctcactgctgcgggaatttgccagaatactttagctgtttaccttgtcttccagttgacgtccctgagaaacatcttttggtggttggaggtgggagaagtaaaagccgaaaatgatggaggcagggctaggtggaggcagcatcgcctggtctggctgtgttctggctggctggcaggccacgtgcccaggagagtggcgctctgccccggccactggcctaccaccagccgcctacactggggcacgagtgggcacagggcatagcctgatgtgcccacggaagggacccctgcgaggtgccagcaagccaaagctggcggccttctccagatgggccgtgggaaacaggaagacaagggtgcgcccggggccacacacagggaagggcagctgccgctgctgccggggtgaggcaggctgggccacaggaccctgggaaagctgaggacccatggggccttgctgagggtgctgatgctggctgggatggctcttggggctagggcctggcactgtgggcctggggagacagctccaaaaccaagcagccttccttcctgacacacgtggggcaagggcatgtgagcgtgggtgacctggatgaggccaggtttccagaggaaaaacccaggcccaggttgctgtaaggactgtgtaaggaggaactcgagtgaggggctctcatctgacccccacctcacatcttggtcgtccagcccctgaccacgccacgccagaatgccccccagcctgcccctcttcccctgcccttctgtttctgcccttgccacctcatgcctcagactgacactagcttcttcactgacctctctgctgcagggctgtcccctctgaccctcccagggctgcctgatccaggcccttgtcatctctctccttgatgactgtaacagcttccccctgaccacccatcccccaagccgactggcagagccaccttctgaaaacacagatccaatcagatcattggactccctagaaacctcaaagccctcctgacagcctctagtagtgaacacaccccagtggccaagtggcttccagcaggagatcatcctgaaagacaaaggcacacctgcgggaggggcccagagggcagcgctgctcagcacacacctggggagccttgacgccgtgtgcggctctgcagggttgatcctgcttgcggggcctgcttgctcctgaggctacaggtccactgcagctgctcatgccggctgctgagacagagtcctgtctacactgagctgactgctccatgcacttccatctgactatttagcagtcaccgaatggcaggcacagaggacgaattaagaccaaaacagttgtggcatggtagaaagtagcatatttttttctcaccaggcaaatctgggttcacatcccagctttgcttcttactggttaaattatatgggcaaattatttaagtttgaacttcagtttcctcacctgttaaatgagaataacttgaccttggttacaatctaatccaaggggacagcctgcaaaccatgcatgttcatgctcactgagctgctcacttctcccagaacccttcgcctcccatccaaacaagcacaggcgtttttccaaggctcctctgggacccgtagccaagctctgcaaccctcacttcccctgtttgctcagaagctgtgcatcattaacttagatttgtctacctcattgcaatccctcccccttctgtagttacttacattggaacccagccccagctttaatgcacctcaaatgaatgatgtggtgatcggccgttagaatgatggcagagcattaatttcctcattaaagcccccagagcaaaaggcaacgcaaacaaagtccgaagccctggccaaggtgtgctgaggacaggcactcatcaggcctgggtttagcttggcaggagacactgctcacggcaagccggaaccagactctggccatgggctgacagctctgatttaaactattaggagggctgaggattaaatatttgtccaggtcactgtaaaccgggtggaattatcaacagcctggagtggtaagtgatacaggaagcagtctctggatacagattcaggattttccacccactccccaggtggcaggatgtgggagagtcaggctgcaggggagctggctgcctgggggtttggctgttcctccctagccaatggcccctggaagataggagtccacttccacgcaaaaaggctaagtgccccctgtgtgcactagtgagtagtcctgggatgggactgtgacatccctgcccagaggccaaaaagaggaccgcaacatcccttctggcctccagcccctctgacacaggagaggcagtggagcttctataggtggagggagggtcccaggtatgacggctgacattcaccttgcgccactattttttcaatgcatgtagatgttgttgtaactagtagaatgcaaattcacttaaaagatttactacactgggccgggtgtggtggcttatgcctgtaatcccaacactttgggagaccgaggtgggcggatcacttgaggtcaggagttcaagaccagcctggccaacatggtgaaatcccatctctactaaaaatacaaaaaatgagctgggcgtggtggtgcacgcttgtaatcccagctactcgggaggctgaggcaggagaatcgcttgaacccgggaggcagagattgcagtgaaccgagatcacaccactgtactccagcttgggtgacagagcgagactccgtctcaaaaaaaaaaaaaaaaaattttactgcatcgatcctttcggtcatattttttctatccacagctattgagagcataattatcttaccgaaagagatctctgatgttaaaaggaattctcacagtggacagtcagggactgctggaactgagaacggaagggcatccttgcagaaagtggcgccccgctgaggctctcaaggctgtgccgtttctgccaataccgacttctccgaaggcaaagaggggtccttgtgaaacccagttgtgcttggtctatgctttctcttccccctttacgccaagcatcttgtggcactgcactggcacaggtttaaggccttctcttgggatgggaatgtaaagggtcctgaacatggacctttatacaaggttcttaaacccacccagatgcttatgggagcatctaaggtagaagggcgggcaagtttgctcaggggaggcagtaccttccagtccaagtccaagtttgccttagacagaacctgggaacaacatcgtggagaagggttgctagtgatacccaaacaaaagatggataagagagaggtatccagtagggcacttctgaaatttcaatgtgcacacattacctgggcaattttgtgaaaacagagatcctgatatgctaggtctgggtgggacctgatatttctgcctttctgacaagctctttggtgatgctgatgctggtccttggactactctgagggcagcaaggtgcagacactctgagctcaggtaagctgctcccagagagctggcctgactgatgggctgggcatggccacagagacggcaaacagggccaagcaccacttctcacagcacaacatgagctgaagcatggggatgtgcggggccctgaggggtaaggaggagccacagccagcacccggcctccctcagcaggaggccagcagagtgccagcagctgtgggcaaccttgcacagcccagagagcttttatttgaaaatgcaaagccctacttagatggtggatttatagctggctgaacatgcttaccctaaatggggcacctgctcactcatctctgcaggtcagcactgaggccagcacctgtgggcactggcaagtggctatgagcgggtaactctacctgtctggtaaggctgcctccgaggttcatggtgccagagccagatttgttggtctgcagccacagcatcaccgtggaggtcaacttgtaatgggcggtgcgaccgctggatttctcctggaaggacaagacagagatctgttgagctgagggagagcctgaagtggcccctggaattcagggtcatcctaacatctcccttcctaggtcattatcacaatattaccttttttttttttaaattggagacaaagtctcgctctgtcacccaggctggagtgcagtggtgcgatctcaagtcactgcagcctccacctcccaggttcaagcgattctcctgcctcagcctcccaagtagctgggattatgggcgcccgccaccacgcctggctaatgttttttgtgtttttggtagagatgcggtttcgccatattggccaggctggtcttgaactcctgacctccggtgatctgcccacctcagcctcccaaactgctgggattacaggcccgagccaccgtacctggcctcacaatattgtctttcttaaaaaatctcaactggtttttaaagggacatttgtaattatgtatttcttctgggaacttaatcatcaatgactactgcagacttatctttatccaaatggctttgaggcatttctcagaattaggggttcagagatcacagcatccccctactgcatctgttagagagcagcgcggcactggttggtgtgccatctgtacttagtggcccgggccaccagctgctgggaggcagtacctgcacttctaccacgtggatggaatcccagcagcctttgatcttctttgatccatctccagccttctttatgaggatcactccagcaaagccatgatccagatcccagaggtagacagatgagacgccaccttcaaaatacctgcaggaaacaggccaatgtgcctgttagatgctaaaggacagatcatcagcctgggtcccaggctgctgctcagcaaagattctgggattcagggccctccctgcgacagttatgggagccgatccttgggtgtgttctgatcgttctgtggctgggggagggggtgcagcattcctgggggtgtagtaggtttaggcgtcataaagatgaatctgaggttggactctgccacctcctctatctgtgtggtctttggcttactgaacctctctgggcgtcacactcctcccagataaagaatgcagcacgactgacatccagtgacaatccatgcaggccatgactactggagtcaccacggttgttcgatatttctgtcttttgggatattttacagggcagatgagaaaatacagcaacaaactccctacaccctgatccctcctgagcctggcagaccagggctccagttggtctttcggagcaacctcctacaaagcgctagccggaaatgaagggctcagcttgagacagtgcttcctcctcaaatccgacgcaatgcaaaaacatcttttctttttttctgtttttgagatgaagcctcaccatctcccaggctggagtgcagtggcaccatctcggctcactgcaacctccgcctcccaggttcaaacgattctcctgcctcaacctcctgagtagctgggatcacaggtgtgcaccactgcacttggctaatttctgtatttttagtagagatggggttttgccatgttggccaggctggtctcaaaaccctgacctcaagtgatccacccgcctcagcctcccaaagtgctgggattacaggcatgagccactgcgcctggcccagaaacatttctaattataatcaaatggaagagggatttctaattacgatcaaatggaagagggaacgaaaaggttagatgagaaatgggaatcagtctgggatcccaaacccaacagacccaggtcaactactgtggctcactgggactgccgtgagcagaggtgaggggtggagtcagctgatgggaaccgcaaatgctgttgataaccaacaaaaactatgcgaaatctcatttcttgtggcgaaagtctgtagcctctccgaccccaattaagccccaaagagagaaatctcatctctcgtggtgagcacatctttatcagaaagtctggggcctctctgacacctattaagccccaaagccacggtgtggcaggtgcattctgggagcaccctgccctcagccctggacagctgggaaggtgggccgcagagtgcactgggtgggtacaggcttgggagtcagacagacccaatgacagctctagcacgcccagctatgagttatgctcatgcatgcatgtgtccaacaactatttactaagggaccagcggtgtgaatatgggcctcagggacttaatctactttctacggctgttgagagacaaaaacaattaggaaaagtagacacctgccaaacggttaatgtaaaattaagtactagaaattaacatgtatctgtagattatgtctcaccaaagctattatataacaaaaaatacacatttacagaatgtgggtgatgggtatacaagaattctctgtactcttttttttttttttttttttttgcaattttacagtaagtcataccattccaaactaaaaagcttttgtgaaaaatcagtacacgaatacaccggagtgtaatgtaactaagagaccaccagaccaagaaagcaaggcatcctcccaggagaatgagggtgccctggctggtctgccctcactccaacccgcagacctgcggagcatccagggggccgatactcaggtgggctacccttggccccctgcccagggctccctcaggcaggctgcggccagcccctgcggcaggaccacatcctgtcccattcccctctccggcactacccactatgattaagctctcaaaccgagtacaccatggtgtgtccacgggtgagtctacaggagggcagatgagggcagggctgtctggctaaccaagtgtcactcagggaacacctgtcggatggaggtgtcaggtgtcagatgctgagcccatcgctggtcaaactgcgcagggtggggaagggtctggctctggccaggtgcagcacaggcatcctttcctacgagaggaaaaggaccactggatgaacagacacacctgtgaggcccagagctcactgctggcagaggtgatgtccaggaaaccggccaacactggcactcagagatcccactccagaagatcatttcctttattccggtctgctccaaagtccccattcttggggcgaggcgaggtaagcagatgagtgttttggtccagggcccaaaaccccatctgcctccatagagccctcctggtctggaccgggcccacacagagttggagagatcaggccattctgcaatgttcctggaacacctggagagggatggactgcccctgctggacctgagggttagcagggctcagatgactggcagcatgggctccgtgagcctttctggcttgttctcctggattcttgcaagttaacttacgaggcacatcaatactaccaacggaagagcaactcataacagacctgctaatacccttcctgttggcaacagatggcttggttctagcacaccgttttccctttcagtcggcttacagggagagcagccccacatcaaaagagggggaagaaaaacaaacaaaaaaaccctactttgctggcaaaaaggatgggccaataatccgttctttccttcagcccttctggaaagaaggcttgcagcccaggggcatttcatccttccactccttcacagatccatgcagagctgcggtgctgtgcctgcccaaggcttgctctcctctgtgtgctgggacactggggagatgcaggtcaggatgccctggaggggaaccaggagaaatcccgatggcctgacagcccttgtcgacaccctccggtgaccagttcaaaagcaccaggtggcccacggctgcttcccctcagtcccatccctgagcgtttcatttcttccagaaaaataaaacaaccgcattaaagttttatagggtggaactggccgtttccactccaatgtcccaccctgtggcctggctcccactacgggcagcttctccttggcgggccacggtgaccaggtctaaagtttcaaatgctggagccaggggaggtaaaaatgcaagctcaattgtcactccttgtggggttactattcttttacccacaattttaaaacttactgcaggaacattattgttttttaaaaaaggaaatctgaaaattagcccacaatgccataaatcaacttatcccataaatctgatttttccaaattcccttccagtccagatgcatgacttttatataactgtaagcacagcaagagtaccatgctgaatttggctttttacacttggcacagaatcattagcatttttccatggagccgcatgatctccataatcatttttaacagcaaggatagtattcagtcgggtagtatcctaatttaccatcaatctgacttttaataaagaaacaacggcgacagagttagaggcggcgtggtcaatctctcacttcgaatctgttccctctctgaatcggggtgttccaactgaggtgagtcagacgtgctgagacctggcctctgcaggtacagctcaaacactacaataattcaagaatggacttgcattccattcaccaaaagggatctccagggactggagcagccacaagtctcaacctgacattccgagacaaagggagcagaggactgcatggttagaaaggcctgtttcagaattgcccagaagcaccagcctctcctgcgagtgccatcagggcgctccggcaccttcaggagggaggtgactgcagggcgcacagacagcgcccccgctacatggtttatggctttgctctgcgcgtgaagcattaattaaagggggaccacaacacgtttttgaaaatttatttcttacctactgtactttgatcataatgatatgaaacaaggaaaaaataatttttatgtggtttgcatttatgagtttttacataaaggcttttgtgggtattttaagaatgtgctaaaacgttgtctgaaaccacataaagccatctgaggagtcgcccgccagaattaacagcacatacatggaagcagtttaactggtctttgtatatttaatgagtcaaatagtattaatattgtttaaatgctaacatgctatttcaataaggtggctctaccatcgccagcgactcactctcaggccttgtacttccatgtgagtgaatgatcaaatgtggccaagcgctgagagcaggctgcagaggaattaatccgccctgccctggcccctgcccatgcctgataatttcaaaatctcccaactctgcagggagggaggaatgggcccaggactcactaccacagctcagctgatttgggctcaagaggaaaatcccagagagtccctgcagtgaggtctctggtcaaggaggtagaagggggaaatttttattatatttttttgagacagagtctctctgtcgcccaggctggagtgctttattttatttttttgagacagagtctcgctctgtcgcccaggctggagtgcagtggcatgacctcagctcactgcgacctccacttcccgggttcaagtgattctcctgcttcagcttcccaagtagctgggattccaggggtctgccaacatgcctggataattattgtatttttagtagagactgggtctcaccatgttgcccaggctggtctctaactcctggcctcggtctccactcagtgttgggattacaggcgtgagccaccacgtctggtcaagaacctcttttaaacatgcaggcctaggaccaggcgcagtggctcacacctgtaatcctagcactttgggaggctgaggtgggaggactgcttgagcccaggagttcgaggccagcctctataaaaaaaagaaaaaagaaagaaaaaaaaaaccgtggaggcccaaagagaaatgcatgagcttttcctaggcttctttcctaaatggaaagccagacagcacgggcagcacagggctgaaatcaatccccacagtcaagaggctgaatgacatgctcaaatcagagctccccagtggccaggacaacacagggactagcttgcaaagactgcagagaagtcaacttggacaagtgttgaaccatgaagtgggggggcctcagaagctccaggaagatgaggagggggtgaaatgacagaccaacttgggaatgactgggagcaaagtgctggagtcacctgtttgcttgcgtccactgaagagctaactctttcaactgagtgccatcagttttaccaacggtcccggcgccttttaagactttcctaacacagattaacatcttgttttgttttttgagacagggtcttgctttgatgcccaggctggagtgtggtggtgcgatcaccgctcactgcagcctcgacttcctgggttcaagtgatcctccttccccagcctcccaagcagctgggaccacaggcatgcaccaccatgcatggctaattaaaaaaaaaatttttttttttttttttttagagacagggtcttgctatgttgcccaggctggtctcaagccgtttatcagcacagccaattacaattaaacatctggttgggtttttgtctatcgtcaccttggtccctaaacgtggatcagctaaaagcctaatgtgtcagtaattctcttcttctcagagttttaggtcgtttctccctgaaaatcactcttccagttgaataatgtcatagtcacggatatagattctatgtccgtaacttttcaaccacaggacttctggggggaaggagaaaaaagggaaaacataatacttcacactcaaaatgacctaattcacaaaagtaaaaagaaaagaaaatgtttcagctccaaaagctttatggagtgtctgaagctgaggtgtgcgtggggtggaaacgtgctcggggaatctgagctgtaactatgaatgacccaattcccaggcctggccaacacggggctgcaaatctaacagggaaaacgggaggggaagaaggggctttgaagctgctctttactccttcctttcacatcacctcctgggagaagagctggattcgtggctcgaatacaaaggctcccaacagataatgagtacatgccacatgccacaagaaccaaggccaggacagacctgctgggagcagggctttccagcatgagccaagaaacagactctgtggttctagggttcactgagacatgtccttctggctattagtgggctgggccacactcacaggacttggacctctggcctgagatacctgtgacgctgaggcacaggcagcagccaagttaggggcattattaaggtgagctccataggtgctggaacagggctttctcttgcagtcaacttcactgaataaagccaagggaaaggcaatatttggcaccaacacagtgcaaaagacttttttcttatttgtaaaatcaaagagctggatcagaggccagcgtagagggtcctcccagttctgacattccaggatttggtggttgcatcagggcctgtatgaggcagactgagcaccacagggcaggttcctaacatcttagtctctgtcaaactgctgcttacacacctccagtgacagtgaactcattacattcctgaggcaaacatttctgttctgaacaactgagacagttctctctggacttgagtgaagacttctcactactgccttccagaatcacaaaaaaacaaggacttcatgccctttccttgcatagtcctttcaaacatttaaaactggcttacaccaagatttctcttttctggccttctcctccttgtaattcctcatacgactcaataccttgtttatccttctgaacatactccagcttgtcaatgtccttcataaaagaacagaaaacaatgccccaactaagtgttaaccaatgcatagcagggaccagcacatctcttggcaaacaggctactcctccctccagcactcaagaccaaattagctttcattagcaatcacacctaatccatgctacacatactgaacttgcagtcatctcaaatggagtattttttctttttttttttctctctttttttgagacagggtctcgttctcttgcccaggttggagtgcaatggcatgaccatggctcattgcagcctcgacattctgggctcaagtgatcctcccacctcagcctcctgagtagctgggactacaggtgcatgccaccacacctgggtaattttaaatttttttgtagagacagggtctcgctatgctcaggcaggtcttgaactcctgggctcaagtaatcttcccacctcggcctcccaaagtgctgggattataggcataagtcaccgtgtacagctgaatattttttcttatgtgttgccatgaaaatacctctcacatcctggacttgagaacttggtagactggacccaagaatatcactttccactcaaatctgtgacagatcactctcgtagacatggcttcaacatttcaacgtctcttttgggatcccgaagctgttgtgatctgtattctatccaagccactcttcccccgaagtctttatgcacaggaatatacgtgaaagcaggagactgtgcaaatgaggatgtcactgagttccagatcgcgtggatttccagaaagagcacgggcagccctagtgaaggcttctgtggagaaactgatggtccaccaggaaggagggctctggtctgggcacttttttcatgttggagtcagtataaagatggaaaccaggccgggcatggtggctcacgcctgtaatcccagcatttagggaggccgagacgggcagatcacctgaggtcaggagttcgagaccagcctgacccacatggagaagccccgtctctattaaaaaaacacacaaaattagtcgggcgtggtggtgcatgcctgtaatcccagcgacttgggaggctgaggcaggagaatcgcttgaacccgggaggcagaggttgcggtgagccgagatcatgccattgcactccagcctgagtaacaagagtgaaactccgtctcaaaaagaaaaaaagaaaaagaaaagatggaaacgcccacagccttgatgaggcagaagtagaagggaacacaggaggtggggctggctggaatgccggctgaagagctcaggctaaaaaatttgaagtgttgatgtaactgaaaaaagcagaattcctctatgatctggtgctaagctaggaacctgggccctcaaacagctccaacatgtaagattccacgagtctttcttctcctaccctatgttctcccgtcacatgtatggtgtgttctgcttctgggatctcaccaaggagtagcagcaagacttgggacaaataagtggtcttaggtcaggcatggtggctcacgcctataatcccagcactttgggaggccaaggtggggggatcacttgactccaggagttcaagaccagcctgggcaacatagtgagaccgtgtcttaaaatatatatatatatatatatatatataaataaaataaatggtcatgagggacactttttgctgtactggtgcttggtcatgacaaagacaaggtcatacaggcatgagttcaaacaaactcctggccgggtgcggtggctcatgcctataatcccggcactttgggaagccgaggccggcagatcacctgaggtcaggagttcgaaaccagcctggccagcatggtgaatcccatttctactaaaaatacaaaaattagccaggcatggtggcaggtgcttgtaatcccagttactcaggaggctgagacaggagaattgcttgaacccgggaggcagaggttatagtgccttgagatggcgccactgcactccagcctgagcaaaaagagcgagactccatctcaaaagaaacaacaacaacaaacaaacagaaactcccaagctccatgactgattttatggcaaagaggaagagaataaaacccagaggcagagccattccccggcagctgaggttctggccctaaaacaatgcctttttgttccctcctagggtaaaaaagaaactaaaatccccagctatcagcagtagtttgtttttctgatcatccttaacatccttacaacaaaacaggcacctggtcttcacaggtgggaacaatccaactccacctcaggaaaaagagaaaactgtccattctgctcagaggggcatccaaaacctggctcccttcctcgtggtgtagaccaacgttcctttttgctctgctggctgccatctagccaacttcaaaaagaagctgagcgcatcccctgtccaatggatgggcgtgggtgctgcccagtgggcacaatgttgcaaagtccagagagctgcagacggcacacgaggggctggagagtgtgggttctcttccttacactggttataccagcctgcactcaagatgcatctggcaaacaagcatgaggagatataaggaagatcacaagaaaaaaatgaacgggcaagcacttgccatggcacctggcagagcaagcactcaacaagtggtggctgctggttttcatcaggctcttactttctgaacagaggggaggagaaggcaacctcgacgtgttgtgagctgccctggaagtgtccgtcagaaacacaaagtgccgcttactgggagcggttccgtacccactggcacaggctccacacaaaatggagaaagatcaatgcttggctttgggcgggccatgtccagagctgatgctgaaactcaaccacccttgtttgtgtgttgagaccagctgttttcaccatggtttagggaacacggcccagaggctgcccatggacacgggacaggtattcagcggaaattccttccagtacacacaggtgcaacaatcccccgagtcaacataccaatcagcttaggcatgtgcgactttaatgccagctgcacttagaaggcacatctggactgtggctgccgcgctttagtgtctcgcttttacgaggcttttatttttttacttaaagaaataatgaaggcctctctggaaacaatggtgccgctgcaggggccggctatctggctctgggatctggttttgggatctggccaaactgtccacacttggcaccactgcgactgtcttctgccctctggactacttgtgaaaacactgctggccccatggagctacctcatgagccgtcaacagtcagggctttctgggcttccaagtcatcactctcatccaaagctgccattgttgagaactcattctgtgtcaggggctttgcatatcttttttttacagttaagaaaactgtaacccagagagataaggaacgtgcccaagtcacaggctgagaagcagggatctgggagtagatgtcaggcttggctggccccagtgcccatattctgccccatgccaggctgcctggccatcctgagacgtgccagctgtggtgggatggagcgcaggcggacagaacagggtcagccagtaggttagatgcccgtatgaagccacaccactgaacacacagctgccccaaagaggagaaagtcaggccaagtgcagtggctcatgcctgtaatccccagcactttgggaggccaagatgggaggatcacttgaggccaggagtttgagaccagcctgggcaacagagtgagagcccccgtctccattttttttcttggaaaaaaaaaaaaaaaaaaacggtggagagagtccgagttaaaaaaggaacccgctgggtgaccaggaatccgggacatgccccgagcaccctgtactggggattttggagggttctctgcctcactgaggcagctggggctgctggctgggtcactgcaagaatgccttttttttttttttttttaattagacatggggtctctctctgtcacccaggcagaagtgtggtggtgggaccatagttcactgcagcctccaccttctgggctcaagtgatgctcccacctcagcccccagacactgagattacaggtgtgagccactgtgccccaccgcacctattcttgatacttgcacaaagcagttttccatcacagaagcctcggaaacatctcagtgaggggagtgcagggtctctggcaggatgggggagcttgaccaagggagggagctggtccctgcttccagcagcagagtttcactccaacatgtgcaacggcccaaaccaaagagtgactgtgtgccatctggttagaggaacccaagaattctagaggcatcagagtccctgatgctgacgtggggatcatgttcataagcaaacttgttttctgcacactcctgttttccatttaactttctttcagcagatgaaaatcagactgcacatgccaagcaaccagacactggcctgcagccttgggatgccagatgaaagggaaccccaggacagggggcaacatgcaagcctgtctagatccactctttagggacttgataactgtagcagacacccccactaggagcagtggtcacgaaagagctgaaacgcactgcgagagcaggaagcaggctcagctgtacccctccaaagctgtgaggtttctccagacctttctctctgctctgtgaaaacaacacaatagaggtgggcttgggtttccccattaagtgcttctggcactttctcacaagccccaggcagtggcaagccggtgtcccacagcaggcagggcgggttctcagaggccctgtgcgcacatggctgaagacacaaacatgttcaaacccaagtgctaattacactgtggacatgccagaagccagagacggcctggctccaccctgctgtcccgagtgcaagatgagtggcaagcggtgcccgtcacgggatccctctggaggcctttacatctggggaaaggtcctacctctaggcaaggaaatgagaacacagacctcgctgaagggacagggagtgaagggggatgtccccaaccaaaccgtccctgcagctccaggatgttcttaagcattctccgttactccccttactctgcccacctcccagtggggctctgagtccgcaggcctggccgtttccagcggtggaaaaagcccccggggcacctggaactgcagagttcactcagccagagcaaaggaagcagccctccactctagctgagctgtcaggcccttcctgctcctggcctctccaatccagcctccacactacttccgaggaacttctttggatgcacatcagagctgtcctacccttggaaccttccagacctttcccaaggctcccagaatgacacccagagcccgcaccccacaggcctgtgcgcctctccccactgccctgtcctgttccggcctccactcactgcccacgaccactgggaatcccttcagggcgtggcccaggcggttcccactgctcagggcactgtccttgtcctctcccatcacagtacagggctgtgcccgggatccccagaccacccgaggctccataattcgctacaaggactcacggaatgtggcacaaagttgccctcggggccaagggttattgaagggaacagagcaaaggaggctgagggagaaggcgctggggctggggtcctgagaaaccaggcaccagctttcaacgtcctgctccatgacgtcacacaggacgtgatacactcccccagggatgggcttgacggcatgtgtgaagtactgtctactggtgaagcaagccagggactcagtgcccagggctgtactactaagcaccctctacctagcacatggtgaaatttcagatgcccacaaggaaaggagaaggaaggccacactgtttgcacacagttcagacgtcggaagtcactcttatcagggagtggtaagagccctcctgaaacccaagttcccagctgccagccgcgggccaagctggcaagcatgcctccgagggacagcagtctcaggccagctctgttagccctttccactcaagggcaacccccctgtaaccgacccacagttccttcctcagagccttccctaacatccacaccctttgctcttccccaccgcaggacccagctctcattcctttgcagcgtttatcaaactgtgcaagtactgtgttcatctgctgacttgttcctgtgttgaaacatgggccccatgagggagggactgggcctgacacatttgccactgaccctgggcacatgacaccatccccggcaggttctcattaaggacctggtgaccgatcccaaggattctctctccagtcactgcagacgggcactaccagcatctctgttcagcctcactacaccctgatgatgtggattgagcaggaatcattaattccatttttgagacagagatttcctggaggccttgctgtgggaggtggtggaagagccccatcccgaaactacggccttctcgcatgatcacgaagcctgctaccccatcaggtccgccacccaaatggtcccgtatctgtgatcataaacgcacagaatgtaagatgcaggtacagaatgtaagatgcacgtacagatacctgctgcacaattagaagagccctgtcacccagcagcctggaaggtgctggctggacgcaaggcgtgagtgcagcaggggtctgacgcacagtgtgtcactgagtgacgcctcagcccacagcatgggtaaggaaacggaggctcagagaggttaactcactcgcccagtcagtcagcaagaaaagacaaagagagaatccagtccaaagctctttaaagccaaggtcctctccattccgtggctgggcctcagacgccatgggtgagggtcagaggcttttggtgggaggtggtggtgccttctgcctgggaagccccccagcacctcagctgcccgctcacacttctgcactctttccctggaaaatctccccctaccgcctgcagttcctccacactcacgtcccgaggaaggggtgccctgaggggtctggggctgggaacctgcagtttcaaggaccccggaaatcaggtgcaaacatttctcacatgtgaacatggacatcctgcccttcctgggccaatgttcctcaaacatcaaatggcgggaaggagcaggaacaactgcagttctgaaatggcccagagaggggacaggtgctggggagcccaggccggggggtggggcccatccacccagctcctggctgctccactcctggagaggcccttgggccctgggactgccatgaggacgccagccttgtttcactctataaacttcttccagacaaggagggctgattggaaaagctaattaaagcttttgaagattatctcagaactgaagcaaggaagaacacaaaataccctcccaccctgctcctccactccccagactctggccttcattaggctttgatttcaatcaattgcacacccactaaaattaacttataaggccaataaattgcaaccgcatgtttgaaggtattatctgctccaagccaagagccaaggacttcagagcattgggcgagatgtctggcgcagatgggagtaatcatctttggaagaaggcagtgccagccctttggtcagaacatctggtcccaggcagaacccggggccgacacaggccagggccagacttgatgtgaaagctggagcagggaaggtttcctatcttctccaggaacctgaaaaatcaaagtgttaatcttggggttcatggcagcccactggtcgctcacaccagcaagatgttcctctgacagctgctggtgcctgacctacagcaaagtctccacttctaagtctctcccaagaaagatcacttaggtcaaaagatgaggttttgtgactgatgagctagcctaggcttggacctaagaaagcagagtcggctctgctgagaaagagtgtcaaatgatcctccgagccagctgcccaggagtcggcccgctcggctgtcttcccctctgcctcagtgctcagttctcgtgacatcccctggatgagtcaggcccatcaattacaggcagaaaaccatcttggggcttggtagagagaatagcctagatgttggggaccaggtgggtgggctggctgggaggggaagtgatgaaaatgaaggtgacttgcgagcagataataccctcacctggccccagcacaccagcaaaatgtgcttgtcatctcctaagcatttgcgcaaactggctcttttcatctaaaaacaaggctgtttgggtagtgacagttactctcctagggaaagtactactatgatctctttctgcccctgaggatggcagagaagggaatcatcagcatggaagggacctggacgtgagaatgccgcagggacccagcagaggcagggcaagccaggagctagtggacttcagagggagccgtgaggacacacggctcagccccctgcacccctactcgccttttgcccaccttaaggagtcacgctcccaactgctagccctttcaatccacaggggagaggggctgccacatctccaaggagttacaagccagaaaggcctgctggtcaacccgtcccctggcccagctccatcattctgacattgattccatgtgcttatgattaaatccaactccctacaaagtcagagcctttacagagccagggatcaaagcccagagcctgaagacagaatctacgtctttccctcaggatccagtgaagaagatttttctctccggtggcagagggagcctctggggagacggtaagttctgctatctgaggaggctggtgtggcccgtgggctgcctggatcatgctctaggtctctggaccctcaagcctatctctttaccaatgtctcctttcacatattttttattttttagttttcttttttttttttccagagacaaggactcactctgtcacccaggctgagtgtatgatggcatgactatagctcactgtaaccttgaactcctgggctcaagcaatcctcctacctcagctgagtagctaggcctatgtgtgtgtgtgcctctatgcctgactaatgtttatattttattttttggaggtacagggtcttgctatgtcgcccaggctggtctcgagctcccggcctcaagcaatcctcctgcctcagcctcccaaagcaccactaatcttttcaagcagggcctcaaggagtaaggacaaagctaatgggttaatgggtggggggcaggcacctcgttcctgactgtggcacacacacggccagtgcctgtgggtgctacgtcagccgacaacaaacatgcccacagacagcaagtccagtcttctggcatgagccagcagggtacggcgggggcaggaacaggggcaagacagggtatccaaggcctctttattccttttcttgggtcaaatctctgtgtgagcaaagtccagtgtgaccttctcagcataaagagactttttaggccataaaacaagcggctccctggaggctggctgcagcacagtgtccccacgggaggattctgagctccaacgtggcaggagcctggcagctctcagtcattcgatggggttggtggtcatgaggctggagctcaagccaaacatagtcctgattgcgattcatcaggatccaacaattcagaagcacctggaatcgtgaattaaagaccctgtcaacacagtctgctcttccaacccccaaccaccaggggcgcaggccaagctctagcttgaagtgtgtggtctgaaagtggcagctgcacctgtgcagccctcctgggcacaagggcgagcccagcctgctctcaaggggtggcttctccggccactccccttttctcctggcagggtgggtctggctgaggctctggccatctctcacaggccggggacaccagccactttcctggcccctcaggcagcagctcagggtgaccaagccagcagacgggagcattgggtggaggtctcctctcagaatgacccttgcctgaacccatctgccaacctgaacagaagataggtgggagagctgtggccttgctcaggggacaacaaacaagtctttctgtgagaaagtgtttgtatggggaagggctagataaaagatgaagagaaagggatggcctactgcctctccaccccatggaacagcctggtccctagaaaaccgagtgtgaccctggccaatgcccctcaggagacaaggccacccagctgactcccctctgctccaaagccacggggaaaagagcttgcattccagggcctgctgtggtcacttatgtggccaccaacagcctcgcggggcactctgggaatgggaacttctggagatgagcaatgtaccacaatgtaccaagatgtttttaaaaaagaaaaaaaagagacttgttctcataatttttagactataaatgggttggttcgtcacatgtggttcagctgggaaaacgttcctcgcatgtggtcccaggagagagagctcttcagcacactccgatggcactgggtgagtcaaaattcatgcctctggtatcccggatggcagctccaactgctgtccctttggtggtctgcggtccctgtcacccaggaagagcctggccccactgcccctgcacatgcaaggtaaggaagggcctcctgcctctcctgcggggccactctcctccttcctcccgaggtgctgggaacagaacggcaccagcctggatcccactacacactgttgcagaccctcggggtctgggttatccagttcgacccccaactgggggcaggatgctgtcgtcacccctctttcaactcccccgagtcagtttaccttcagagaggagtgtgtaggcaagtcaaaggcacacagaaatcaaaagccaccttacaaatacacatttcccagggaagggaaaggcttcaccagaggcagcgtgaagagtgaggccttagctatgactcccggctcctgtggttttctagctgtgttaaccagcttgagtacttatctgagcctcagcttcatcagctgccaaatggaataactcccacttgtcctatagtcactgtaaggattcagtgattattctgaagagttttaatgatagtagggaaattctcatgataacaggccataaaagcccctgcagaaccatacaccatgtatcattacatatgtgaacgatgagatgggaagggagaacaagggaagcagaagtccaagatgaaactgggctcttccccaaggctggccctaaatggcgaagtaaggcaacacatctgattcactttattaagggagtaacaacatgaacacttaagtctcataaagaatcagaatcacccccacctccatatctcaacatgcagcccagtaataagccagagtacagcctcctcatagaacagaaggggtgaggccaggcaacttcctcaggcttaggggatgacacgcatggcacgttagctccccaagctgggggaaaatctagcaaacactttcaagggggaactttccacttccaccttcaaacttagctgaaagggcaggctgtattcctggagtatcctgagatggctcccaagaagcttacatataaaaggggccaattttgcccaaatctctttcaaattgacttccaatttaaaagaggctgagggtgtgcacttgctggttgacagctgtgtgtgcacattaaggggcaccagtctcagggccttagacaggtgagtttgcccctgcctcagagaccctggcacaaccagcccccctgcctggctggcttcctcaatgtcagacctcagtcaagtgtctcctcaagaggcctcatgggccactctacataacaagtcagctgctccctgttatcactagcagcaatgacttgttcactggtccactgtttgtttttccacaatggagtgtggtgagggcaggggcctcatctaccacgtacgaggtgcatccctggtactcagcaagcacccggctcatgggaggcactcaaatgtctgctgagtaaataaatcgatgttggactctggagctgggtaaggatggtttgatatcccagttccaccacttactagctctgtgaacctgggtaagttatatcacctttctgatctgtcagctcgtttgtaagagggggataaccctctctcatgggttcttgtgaagaccgaatgagacagagaatacctggaggcccacttgcatggccactggtaactgttatcatcaccatcgttattttattaccagtattatcactttaatattaaaccaattctacttgggcattcttgtttaatagctggattggcttcttaccaaatgggcaggtaaaagaagatagtaaaaaacaattacaagtaaactaccatagagcaatgagtcagcttttcagtatcactggggaaggaactattctacaataggacaaagttctagatgtaagaacctttaaaagactgaagcctattttaactgtgaaaatcaacaatttgtgggaatttcagataaatatgggttcaaattctagcttttcacctccatgtcctgtggtcttgtgtgagtcatttaacctcttggaaccttggtctcatttgtaaaaggaggaacaaaaccatcttccccagaggttcttgttaaggagtaaagataatgtatataaaatattcgtatataatagaactacagactgggggccaagccccacccacctcaaagctcaagaggtgaattttacattttaaaggttcaacagaaaacaaaccaagaagcagcaacagagaccttatgtggcctgcaaagcctaaaacgtttaggatctggttcttgacagaaaaaagtctgccaacttgaattagtattgcctattttacagttttgctgtattttcagtatagagcttaattataaatgagattctgttgattatggctaactttctctggagcccttccttgtaagcctgaacaattaagtgacatgttggtgctgtggtgctgggaggcaggattagacggagcaggaagaaatctcaacagatctagcaaaacgctttttaaggaaggtgccgaggccacaaacaactcaggattcaggaagatgtttgctgctctgctcctgctctgtaaggactgcacttatcttggcctgagagcagctggaggcagaggcccctgagctccaggtcagaagtgagcgtgtggtatggcaaaaaaatccatacgggcctttggagataaacaggtctgactttaattcctggctctaccccttgctgtggacaaatactttaatctgtgtcttaatttcttaatctgagaaacgaggactaaactagctatgtttgtgaggatttgagatgctatgtagaaatacctggcactgtttcttatacacagtaggcactgtaccagtggcacctgctgttattatgaatcacgatgcaggggaacagcacatagtgaagtctggtagcattctatgaccgagtcatctcataaccaacccaaccaccaaacgagtgccctgcatcctgctatgggaggctcccaattttagttaggtgagccaggtaacagattcaagggagaatgcttggccgggtaacagattcaagggagaatgcttggccaggtaacagattccagatagaacactgccacttaggatttacctctcaaaactcacaagcgctaaagtgcaacaggagaaaatgactcacaggtctcgatactggtcaaaggcattgttggcttccacctccagctttctcagccgagctgacggcatggccccatcctccaagggagggtcatacttgttactccatggtgacctggagggaaggaaggaaaagtatataccatgaatcgttccatgaagacacggccagcgagcagggagcctgagccctggctatctgaaatctcggaggcaaagccgctaactccagcaaagatttttctgggtcctggcaacaaacagggctttctggaggtttggagaacaagggctctgatgcgggcagactggggcacacgcccgtgctccacctctcactggctgtgaatgctcagcaagtgtcccaactccctgagcctcacttttctcctgcgtaaaatgcggctgctacttgctccgcacacagggtcgtcatgagaaatgagacaagcagatcaagcgcccagcccagagcttgccagactgtcagtgttcaacaaatgctagttctttcttacccgctttctcagttttgtgttcaccacctatttttttttctttcttttttttttttttttaagacagagtctagctctgtcgcccaggctggagtgcagtggcgtgatcttggctcaccacaacctccgcctcctgggttcaggcgattctcgtgcctcagcctcctgagtagctggaattgcaggtgcaagccaccaggcccagctaatttttgtatttttagtagaggcggagtttggccgtgtcggccaggctggtctcaaactcctggcctcaagtaatctccctgcctcagcctcccaaagtgctgggattataggtgtgagccaccgcgcctggccatgtgttcaccaccttatagttcaacagatgcccctctctcctccctgatttgctggaggctctacataaactttaagaccttcttacatagtaagcgttaagaagagagctgtcagttacagaggcgggcaagagatacagctccacagggaaatgctgattacattagaaaacctgagcaatcaggttctccacgtgaacacaggatagcttttccaacatccaagagctatgcacacatatgaagactgctaagtaatgagaaccagtctttttgcagcccaaaagacttgctgtatttcttgaaatgtattttgccacatcaggaaagcatttaatcacactgagaactggaaagggggttataagggaaagatctactcattaattcctgcaggtggggttcagagggccgagtgttcagagaaagtagcagaattaaaaaggtgagagaggaatgaaaagacagagaagacaacatggaattcagaaaaagtccttcacactcttggtctaaacgcctcgctgtttccactgtcagagacccacaatgccttttccgcatcccctcctgaccacatcattgtgatgtggaatgcatgttaaggaaaaaaaaagtatgctcatcatcttccaaaccccagttttaaagaattctgcacgcagacatctttcttcttggtaagtgatgctccaccaggcacctacgtcagtagatcatggagtatggaaccagaataagctgggcggcctcttccaccagccacccgcaggcagctttctcagaggctggttcacaaacggtatgtaggggaagagttgctgtgcttggtgtccccaaagagtctccaggcaggaattacactcctgatcacctcaaagcagaaggagccttggaaatccttgtttccaagctgaccactttctgctgctcaccgcagttttggtagagactttgcaagaatggggtgagacaccccctgctgccccatgagcagcagccagctttcatggtcacactgggccatcgcacaccatgggaagcaaactgtcaacaagctgggaccccagatggctgggaagacaggcgtgccgcccacaatcgatgcctcagttctcctgagaagccaagcgcgggctgacctgtcagttcttgtagcctgtcgctcctccctctgaaacggggctgcccaacagaacttcctgagacgatggagatgttctaaatctgtgctgtccaaaacaagtcactagccatgtgtagctacttgcatacttacaatgtgaccggtatgaccaagagactcaattcttaattttatttaatgggaatcaatttgaatgcagatagctcactctagaacctcagctaggaggcggcaagagccttttctgtcatcttctcttcgggttgctcagcacctagaacagtgcctggcactcaactacacgctcattaaaaaaaaaaatgtttttaagaatgaatttggccaggcgcggtagctcacacctgcaatcccagcaccttgggaggccgaggcgggaggatcacaaggtcaggagtttgagacaagcctggccaacatggtgaaaccccatctctactaaacatacaaaaaattagctgggtgtggtggcatgcacctgtaatcccagctactcaggaggctgaggcaggagaatcacttgaacccagaaggcggaggctgcagtgagctgagatcgcgccactgcactccagcctgggtgacagagcaagactccatctcggggaaacaaacaaaaaaaaatgaatgaattcttcttgtccaatcacagttgtaaataaataaaataaaaaagcatgaattcttgcacccccgcccccccaccacaacagaaccaaccactccctcctccctctcacacagatgttgatcctcatgcctgtcatatccttgcccttcttccctcaccctcgactgcaagaggtctttgacagcagagagcctgtgctgcctgcccttgtccccagtacccagccctgagttagtgccaagcagatgctgctggtggaccgaagcctcacagcccgggagaggaagaaaggggaattctgctggtgttccacttctccaaaccaagagatggagcagctttctggctttttcatgctggtcacgggcatggcgcccaggtgctgtccttcttgggagcatcttgctctgtcgcccaggctggagtgcagtgatgtgaacatggtccactgtacaggaccataggcatgtaccaccatgcccagctaattttttttttttttttttttttttttgagacagagtctcactctgttgcccaggttggagtgcagtggcatgatctcagctcactgcaacctgtgtctcctgggttcaagcagattctcctgcctcagcctcacctaagcactaaaaaacaaaaacaccaaatcaacaaaagcctctcatcagatctcagagacaaagatccaggtgaaaagatgctgtcgccatgatttatctataaacaaggcttggttcttctgctggccgggggagtggataagaatctgagggtgtggagctgaattccctccttcccctgggtggccctttgagactctgcagcacactcatacgcaggaccgttcccacagttcgatgacagccatcgccttcctgtaggctgggaagacccgacccaagtggcgttcatttcaaggcaccctgattagacacaagagcccatctttcgggcagactgggggcctgcaatttgcaagaagcctgtaactcacatttctactggctcacagacgatagcatttcaagctgttagtcctgaagccagggtaattgtagctgagggaaatatcataacattaaccagaatattcttagtggaaggggcactcagaacacacttaagagcttaaatggaggccatttgaaaaaagacagatggacaggaatgcctagatttcaaaagtcaggactttcatttccctccgagaaggctttttgtttcagctaacaggtttcaaacggtgctgctggcaacggtcacaccataaggatcttatttaagcaaaccatcaaacacagtcaggatggaaatctgtggacagaatcagaagaccttgaagtttcatatcgagaagaggagaaagaaagacatactttctgcctccacaccccaggctcctctctaaaggcctgagatcccccagagctggtggtagggcctcaggaatgcaggtgggggacaaaggggtgacctggaagggctgcaggtaccaagtctcccgcagagcctggcctagccacggacctagacatgatcccgtccttccaccagctcctgcagaacagctgccttacacagtcaactggagtttttaggtggaaataataaatataataatgatgttgattaagcaagaccagttcaaggaacacctcctccaggaagcgttccctgaactgcatgccgggcgagaatacttctccctgcctgctccctggtctgtcagaccactcaccatcttcactggacttctctctctaagggctggtccacccacttcatcagtggctccctggctgggcaatgtggctcacacctgtaatcctagcaatttgggaagctgaagtgggaggactgcttgaacctaggagttcgaggccagcctgggcaacaaaatgaggcccccatctctacaaaaaaaaaaaaaaaaggagagagaaaaagtcaaaaaaattagctggggctgggcgcagtggctcatgcctataatcctgacattttgggaagccaaggcaggaggatcatttgaggtcaggagttcaagaccagcctggccaacgtggtgaaaccctgtctgcactgaaaatacaaagactagctgggagcgatggcgtacacccgtaatcccagctacttgggaggctgaggcaggagaatctgcttgaacccaggagacagaggttgcagtgagctgagatcgtgccactgcactccaacctggacaacagagtgagactctgtctcaaaaaaaaaaaaaaaaaaaattagctgggcatggtgatacatgcctatggtcttgtgcagggggccatgttcgcatcactgcactacagcctgggcgacagagcaagatgctcccaaggacagcacctggacgccatgctgtgaccagcagttccaggcacagaatgagcccttcaaggatgaatttgatcggcctcagggctgtatcaccatctatatgctgggacatctgcagccacatccccagcctaaacctctctcctggaactccacatggtacatccacagcctacctggtatctccactttgatctaatgggcctctcaagcttaaagtgtccctatgcctgctcctccccgagtcctcctcacctcaatcaacagtggctcaggtccgaagccttgtaatcacccttcacaccccacctcctcttcttccatccccacctacctgcagaggccgctggctctacttttaaaagtgacctcaaatctcaccacttctcaccatttcaactctagtctgtggtctgaaggagggcaaaatataatctctacctaatttccatttaaagccaggaaagggacatgattataaaactgttgtctagtctcttataagtcagtattaaactttttaagtatatgacaatgtctgtgccattcaacatttcacgtgtgttacttcttttatccccccaataaataaccctgtgctaacttttattaccctcagcctggccttcaagaccctgccagacctgccctggccatgcctcctccctcatctccgcccccactgccctcccctcactgccttctccacctctggccttctgccagctccatcctggtgagctcatcacccagggcctcagcacccagcaggctcttccccagacctggaccttttcatcctccagttcccacttgtgggagagccttccctgcctgcccgtcctctccctccctcccactgtcctctttattttcttcaggaagcattctgttgagtaaagaaacactactatttccgttttacagatgacaaaactaaaagaccagcgacaataagtgatttgtcaaagtcccattgacacagggagctgtgctggtttgaagcccacactggctgactcctgatcatttttcctgctttgacttcccagaagccttgccccatctccaaagagagcatcagggtgaagcttcaagacaaccctggttctgtggtctccaaataaacctaaagcaggctgtgttcctctaccattctccaaggcagtgactactgcaattcatcatggaaacactgggccagtttaaggattcccactcttaaaaaatagaggtataactcctacatgcccttaaaacccagctcagacatcacctccttcaggaagtcctcctggagttgaccatggcctcttctgtgctaccgtcccaccctgaacagactttgcactggctgtatgaatcacatcatacagttaccagttacccaatgtgtctcctatgctagacctggtgatcagacacccagggcagggactaatgtcaacttagttatttacagccttgggcgaggtgacggaaagagagaggagagttgtgtatctgacagagctgcgttcgtagatcccttaccacagagaccctcccagccctcaggatccccatcatatgcgcaccctgtacactgccctccgcaggactgaatgcaattataatagaacagttgtttttgaacaacatccctctcccgttagactggaagatccatgaaggcagggggcctttggtccgctgctctatctctcatgcttgtgggtggcactcttcaaacgtctgctgcatgattggaataacagatggaacgatgagaagaatggggaggacaagagaagaaaggagaggagggcagggaacaaacggaaggaaagctgaatgggctgccagctgcccaagtccaaggtccccgtgctctgcagcaggtacctacggcagcccgcgtgtgcctgctgtgcctgctgcatccccggggcatgagctcacctataggagtccccatctctgttgtagtcacacaaaaggtaatcctttcccaccaccttgtctctggcaattttcagtggctggtcaacagaagacaggagatcctcacatagactggggacctggcagagagaaaggacaaggtcgaaacagaggttaaaacagcacaccaaactcaggtggctaacaatactgcagccatattgtggtcagtacctttaacatctggccctgggcactgagacaaaattatgggcctgttcttttcttttccacatgtgtctgacaccaactgtgtccctctataaagaaacccattcttgaattacagtggagcgtgatttctaatacagtcttccttccaaaaactgtgtgcagctttaattacctggtcaccagggtggcctagtaaatttaagtgtgtatgtgcttggtattggtctctggtgggcaaagtacaagctgaagtcccgagaagaaggtaaacatttcaaatacacaggaatctaaagaactcggagtagaaaaactcgtccgtgccgggaactcccacaggctcctatgctgggtggagtctccagtactttccaggcccctagccaagtgttaccagttggcttgtagagtcaactctatctgctgcaaagagagcttcaccccggctcccccacagcacagagccccagtgggctcacctccggctggcctgccagggggccgcctcaccaagaaagatgaccccgcggtcgggggctggcaggactcaaactctgggccaatgttgcgactctgacacaaggctctgcaagtaaccaggccactggcctcctcctcccaactcaaacatcaatttctaccaaaatatcccagaaagggatggcagcactttcagaaatggattccttcaggcctgagtcacttccacgctatattttcaatgtgctgacttatttgtttcatgggcctgggtttatgggggctccaccatatcgtttaccaggaaagtgcctgccagttgcaccaataacccttcccagtggaaaaattccatcgtatggcaaagacaccagcagagcagctcagcagacgggctgacagcgacagtggttcctgtgttcttccagaaggcccttgccaccatccaagagacaggcagggacagggagtcccaccaccacagggaccacccagcctccacgggctcctctgctgcccctccagggtgctttagaactcagcttggaaagcaacgcccagcacaactaaaggactgtaaccctgcctcataactcacagaaattctggccttggtgagatgatctgtttcttatacaggggacagtacccaaagagatagacatacaccaccaacccctgtgtacaatgtgctgggcttacaggtgtgagcccccaggcctggcctgtacctgtgcttgttttcagaattctttctccatgtgtatctgccctttcctaacaaacataataaaaatgggggctactttcaaagttggttttggtgataatatcatgcaccttaccatttccatgtgcctgccatgcaccacgcactatggtagagcatattgttgacttgaaagctcacacgcattctgcaaagtgggtatgcaaagccccattttacagattagagttgaggccgggagccataaagttacccaagggccacacaagaagcaagcagtggagacagaaaacaaaaccagggccagatgagtccaaagtccctactcctcctactctaactttggtttaatgtccagctaaggggaaggacagtgcatgctaaaggcaccctctggtggcaaacagccctctcctagccccagccctgcttagctgtggccacagagcccttcaactggaaggaagtcctggctgaggaaggaaggtctaacagcttccacccgaggccatctgggacctgaaagaggccttgctgtgctgccacagccaatgaagccacctcacctaacacatcatgcctgtccctaagcatctctgtttataatgctgggatgctgccttggcttatctgttgggcctcaacttttgcctggaacccattctctctggttggagtcctgacaccatcagctcaatttttcctcaattacagtagagactgagcaaacagggtctgaagttagacctcctgactccgctgcgtacaagtagccttatggcctgggtaagtcattttacttctctactaagacttggtttccgtacctgtaaaatggggataataaaaccaacccatctgggtgcccatgcccatgtgattttgaggacccacatgacacaatgcattccgtgttcagggcagagcctggcacagggaaatgcacgtatgttactgcctgacacgttcaggttcctttcccttcctttagacaatatcatctgtcacctgttactctcagatggcaacaatagcctggatcatacctgaattcactgtgctgcttcagacacagggtacaaacgtacctgtgaggatccggtgcttcaccccagttccacctggagccagctgtttcccttctcctgccaggcacactgcttgcagctaagtcccctcaacgtaggaaagctcacaagaaaatagggtttggtataaaagaggcttgactctactcctatccaagagattcatctatgaatcgaaagcatctgagtaatctcttcctagcacttaacaccaggtggagtattttttcattgatcagttatctgtatccctcactagaatgtaagttttactggggcaaggacttcgatcttactcactgcaggattctcagtgcctgtggctgtgcctgacacacagcaaatgcttaatatatttgggaggaaggaaagaaaggagggaaagagggaggaaaggaggagttttacaacacggagcctcccaaactccaatcaactttactttaaaattaataaattggcaggtaataggaatctttagcaaaagcacttgtccagaactaaatctgaatggatgctgatgacaagtttcctgtgtggttccaacccagcactctcagatatgaaccatggtatggtgggaaagcactgaacaaagagaaccggagctgtcatgaaagccctggcattttttattaacatatgacctcaaggagccacagcattggtggaaagagtgagaactaagagacctgggttctagcctctgctctgctgtgagctggccacggaaccttaggcaaagcccaagactgttcatttgtcaaacacagtagatgagctgcacggagacagaccacccttgaagatctgtgatgggacttctgaaagccagtatgccaggtactaaccaaccccagaaaaacatacatttaaactggaactcaaaaactggcactgcttgtcctacagtgaaaagcctctgggacttgatatggccaacggactccacccaagcaggcaccatttttgccttttggatcaactcttaagctgggccatagttttggccatatttccatcagcgctgtttcttttgatcaaagataatctgctctggaataataacattttcgttgtcatggggaatgagaaatgtggaataatacatggtgtgcccacagacttggaccacagcagctgcccaaaggtgcattagtcacgacctggcaccatcactgatcccgtctcatacccacgccgtccctccacctctgcccgaaactcctcaaacaaccacacggtcccattcaccactccctgaacatgcacgtgcattcccccacttaaacatcttccccattgagggttgctggataaaacagagggaggccagttcagtctgaatttcagatacacaatgaataacattttagtatgactacttcctaaaggttacatgggtcgtgtgttttttttttctcaatgagatggagtccagctctgtcacccaggctggagtgcagtggcgcgatctcggctcactgcaagctccgcctcccaggttcatgccattctcctgcctcagcctcccgagtagctgggattacaggtgtgtgccaccacgcccagctaatttttctatttttagtaaagatggggtttcaccacgttagccaggatggtctctatctcctaacctcatgatccacccacctcggccacccaaagtgctaggattacaggtgtgagccactgcgcctggccaggccatgtatttttatttgctaaatctgacagccaatccccactgctctcttaaatcttactgatccttcagggcctggcccaaactccaacttctttatcaagatgtcaaattcttcagaattcctgcagtaacactaatatcaactgaatcctaaatgctttggggatggctgttctaatactgccaatgactttcaccttactccttcctcaccacttagcatttttcattgtgaattgactccacacctacagaggccaagacaggccctccagcctcagcgcagcatcacgcccgctgcagcagggatcagtcaatgcatgctgattccatgtaagtggatattaatcctgtggtctgaggccatattacagaaccagaatgaaggcagtgtatctctgtaatctaaccagtccctacactcatctgaaccccggcccccgccccctactcatgtcgagtgcttagagcagtggaagaaatcacattaagtgtcacagaccatgggtttgtacagtgatttaaatgaaacgacaggtccaaacaaagccgagagttcactttggggtgcatgtggcactggctctgtcgcctccaaagccagggagggcctctgaggaggaggagcggtgctgacacgcggcagccggatggtttctgtctaaaccacccatctgaactgcctaacggccttggagggaaggttcagataacaccaaaggtgtcagaccaatccaggctgttggggggatttaaacataattcccagtgacttggaataataaacactacactggtcaggacagtgcctgccgtctttctggtgggagttcagggctccaccagttcctctgctgccacaggagtgtgcccaccccagggagcaggagccacaagtccttcaccaccgatacttttgccgggctcggtggtacccaggaggccactggaaagacgggtggggagtgggtaaagtgaactagggcagggaaaagaaaaaaccccagaaggtagaaggtaagggagagactaggatgccattggcaacggcctcaggtgacacctgaataataatccgtggaaggaccaggtgatcgtaatagccctgccctgcgtggcaggcactatgctagcagctctccctgcccttccctatgatcctgacaatggctcttcacacagacacgcactccagtccttgttttaaagaaggggaaacagggccttagagaaataacttgaccggagccacgcagctacgggccaatgtctgaggaaggacatgcagttatatacagcacagctaggttcaaaaagaaactgcttttcccaaactgaacactttttttttttcttaaatcatccaacccaacagctgatcacacgaagagatacaaatcagaagtttccggccacaagtgaggttcgtgtttgtgccgccatatggttctactttgcctcttcctcttctccattagttattaatgttgaaaaaaattgttcaaccagaaaaagaaacttgagatgaacccttaaaaaaagcacaaaagccagagcagctcagacccacggagtctaacccacggcgcccttgtctttaagaagtgcacccttgtacctcggttttttaaaaaatggccaaatgaacacattccatcttttgatctgcctgttggccgagagcccaccaccagcaagataggaatcaaaaacagattctgcgtacttgggtgcactcagaggaaactgccacgccagaatgctgcagctgccgacgtccagcagagggctctgtgacaatttgttccttttatttttccagaaggcccaaaactttcttaaaaagataaaagagcatttcaagtggcacatacactcgtgtcagaaacaaaatatacagtgtggcattctgtaaaaacaccaacctcgaaaccgaacaggttcaaatcctcggtcagtcacttgctggctgagtgtaaccttcctaagtctctggaactgggggttacaacatccatgtcaaggagaaattcacactgttccataaaccccgaatgcccgctccaggcccgtgtcaggtgcaagggctcagcacgggaagagatggacatgggcggccctgctctgacagcaaagtccagccacagaggcatctccaagaggcaagggtaggccaggcatggtggctcacgcctgtaaccagcactttgggaggctgaggagggtggatcacttgagttcaggagttcaagaccagcctggccaatgtggcaaaaccccatctctactaaaaatatacaaaaattagccaggtgtggtggtgcatgcctataatcccagctactcaggaggccgaagcaggagaatcacttgaatctgggagatagaggttgccgtgagccaagactgtgtcactgcactgtagcctgtgcgacacagagagactctgtctcaaggtaaaaaaaaaaaaaaaaaaagaggcaggaagcgaacctgcaggagacgacagaagggggttgctgtgggggcaagtcagcagtctaggaggtggcacagagatgacatgtgaataatgaccaaggagccggccctccaagactgcagggaaaaataacaggggcatcccaagaagagggaagagctggcatgaggctctgctgcagaggccactgaggcaagtgcaagaacagagaggagcaaagcgcggctggagtgagacccagtgaggcagcacgcagcacctcctgggtcactccaagtgtgagggcaggccctggcacactgcttttcttaagaattaaaaaaaaaaaaaaaaaaaggccagctgcggtggctcgcttgagatcaagagttcgagaccagcctgggcaacagggcaagactccgtccctactaaaataataataataaaaatagccaggcatggtggcatgttcctgtagtcccagctactcaggaggctagggtgggaggattgtttgaacccgggaagtcgaggctgcagtgagccgtgtttgcaccacagtactccagcctgggtgacagagtaagaacctgactcaagaaaaaaagtgtttacttatgtataataggtaatacattcacataggtcagaattcaaaaaggtacaagagcacatgctgggaaaggcctcccagtgagggcctgcaagctggctgtcctcgcctagggagatggcctccaggtcaggatcccttcagtggggctcccttcaccggtctgtccagatggacacatggcctccaccagcctatgagagatgcaggaatccccaccccaccaccactacttagtgtagagaaaacacaagcctgctccccaactccccaagggcagcttcgttacagggaccccagtttgtcattaggaacactgagccacggaagcacagcttcatgtagccgaggctggagcttccgacccattttgcctaatggctctctgagcatggccacctctgcaatgagaaggcacctgcacaggcggcagcttcgcgccgggcctgaaagtcacacccgggtggccaagcttgtttttggacgggaagcagctgtgctcccagagactcaggcaagtggtacccctgagtaaccagagggggaccccaggggctcccgctcaccccaggaagcatcaaaacatatctccttaggataatagccacgtgagctagggtatggcgcacctattcggaggcaggattgagggcaccccccaacctgtggatgagaaaacccaggcacggggaagctgctggccccggctgtcccagccaacacgaggtggagaggaatgagaatctcaatttgagactgacccagctcttccaaagaccaggccccaccgggtcaacaaggcgagctgcccccatccccagtcaggctcaggggacaggggaggaaaaaagaatagaattgggggaattatgggactgtgaggaccaaagctttttcccccaagtgcccggtcacggcagacccaaggtgcctggggtcgcctgggaagggctgcagggctgggctctcctgcccctcaccacagcccacagcccacagcagatccgacatgtgacctttccactctgggcctcggggactcctggcgtgtgggcaggggctcagtgcctactgcccagcagagcctagtgagaaactggccccccgcctgccagggccacacacaagaggacacttccaggtccagcctctctcctctttaagaagtcacttggcgctgagggccatatttttttgttttgttttgtttttgagacgaagtctcgctctgttgcccaggctggagtgcagtggcgcgatctcggctcactgcaacctctgcctcccaggttcaagtgattctcctgcctcagcctcatgagtagctgggattataagtgtgcaccaccatgcccagctaatttttatatgtttatagagatggggtttcaccatgttggccaggttggtctcaggtgatccgtcctccttgccctctcaaagtgctgggattacaggcatgagccaccgcgcctggccaagggccatattctttaagtgcaagcacagcctgctttcttcctgtgaaggctgtaagttgtaagatgcaccagtaattataacatcgctaagtgtacacattaagtgtaagaagcaatttcccaattttggcaacattaaaacgcaagcgatggctgggcacagtggctcacgcctgtaatcccagcactctgggaggctgaggtgggcggatcacctgaggtcaggagtttgagaccaacctggccaacatagtgaaacgctgtttctactaaaaatacaaaaattagccgggcgtggtggcgcaggcctgtaatcagctacttgggaggctgaggcagaattgcttgaatccaggaggcggaggttgcagtgagcagagatcgcgccacagcacttcagcctgggtgacagagcaagactctgtctcaaaatacaaaacaaaacaaaacaaacaaacaaaaaaagtgagcaagccacgcaacatagatttgagataatggtacatacagcacatctggcggagtaacacagatgtttctgacttaagatttttttgattctgcgatagtattcagtagaagctgtagtttgaattttgatcttttcctgggctagcgatgcacggtctgatcctccctcatgacgcagggagacagcagctcccacagctccccacaagccctgtgatcaaaaaggtgagcgatgacactctacagccaccgcgcgccaggtgctttcaccaaactgtaggtgtgttctgagcacatttagggtcagccagcctaagccacgacgcttggcaggttagggggattaaaagcattttctacttccagtggatttttcgtcacgtaaccccttcgagggtgcagcagcatctgtacctgctcatatgaggcacatgactcaaggcgggggttgtggttggttacctagggtttaatacaactgaggctggccgagagggccaacattaggaagccatttttgaccaacaaatgatttattctacttagaaatgagtcttccacatgccattaacaacaaagagctttttcaggaaacggtaagtcccctccatctctttcttttctcagacaggtgccctgaccatccagagataaataataaacaaaagcaggcctcctgggctcgctttcagccattcatactccaaaccccaaagctttgccctctggaatctcacagcctggaaggggccacaacggtttcctaaagaaagggtcaggaaggggcagaacaaagaagacaaatggaaaggagaaatgaaaatcactacatttgggtcaaccacaggcacacacaaggctcctgttgtccacatgtaaccttaagcttccctgaaggggatgaaccaggccctcggagcctaattaaatgaaccatttcctggccaggcacacaacccatcacctgtgtgcagagaagccagggtctctctaagctcccggctgcttttaattaaggactcgtccctgagagatgaagcacaacatacaaaaccaccttcgagtcaccagaatggaagtcatcttggacttagtgctgagaactgcctgcagccggccagccagccggcaggagaagctgccgcctacagccaggcgatggcctcaggctaaggagcacagggaggctcccctgactcaggcttgccccacacccagcatcctgcatgtctatccagaccacctttcttccccgtgttccacctaagtcatccttcagggtctgattcggccacgcctgcctcttccactgcaacctcccaaagccgcgacggcagaggccgttgccccgcctctactcctgcaccctgtgcaggatgcggtcttgagcctcacaggtttgtgacatgcatgtgtctccccagggcagtgatgagctgtctggacggcctcatgcccggcttgatgctggcaggacttctgaagcgttggtgggatggtgtgggatggtggaaaactagggccacttgggtcaggttctgatcttttgaagcccaagcctgccttggtgggaagcaagttctcagcactcttcagcacctcccttaaaggagggactattcttcggtgagtgggagacagaccgaaacttgacgtggatggcatttcatcttcctgactgccagccctgagttggatgaaggtgtgcacccactgggcgtgggctgccgcctgctgtggagctgccgctgcccctcgtaccctacacaggctcctcctaaagccagacccgcagccttcccagcatgaaggcaagcacggggtagctgctgttctcttcccggacggtcctcagtcctcggtccagctttctcagtccacatttttattaaggattattggccagacgcagtggctcatgcctgtaatcccagcactttgggaggccgaggcaggaggatcacttgaggccaggagttcgagaccagcctgaccaacacggtgaaaccccacctctaataaaaatacaaaaaaaaaaaaaaaaagaaattaggcactgtggcgagcacctgtaatcccagctactcaggagactaagggaggagaatcgcttgaacctgggaggcggagggtgcagtgagccgagatggcgccactacactccagcctgggtgacagagaggactctgtctcaaaaaattaaaaaaaaaaagattatcgtattggcttgtattcttctgtcacctgaaatctttttgggaaaagaccaggtaaaaatacacaaacataactcatatataagttgatttttctccaaagacactgtaatttcacagaggatctctgtcctctcgtttaagtgaaaagatacatagtgaaaccaaatttttgttctcgtcaacattttaatgaaacattattcaagggcctgctgtaggtcataattcccaagaacctatggacaacattaagtgaggacttactgaactatcaaagttatgattggaataacagcaaagatgtttaggtcttaccatttaaaaggcatgtaacacacatcctcattttatcatcacagcaaccctgcagaaggcaggggtgttattatcccacattactgtttacaggtgaaaaaaagaggcacaggtaggttaagcaacttggctatggtcacacagcaggtaattcaatgaaagccatgcgatcccaccctaaggccgtgcggactctagaatgacacctggtgagtaacctagcaggcaaaataattcagctgaaagagtcaccagctggatggtggcagagagaagtacttggcaagattggtttttcacacaaggtcaacgcgaacggaacctctcataccagccacctactagggtacagcatcaagacctaatttcagggagggaaatgggaaatgcatccatttcatcatcactggatactaagggttaggcctggcctcaggctttataaaccacatgtgtgccaaatgtccacgtctaaacctagagtttagggtgaaaactatgaatgggctaccatggaagttacaaaataagaatgcagggggaagcctgagggcgcgcgccacccgaatgcgggaggagccagatggggcagcataggaagggctgttctttaccactgatctggggggctcatgatcgcccagagggacagaccaacagcatcggggtctgtgggttgatattcatctgcacgtcgacactggtggggatgccagggaaatctcacatgttctgtttagcagaaacgagacacctgaggcagaaagtgacaataaggagtcacacggccaggcaaccatgggcaatggcaacgcaggggatactttagaatctgaaagcctgtgaaacaccctcaagtccgagaggatctgctccatgatgaggaactccgtgacctccagggcccacacacggaggtgagccacagtcatcctgccacacctgctcagtctcccgatgagccaggcgaggtgctgagccctgtactcctcgccccaggggtcctgatagccccttgggaggcgaatgacctttgaagccacagcagaggctgaccagctcagagcacggagccactgagtcagagggcggaggtctggcttcctccaacagattctccaaaaatcctcacgatcacaagcttctaaacctccatgacctaccatgattccagtaatacttctgtttcccttcaagtgggagtgtttgtgccatgtttacgtgtctgagtgggggagcgggtgctaaggcagactcaacaagtcgggttgcttcgctgttctcagcacaaaagtcacccaggctgtctggccacaatgtttcacactggattccttccactggagggatgtctcatcaggttttgctgtaatttcactgagtcacccatagaaacgaccaagcaggggagactggaggggacatctccagggggccacatctgagctgagttacagaaagtgaggcagggctggcagttagggcaggtcgcaaagcagcccaaggactaaggtgcagacagagagcatctctgtctgtcaaaggcagacagcgtgggatgccgaatgctgatagctgcacaactctttttttttttttttgtcacccaggctgcagtgcaatggagcgatctcgagtaccgcaacctccgcctcccaggttcaagcaagtctcctgcctcagcctcccgagtagctgggactacaggtgcttgccaccatgcttggctaatttttttattttttagtagagacagggtttcaccatgttggtcaggctggtcttgaactcctggactcaagtgatccgcctgtcttgccctcccgaagtgctgggattacaggcatgagccaccatgcccagctagctgcacaactcttgcgtgtgctaaaaaccattggaccgtacactttaaaagtgtaaatgttatgttatgtgaattatatctccagaaagctgttgttaagaaggtgaatcaagagaggatattttaggcagagagaaccacatggatccaagacatcacaggtagacatccaggaaaccaacagtttcagaatacgagtacgtcatgtgacccagagttaggttggtaaaaagtgaccctgggtgtcaggaaccatgggcagtgttgtctttctcctcactctcagtcgtagctgtttgactcttcactcttactacccagagcttttcctacatcaaaataaaccaaggtactgcagggacttgccactggcctggaagtcagagctggttctgccatgaaacggtgctacatggggcatgggccacagctccctggtctctgcaatggatggttctctgagagaggagcactttgagggctgtgagtacagagggaggagctcagggtgtcaagagtgggagaggaagtctgggcctaccaccttctacctggtttattcaagttctaagattttgcttaaaaaaagggctgtaccaattttccaaatgtttgaaaaccactagatgagataatcggtaaggttcattttagtgttgacatcctacgaagtttcatagttcaagacttgagagttactcaaaagtttgtgtcatccctcctaaaacaaacctttactaagcaaggtactctgaggctcaaaccaactgtggactgcccagctcttcggttcacagccttaggacacagatgcaagcagctgagtgagttattcacaagaaggggaagaaggaaaaggcttggaacccataatcttctcccctgaatgccatgttcaaatttaaactcttagggaatttctatatttgtatacagaatccaaattcccttctcttttctcttccaggagagattccgagcccaccccttgcctgcctccgagacctcaacaccatcctgcttactaaagggagcccagtttttcccgctacccatggcacaggtcttcgtcaatttcagtgtgcccttcatgaatctggcatgtggtcactggcagttaaagggggtgatgatggagaggagaaaccccaggctccaactacaaaaccctgcgggacacgcaggctcctctgggcttcccggcccacattcctggcctatttcaaacatcagggaagcagactgagcgtgccatgccctcctcaagtatttttaacctgtttccaaaaccagacatgttctaaggggggcgacccaggaattcctcatccagggccagtgcctgccaaccgcgagatgttggctttctaacagctctgaggagggagttgttgtctgccttttctggcacgtggggaagtgggatctctctccaattcacttttacgtctcacatttctcatcaaccagagggcaggatctaacttaaagtgagagtcttcagaccatcctcaatggaagctctccaaacactgttctccggcttccaacaacaacaggagtccataaggttccccaaatgaaggacctggatagatcttgtaggaaaaaaaatcctatgaggacaaggccaaggaacgggcctatatgcacttcacttgaattatgcctcctggctctaggtgacaagagccatctttttcaccactggagagctcagcctcctaccaccttgccccgatcctgacctggttcagattcctcgctaacatacttctctcaccttgtagcactgttgcacattgaacaggagggaaaagctcttttgttcattttccttagaatggaaccaaaatgatactccagtagctccatctaaaagctcaagtggcagctaacagcacggacaccaggggcatcccttgccagcttccaatgccatggtgagagacactcatcatggtttaaaaaaagaccagagagcattttcacaagcaattcctaagagacttaaatttcctacacataggcagaataaaaaccaaaaaggaaaaaaaaaaaacttcccccaaacaaaagtgagggctttcaaggagacttgctgagtgggcaaacattttggaaagatggaattttaaacacaaacacaaaagggcaaagatttgcagcagaagagctatgcacacagccgggaggactttaattagggaaagctttgcaaagcccagggagcatcagcatcggcaaatctccccttggtctccggaatggaaagaatgtggaaaccaatgggtgatcaaggagttcgaattttgcctgacactcttgctgggaatgaagcatgcagtcctgtcttttgccaccttttcagcagcctcaggtgagccttttaaaaaggtgaaaaacgaaggaccacctagcctgggagaagccagggtggatcctctccttcctagggtgcttcctgcagatggcacacagccaaagctcttctggtgttttaaggcagaaacagaattcaggggaggactaaacaacccctttagagctacgtgctgtgttttttgtttgcatttttccaagtccaggcatttttccaggtatttccaatgagactgaaatggcctacacataggctgacgacctataataacataagaaagtgatgttggccccctgctccacccagaggggacatctgcttatttggcttccaggtggtgggagcagtggttttccccaaacagctaatacccttcaattctttgctttctgtatcatgaagttcactggagtttggagcacagactctttaaaccagtaatttaactctacttttgaggataccctatgcccccagcagttatgagaagggttgccaaatcttaactcataagggtgacaggatcaggaacaaaggcctggactctccacccttctcctctgccaaaatctacgagttcaggaaaatggcaagccaggagtttactttaggttccctcaagagcagcagctgttcccaccagggctgcgaaggaatcaacaggaactgagagaacacctgaatggtctgattcagaaagtcccagctccctgtgaggtcaataaagaactttgtctcaacagaggcaacaaggccactgcctcctaggaaaggactgatgtgggcttttctagaggcaggcaggctcttggatcaacaggcttacaagggcacatttctcagttacgatcttaaaattgcagggaacctgctgatctctgtcccttacccatctagaaagtctgagtgggagctaacagctgatcctcagcaaaaccagagtgtgcgcccatcacctgctttctggtaagggacccatgtggcctgaatcaaaactcaaagctcactagacaccaattcacacgctctatctaatcaggcagaaacccagctgctcctgctcagtccctgcccagctagtaccttcccaccacccaccagctgtatctcaggctctgcccactctaagctttccctgggatttgcctgccaagggtgggccacggtgtcctctgtggtgctctgcagtgcccatgttcctcacatcagaagccttgcattctggctgggagcggtggctcacctctgtaatcccagcactttggaaggccgaggcgggtagatcacctgaggtcaggagttcgagaccagcatggccaacatggtgaaactccatctctactaaaaatacaaaaaattagctgggggtggtggcaggcacctgtaatcccagctacttgggaggctgaggcaggagaattgcttgaaccagggaggcagaggttgcagtgagccaagattgtgccatcacactccagcctgggcaacaagaacaaaactccatctctaaaacaaaacaaaaaaaaagaagccttgcattctatccatcctgggttatctggctcccaccgtggctatgagctctttaaagacacaactattctgttgtcactctgaccctggtgcttcagcttaggcagggccttgcattcatgggggctcaagtaggcatgcactcactgaatgtccgcttcaggcttgacagtggggatacaaaggtgaacaaaagaaaagatccctgccctccaagagccaaagctcctaggatggagcaagtccaagagacaggagaagcaaggggcatgctggggggcagggtgagggaagtgaggctccagcggagatgggaagatgagcagttagagggagcagagttggtgtggacatgtgtcccagtcaaggaaacggcatgtacaaagatgcaacaagacagggcacaggcctgggagtgtgcaagacaaggagacaggaggaaggggcagggccagatcaagagctcttccacctagatgtgttctccgggcttgatcccgacaatgtggagtcattaagggacattatccgaagtgcattttggcaagactactctgtatgcagagcaggcaggggatgacaggcaggaaggcctgtctacaggctattataacactccagtaatgcagggaggagcagtagcaataaacattcattgaactgctctaaaatgaggattgggacataccttcacccaacaggctggataaggtggatggcactctgtaaaaaagtgaccccgctttgggcaggtggaactacatctccactggccttcagcagcctgagctgcacccagtgccccttctgcctgcctccctcctggactccagccgcagttcctccctgtcacatgccctacttaacgcctgcagcatcaagactcaagaggttgaagtacaagaggtaacagtagtaggccgggcacggtggcatcacttgaggtcgggagtttgagactagcctggccaacatggtgaaatctcgtctctactaaatatacaaaaattagctggctatagtggtacacacctgtagtcccagctactcgggaggctgaagcaggagaatcgcttgaattgggcaggcagaagttgcagtgagccaagatcgtacaactgcactccagcctgggagacagactgagactccatctcaaaaaaaaaaaaaaaaaaaaaaaaaatatggctgggcgcagtggctcatgcctgtaatctcagcactttgggaggccgaggcaggcagatcacttgaggtcaggagtttgaaaccagcctggccaaattggtaaaaccgcatctctactaaaaatacaaaacttagccaggcacggtggtacaggccagtagttccagctattccagacgctgaggctggagaatcacttgaactcgggaggtggaggctgcagtgagacgagatcacgccactgtactccagcctgggtgacagagcaaaactccatgttaaaaaaaaaaaaaaaaaaaaagaggtaatgggaaaaatgctcgcttgtcattgcaagatctgagctcacctcacagtccctctcccacctggaagaaggcaggacatttcagagcccgatcaagcagcattcacccacctatctggccaaacagggaaacgcaggctgcttttgacaaggggcacgcaccctcctccttaaaaggacagctcagcaatcatgggaaagcagtggattccagccgctcctgtcagggattccaccaccttctttggatgatttgcaccaagtattttccctacatgacttcctttaatattcacaattgtcctcttttagagtgaggcaaatccagaattctctccattacacagatgaggaaactgaggcctggagtctggtagcttaccgagggtcacctagatattcaggatgcatgctcccagccccagctaactcatgactccgtgaccttaaagactctgtccatatactgccacctgccgggaccaccagcccttgagtcccaggggctgaggtctcctgagtcatagctcagctccaagaggcatccgtcccttctcatctctgggtctcagatcacacagcctagaatgtctaatgtggactcccctcagaatttggggatagcagggtttttggttcattatctcatatttatttgtggccatatcgacatgtggccaggcactgtgttagggtctggggatagaggtgagcatcatggcatcccgcaggtgctcggaagccagagggccctccagtgctaagagtacagttacagcacacagcagtgctttcagtgcgttagataaaacgtggagatttggctgcccctacaggcagcgtttgggactaggaaggtcaatgagacaggaaaacaatgcgggcgaagaagtattaagcctctttaaaacacctgatgtacatatctcctctactcccaactgatgttcaacacatagctagaaagaggcaaaaaaaaaaaaaaaaaaaaaaaatccccttgtatgaaggataatcctttcagcctggggcaaatctcctgaagagttttgttctgaactaggagtgttgttttagcttccagtcaatagtaattaagagtcccaatatattccagaaagagggagagggagattaacgatcattaaatctcttctgcatttggctccaaatctcttttcggaggggccggctgtcagatgatccctccaaagcgtccatctgacagcactcccgccgccaccatctggaacatcaattcgagagctcgcctgaaggtttcaattacataaaaggcaatgggcccattaggacccgagagtctggagcttcacaagcgctgctcacaccccctctcctgtacacaaagcctctagaatttggttggcagtcatttgcaaagggactcattttggtgggggcatggggctggccagccccttggcaaggcctctctcaggcaggctctgtgcgtgctatgactgacagggtctctaatgaaccttaattgtgagctcgacaggcccaggaaggcagccacagatgtggcaaagggcaaccgcaaaccgtctgattagtgaataagaagtgtccggcccagtgagggccaatgacccaaaaaaggaggagggcgggactattcctcccccacgcatcccttctaaagctctgaagcttctttatgtaagcaatgcaaagcctctgggtgcactggaacccaacgcacccctccccccggcactactgcttggcagctggcagctgggatgttggggtcttgtgcttgttaccacggatgcttccgtctccatcagcagtgcacctttaaccacaggaggccagaacagaacgccctttcaacgtgggaagggggaagctacccactacggagactgagtaacttcttgccggtgctaagaattgtgaagacagctgcattcagagtcagccatcctctggtgacctgcagtgacaaggagaaagctactcctggggcagctttgggcacaaacagcgtgacggagaagacaggctttgcagacgggtagatcccaactctgctccttactaattagctgtgaggcttggaccaactcatgaaacctcacttggtttcctcatctgtaaaatgggcataaaagatcaaccttgtggtgtgcagtttaaataagcaaagggtctggaacagtacctggcacacgatagtcatctcttaaaacccgggagaacagcagagtattttgcgcaagtttgacatgacctcagaactccatgcagacagctactacaagccaggtactatgctagaagctttacaccccccatctctcattcttgaagttagtgtcatgcccatctcacagatgaggaaactgaggctcagtggtcacacagctaagacgtggtaaagacaagagctgaacaggattgtgcctttcgatttcaaggcactccactatcaacttcaatgctcctaaccaagcatttcaggcatcctcagactaacagcctagaaacacctaaccaagaattttgtagaatttgaattcccaaatacaccaaaacaggcttctctggcctggcatataaaggtgtggtagggggcactaaatggccaatctgtttccaaggaagtctgcaaaacaaatgaggactccacttccagccttggtctgcttcttggctagtggcacctcacaagcattttctgcatcagggtcatgaataggtagcagcaggtgagctgctaaaatagcctccccaccagaaagcagtcccaggagaggcccagagatacagaacagaggcccatcactgggaggttgtgtaggaccctcacacatagactggggggctctcaagctggggaaaagggtacctggggggagactagagatgtaggttcaagaaggggacaagagattcagaggaaagaggagcaagaggtgagcagtgctgataaggaagagggtaaatggcaaggaagctgggaaaccgacagaaaggatcctgaggacccaggtttcacaggtgacctggcacctctggaaggctgaggattgaggggtctgatgacctgggaggctgcaaggctggcttgtccttggacactgagatcaacctaagactccttcctgccgccttagaccatccagccacgctcttgtctagctttctctcccagggcttccgaagactttcccaatgataaccggggtcagctcctcattcagggagcagaagcaggaagaaaagtgcctagcaagcaatcaggaagaggagggggagagaccctcaccagggcggactgtgcagctggtgtcagatgacccttatctctgcagaatggaaaccagccagccaaagtctggaggctcaccttctgacctccatgactcgcctttgggtggggggccgtggcattttcagcttcccattcagggatccttaccttgacaagttctcatgactatctacaaggcctcaatggagggcctcttaatctccttcctcagttaaataagccaagtccttgcaaacgtgcactgggttataaaatgccccactgtgggagccaaggctgggacttggttcacctgtgaaaactcagcccaaaaggctgcccagggcatcagggcacagcctctaggctggtggaacccaggagtgagccaatcggccctaggaagccaacaaaggcagtaaaggcaacagccagcatcaattaagtgcctgtcttccactcacatctgcagtttacacgcaccccaaatcctcacaaccgtctcatgaattcggctttcggaaactgtgggagatgaagtgccttgtccaaggtctcaaagctggaaggtgaccaggccaggattcaagtcctagtgagccttctcttctggctctagtgagccacccagggacaaagactgtgggctggagtatctgctggaggcccctgccggctctgttctctccacctatttaccagatggggcagctcataggcctgagagaaactgaggtctcttctgccagcaaaaggggagcctgaaagtggtgacatcaacagaagggtatccatggtgatgttcttttagttctaggcaacagacctccagttctgagagactgagagaccatcaggcctgcacttcgcagagtgggggcccgagacccaaagacctgcaattcccaaagcaaattagtggcagactcaaagccacagcccaggtctcctgacttccagtaagatttgccaaggcaccttcttaatggacatagtgcttccttttcatctacctttgtccctcctattgaagcagcaggaagtttcctgaagcagttctctatttgcacaaatagataaataattccaaaaaagctatgtttccttctaccccattttaccaaacacttatgaaaataaaaggtttggctaatatcacacttagggccattgtcaaaaaagggtgtagaatccaggccacttagtgtgtaggttatgatccttcccaggaaaacaatgtttcccaaagcacattccttgaacgtgagttgggataacaggttcagttctttttttattaactgtgggacttctcagagcctttaatatgccaacatgggtgatgatgctcttaatggataatggagtctgattatccagactctggatttctcccagtcaatcgctgccctttatccctcaagagactcaatgccaaggtgaggggatccacttcattagaaagtcacgaaatgtgcaggtcacagtccaacaagaaacgaatccacccaccaagcagaaggaacagtcatccatgaaggaggcttttccagccatcccatctcggtttattttgcacttctaactactagtgaggaccaaagtttcacatattaggcgtttgtgtttcttcctctgtgaattgcctatgtagccagctctttcttctaacaaagtattcctacttctcctattgatggaggcaatgccatgtggtagttaagagccccggagtcaggttgtctgggttcaaagcttagctccaccatcatacttggtgaccctggataaactgctggaggccctgcttcttcatctgtccaatggggacaactctaatagcctcagcaggtgttctcagatttaaagagagaagcgttttgccaaaaggtacaaatgcttttcagagtgtgttccttgctttttaattttgtgtaaacttctaagttaaatttgcatgcagtcaaagctatcatttcggcactggcttatgcaccttctaaaggcctcttccatctcaagatcaaatactgatgtttgctctctgggtctttcatgttcgtttaatagttaattcttcagtccatgagaaatacgcaatatgactacatgctgttgcaatagagttttagtgtgttttccttcaaaagtattagctgtttcaacacatttattgaacaattatttttctcccaaataggaataccacttgtgattgttctaagttcttccattactgagtctgtttctgagaattctgactgatttgcttccgccactcagcctggagctctgcagctgtcttcacgcactgcctgcttgcctcttaggtgactgcctttaaattaaatgtaccaaaatcagcctgtgctccagcataaatcagttagaacagataggatgccaggggagatggagggacaagagcccatttgtaacagcaaaaggagatgccacctagaaataagctcccttactgaaccatcccgttggttcttgcagtgcactgctttttccaaaatttttacatttgttttaactgaaagtatagtgatatactacttgtgtctgggcaggatgctttcaaaatagcactttccccccaaacacacacaatgcaaagtgtgtatgggtggggggtggtggggggctgcaataggaagctttgcctctgccccactgttccaactgagcccgggttccccacagcccagccggttgaagggagcggcggctcctctgctggtcaagctctggaggaacatcgcctgcccagagctccacaccagcagtggcaggaagagaagttcaagtccttttcccttaggtacttccatggtgaccattcttcccaggccctcattataaatttcctttacattttcacttttaaaagattatttagctttggcaggacatttaagaaatggcatactataatattttcatttgtaaggctgtaattcagtggaaaatactgactggaatcaagaggtgggcttgacacctcttccccgcaaccccacagcacgcatcacctatcaggtcagagactcactgccctcctccattcctcagtttcctcccactcacttcacagaatggctatgaagacagataaggtcctggatgaagcgtattaataatgagacccatctgtcagtacttgctgacatctgatggagatccattaaaagttacttattttggccaggcacagtggctcacacctataatcccagaactttgggaggccaaggtggaaggactgcttgagtgtggaaggactgcttgagttcagaagtttgagaccaacctgggcaacatggtgagacccccatctctattttctatgtttaatttaaaaagatgaaaaaaatttttttccatgtaattgaaaagtattttatagggaatgaaagagggaagagtcaaattgttaatctgagaccaaacaaaaaatactttctgttttgaaatttgtattctctgaaaaataaccaaagcttactgcgtggctatcttaaagatgatgggagagcatcaattttcaaaatagttggctttggagaaattcaagccccttcccctaatggaaaatcaaccattactgttctaggacagctcaggactggtggatacatcgttgcagtctcctggaatcagtctttgctccccaaggaacacacacacaaaataaagccaatggccctactaatctctttggttcatttcctttctcttgcactcctctctttcattcattccaccgtaattgtctggattgcctttacagaaggcaattaatcgcattcttaattggataaaatgaggaaccattacgctgcatgtaacagaactcatcagaatctgaaatcacttctggccaaatctatgagggagctggtcaggtaagagcaccccaggaagccccacttcctctttctaagcaaatcatgccatttcttcctggtgaagggctgcctggctgccacctggacacaaatcagaggctgcactactaggtggcaggtcctcaggttgataacaggccggggtcatgaagggccgccatcctccggagaggccaggatgggcaggaaacgccagcttggcacccaccgtccagagcatgcctcctgctctccctgcctcagtccccacagctgccgcccattcacagagcaaaaggctcacgtgaaaagactcaccacaattttccaaggaatggagtttattaaaatactgctggaggcttttggctggaatgttttttctccttgtaaaacgggaactatagcagtgttgtctataggaaagctcagaatacgctcagaaacatcagtcacaacagagactatgtaggggctggtgcatattaccagtgattccatccattccgcggctcctgctccagagataacattcggctcagaggagaaaacttccaggcagaccctaggatgggtaggagagaggaagccaagtttccccacccttaacataaacccacggggaactctggtggaaaaagcatttttttaatgttaaaatgtcttgcatgtgggcatgttatggattggaatacaatttattttttaatttttttcttacgagatggggtctagttatgttgcccaggctggtcttaaactctgggttcaagcgatccttccacctcagcctcccaagtagttgtaacttcagatgaatgccacatttccagagagaaaacaatttttaaataagacaaaacatacaatgctctccttgaggcaggcacctgtggattttcccctaaaaccccagaaatgtgtatttgctcttctttcttcctctattgacatgagtactttggggaaagaatgagaagcgccaaggcacaagtcactgagaaaccggttaaaaggtggcgagcaatggcttgcagaagtggacaaacatttactgatagctgggcacgaccattaaagagcctctaacacctttatgagtaagtaaaaacaaataagcacagctgccagttatcctgttcaacagatgtacagcgtgcaaagctgaccacagccaggtcctccttccagaaattaattccccataaaatgtcagctccatagagcgaggcttttcatctggttctccacgaaaaccccggcacctagaatagtgtctggtgcatggatggtgcatttaataaatgtttgcagaaagaataactcagttctgcagctcttgctactcatcctcagagcttattcactggtcaatgaccaatggcctgagagaatccaactagggtcattcttttcggggatcaagctgaagaatccttgcattttgacccgtggaggagaaggcaaggaataaaggctgcacttcttcccagaattaaacacagtgcctgacttccaggaggtgctcaataaatgtcgactgaatccattaccttttcacttacttcagctgagacccttttagaaaggcaaaaacttaaaaacaaaacagggtctcattctctcacccaaactggagtgtagtggggtgatcatagctcactgcagctttgacctcctgggctcaagtgatcctcccaccccagcttcctgggtaactgggaccacaggcgcatgccaccatgcccaaaacattttttaatttttagtagagatggagtctccctatgttgcccaggctggtctcaaactcctgagctcaagcaattctcccaccttggcctcccaaagtgctgggattataagtgtgagccaccaggcccagcttaagtgaagacattttaaatgttgtctttgaaataaaggacgaaaaatgctggtctgagattgtttgaatgacaaggctaaaggggaagctagggaagaagaaaatgtaagcctgcttactctattaacacagataaagcagatcctatctggccttcaagatccccaaaggcaggggtagtcgtcttgggtcccaggcccagtgcagcttcatcacctgggggacaaaactgagttttgcttcactccacacagctgtccctggaaaaatgatttccagatttcattgctttgactattaaagactgaaaactgagcagcactgcttagcagacatcagatattctgctaatcaatcgtattaatgaactattgactaatagtatcatccttaacgtcaccagtcaattacaaatgtgtgtgagctggctccatgggctgcttcacggagagcaggtttttggaaacgtaagcagcgggtgtccactcactcgttcactaaggctcgaatgtggacacgtcccccaagcactcagccttctcatctgtcaaatcacactccctgcagacatcatgctgccccgatgggggtggcgatgcgggggtgacagggataatttcaaagcatggctaccgctgaggctggcagtgtgaatacctgtgcccagctggctctatttctagagggctgctctggctacttaaaaagaagaatatgctgaaaacagttaacctatgaagttatcaactccccggtaaaaaatcaggatgtctcttccacctttacctcactggcctggatactttcccagccctgatgtcttccccttgatagagtaaagtctggggacacccaagagctgagccttaggacaactgtaagaaagaaagaagtgaaggaactaaaaacatgaagtgaccaatgtttgcaagcagagactttcttgcctagttaaacagattcacggctatttttggtttgctcttaaaaaggcaaaggatggaaggcctgctgggtgccaatatgcagaaacaaactccttcctcagctcagggctcaaaatacaccccagctgagacatttctgctcttgctgccagtgtgcagagtaaggccatagaagggccaagtttatgaagccaagggaacatcttcacatcatatgattcttggccctcatggatgtgtgggtatttttgaaacagcttaacaacggatttcagctggattcactctagcacaatgggattaatatgtaataaaatgatgttttggccatctgcaaaggaaggtcatttcccaccaatcagagcaggcctcataatcccaaggcagcaaaaactctctgatgctgggaagaaaaaagaaagctgacctggcatgataaattgggctgccttggcctggctgccaagcatccctcacatttctcttcaataccactctgtaatcagaccatggtggactggatccattcccccacagttccctggccctgacatcttaagcgaggccattcccttcatggggaatgctggcaaatcctaacattctcgtccatcttaaaactggagacttttcttgaaaacaacaatctcccccccttcattatcttgggcaggtgagcagggaggaatgactgctgtttgcatggagcagcagtgcattagctactttcaaaacatctgactgatcccagattacacgagacaaaggcctggatcctttgcctttagacaggtgcataatagtgtgaattttctgaaactaccgctttgggaagaaactaaaactgcatgtgaacttcaatgctacaacagtatactcagcacagaccaatccttacagaataaaagcatttcgtaagttcagttaaacaggaaaaaagaaaaactgtcattcccagagaacactggcagtgatgaaaataaaacattcaaagaagaaacctccaggatcagtcacaggatccagtacaaagccagcgcactgccccttatatgagcatcgcacgtagcgaggagttcaaagccaggccatcaatcagaaagtggcttctgaagcatgtcaatatagttttttttcagtagagatgggttttcgccatgttggccaggctggtctcgaactcctggcctcaagttatccacctgccttggcctcccaaagtgctgggattacaggcatgggccgccgcgcctggccaatgcatgtcaatatagttttaatgaggcatgcattaccagatcctaatttgttgaaaagtcatgctccatttccattttgacattcctcatacttcaattaaaaaattaatgagaacaccgtttccccaacccactctggacgatgggaatccactctggcctcttgttcagcctctgaggtagacaaggccccaggtggcctccacacagccggtgaagggagctggtgcctctcaggccgtcccgaggcagtggaggaaagagaaccactaatcataaatggcctggttccgagaagggtttttttgccccgtgtctagttcttgcttttaaattatgtgaatttaacattattctccataatatacctatgtgttaacattttagattactaatgaatttaattaacagtttctctcccaacaggcaaaactgacacagcacatagacacaccacatttactctgttgctttcagtgtgactaacccaaaggaacctggcaagcaggagaaaccagacctcccggcgctcccaagccacatccctatcctggcttcttccccatagagtctaaatcatctaaaggaggtgaggtggccatatgtaccttacaggggtgttgtatgactttgaagaaacaataaacaacacaaacagaagtccccagcttagtcctgggcacacggcaggtattcaacacgtcagctgtccacctcaacctcagcccacctccaccagctctagcatacattctacagaagacaaagttaaaaacagaaaagtaggattgcctgaggtcagcagttcgagaccagcctgggcaacatagggagaaccagtctctatgcaaaataaaacattttaaaaaattggccagatgtggtggtgggcgcctgttgtcttagctacttgcaaggctgaggcagaagatcatttgagcccaggagtttaggaggctgcattgagctttgattgcaccactacactctagcctgggtgacagagcaagaccctgtctcaaaaaaaaaaaaaaaaaaaaaaaaaaaagtatgctctgacagtaatctatagaatgtcacacagtacaccatatatcagtggtagatacggcctggcacttcaacctgtgtccaagtaccatcctgcaactaagcctcagaggtgatctctctcattatctggctatggcgaaagacagctcttgatactctccttcattcaccatcaatgctgcaatttccctgttgagcccagggaaaacccgcacgggcagcaagggagccagttgaccaggttttcataaaagcagctacatgcacatccctgaaagagagagtgatgagggagtcccggagaaaagacacagctgtagtaaaacacttcagttgccataagaacaaaatagcctattaaacaccaggaagggtccaatgagaaaaatttgctcatcatttcctacttctatgtttggcttatttctaaaatacagtaataactaaattggcaaactaaatttaaactcagccaagcatgctttcatgctgagtttagaggaaaaacaagcccctgcagctgaccaaattaaaggcagatcacaccttcaacttttgcccacctcttccacgtaggatcaatcatagatttctgaccaagaaaaatgcaaagccattaaagcacttcccagaccacattctgtagtcctacctcataggactgatgagagtttaaatatggctgcgcatgaggcactgcatacaagttcagccgtcagtgggctgatggtgaccattctcaccacatcaagtccaaggtctcctcactttcaaggatacctcctacctatccaactttatacttcagtatttctcaacaaaggacatctcctctaacccctccagcccacactgcccgaccgcccccagctcacatttcacatgctcaggcccaggttctacacaaaactggacccggccaatctaacgtgcagcccaatgtttaaaaatcaggatattctgctgggcactgtggctcacgcctgtaatcccagcactttgggaggccgagacaggcagatcacttgaggtcaagagtttgagacaagcttgaccaacatggtgaaatcccatctctaatgaaaacacaaaattagctgggcacggtcgtgggcgcctgtaatcccagctactggggaggctgaggcaggaggattgcttgaaccggggaggcggagattgcagagaaccaagatcaccccactgcactacagcccgggtgacagaatgagactctgtcaccaaaaaaaaaaaaaaaaaaaaaaaaaaaaaccaccacacacaaacaaaccaggaaattttacataaaaccccaaatatatggctcctctagaaaaatgtgaaaatgagcaacagaggcttccaacagggcaacaagcaccaggagtaacgagggcagctgctcttcccacaggggcctgtgcctccagatcccaccatgcccacttcaatgatcttcctcactcgctggctcctggccggggacccctgatcctgagcacacagtgggttcatttgcatcacaactatgttactacccccctgaaatgtcgactgtctggcaggaccctctctttttgatacctgccttctctccgcttacatcacaagcatgtgcagttgtctctctgagcagccagtgacctcaagaaacctctttcttcccacttcctgaattactatgaatgagatacagcaggttcccaactccctccacaggctccgctctgtgtcacacacttgcctctcagctgggagtttgcatccctataaatatacaaatagtcgcactacagacctttcgggctgctgtataaagttttctgtgaatgacatccgtgcctctcctagcagtcatatatttttcctagtaaaaatgttctgaatgcatacaatggaattaaataaatcactacagcatatgaacaagttcccaacccactctaaaaagatacctcactgatgagccatgcttggcaatggataattacatccaagaagacacaggacacagtggaaaaaacagaggaccagactcagggactcacgttccaaacccagcaccagaactcactgccaagtgatcagggtgattcggctggcctcttaggacctgattttatttctttccaatatttcctatggctttatagatgtttttgaatattttgagcactcttcaaataatatggtgctagtgaatttgaggcaacatcttgagaccaatcattctgagcataaaaatctatgaaaatgaatagaatatttaaaaactagatgtgacgggccctttaacaagccaacttttgcttgttataccttttcaaactagaaatgaagccacggaagcatcttacaggtagacgcttgtactgtgttggctggagaaactcacaccatagcagagactgacagcgtctggcctgcgtgcactgctgaatgcctgcgggatgggtatggcctcttcctcaccacgtctaaatgcaagcttctagaaactgaagacaaggcagctggggagggagcagactgtcattaactttagaactcctaacttgggcttcaacaacacagatggttctgaatgacagaccaccatatgaaatccatcttctctctgcctggaggaatctcatagtccagtggcatggtctgccagggagagaaaaggtttcctgtgttgtgaattctgcatggaaaaagctacacaaaagcaactaactcttagccgcagtctcaaatggaaccatatgaaggaggcacgtaccaggtcgatcaggtcgctgaggtttttctcgatttgctggggaggcaggcgcctcattaggtccaaggcacagtccagctgctgatcactctgtggagggagaaatacaagtgcgtcagtcatttttgccagaaggaatatcaaaaactccttttaaaaagcatgcttgcccaaggcattctaaaacccaaagagccacgcagtgggccctccgccaggtctctgtgtgccagcagcctggagcggggggcgactgtgcaggctgtttgctcccctttgacagcagtctctgtctcaagtgggggcatccaaaagaccctgaaagaagtggaagcaggctggagacgtcagaaagctccctcaccggctcccctgctcctgctcaacaggccctggtggctgcagatgtcgtgccccccagttggttccatggtgaacacactccagtagcggattacttttgccctttgttgtaacctgggtgtaaacatcaggtaacatccccaggccaggttccttgagaagctccaagggagggagaaaagccaggcaaagaacaagtggcaagatgcacacggggttaaaagtgcttcattcattcaatagaaacttaggacactaagacctgaaccacactacagtcaagagctcactccacccagcaaactggactgcaaatgcagtaaactatgtcactgcagaggcaaggactggaaagacaaccattactcttgtttatcaagcactcttttaaaaaatgtttttcattttttaaagatagggtcttgctgtgtcacccaggctggagtgtagtggcatgatcttggctccctacaacccccactttccaggctcaagtgatcctcccacctcagcctccaaagtagctgggaccacaggtgcatgccaccacacctggctaattttgtagttttttttgggggggagggggggaacatggggttttgccatattgcccagggtggtcttgaactcctgggctcaagcagtcgaactgccttggcctcccaaagtgccgggattacaagcatgagccatcgtgcccagcccaagcacctttttaaagctatgcatcctgtgcttcaccatactctcctcacagtacatatgctgcaaatatttactcagagccaccatgtgccagtcaccataaacatataaaaaataaataaataaagggagggggagaggaagggaacagagcggaggcaaggctggtaaaatgcaaagtaaattcaatgcacagtgggttctaacacagaaggctagacctcaggagatgagacaagaaataaagtgagaaaggtgggccaggtacaagggtgaagacctgtgtatgcaactcttagaagtacaggtgactccaagtaaggcagatggagtccccaacactacccaagcagccactatctgatttgtatctggaatctgctctgctcagaccaatttcaggatttttggaaggcctaaatcaacaagctacagtctcataaaatacacaaagtaatcctcaaaatgccacatttggccttaacgaaatataacttttgaatattaccgtttacactccaggtctgttaaccacaagtaggccgtggggcaaggacccacttcatagtcaccagagacataacacattattaaggagagtcaatttcatttttttaaaaaaagatattgacatggcatatacagccagctgttttaaaaaagaatgaaagaaaagaaaaagcctgtcccttgctcaagatggctatcagtgacagttcatcctggaacacacaacgaactggctcccctgcaaagagaaaagaaaaacaccacaccagaaattctaccacttgttttgctgaatgccagcaaccatgaattccctacttgtgccacgcatttctatgccaacatgtgtcagccaaggccacagtgatgggtttggcccactggcatgagaggaaattttaacaccacgtcttgggcagaacacacagataagctgattcgactctagagagacatattcaattcccaatactgccattcattaacttatggccttgggtgggtttcttaatctctagaagtctctatttatttatccataaaatgggaacacagtatcttccttagagagtgacaataatttagtaatgcatgtggaacatttaatacacagtagtatgtgtttaatgattggggatattgagtgcatacaaataaacatacagcttttaaatctttttaaaaattttaaatgattcccctgcccaacctccccgcccctcaacccagccctggatctctctctctctctcttgctccccttaaactagagctaatgttcaaactcaatacaaagctacgtattctcttggccaagcaagaatagaaaaccctaaatgattcaagtcaaactcgttaaaaggtataaactagtatttctcaactagggatgattttgcacacgtgcacacacatacacacacacctccaacaaccctgccaggagacatctggcaatgtatggagacatttttgtcacaactgggagagaagaaactactgacatctaatgggtaggggccagggatgcttctaaacatcccaaaacgcgatacacagcctccccacaacaaagaatcacccggcccaaacgttaatagagttaaggctgagaagccctgggcgaaaaataattggtttgggggctgcagattcccagaatctgattgacaataaagtccccctcaggaagactgcacatgcaggcaaacgttttatatataattctaatttaaagaccacacatacactttgggaggccaaggcgggcggatcatgaggtcaggagattgagaccatcctggctaacgtggtgaatccccgtctctactaaaaatacaaaaaaattagccgggcgtggtggcgggcgcctgtagttccagcaactcgggaggctgaggcaggagaatggcatgaacccgggaggcagagcttgcagtgagcccagatcactccagcctgggcgacagagcgagactccatctcaaaaacaacaacaacaacaacaacaacaacaacaaacccacacataacccctaaaaatttctggtcttcagaaagtatctcaactagatattagcaatcctccttataaatgaaaagcaaattaagatataagtaagcctgtctaatttgaaacggtgatccagacagaacacagaagggattaactagaaaactgagcagtgttatctaggaaaagacctaagttgaccagagaagctcaaggtgaaagacactgttttaacccttcttcggtgcctgttcacaagcccagttccaatatgctgatcacatccccaccccgcaaggggccggacagtcctctgtagacctgtatctagttgacagcactagaatactactacaaaaggatctgactcatattttgcattaatcccaattaatcttaattggaaatgtttcactacaaatttctaaggttaaggatgtttaactatcattcaatgaggaaatgactaaatgcttcccataagtgaagcaacatgggaaagcttaatgacagcttttaagacgttaaaattagagttaactggagccatttgcttgggagtcatcccaaaccctaaggggtccaaacaggaaacggtaccggagaatgaagcagatgtggatgaccttcagctacaagcaacaacgtaagtgacccaggaaatggaacgatggggacagagggagggggctagtcccaggggcctccctaggatgctgtcacttttatataaagctcaataacaagcaatagtgaacattctttttttttttttttttttttttttaaagataggctctcactctgtcgcccaggctggactgtagtggcacaagctcagctcactgcaacctctgtctcctgggctcaagctatcctcccatctcagcctcctaagtagcttggattacaggcacacaccaccatgcctggttaatttttgtttttcttgagacagggtctcactttgttacccaggctggagtatagtagcacaatgtcggctcactgtagcctccacctcccaggctcaagccatcctcccacctcagccctccaagtagctggggggccaccatgcctggctaattttttgtagtttggtagagatggggtttcaccatgctgcccaggatggtctcaaacgcttgacctcaagcgatccgcccacctcggcctcccaaagtgctgggattacaggcatgagccaccatgcccagccaatttttctattttttgtagagatggggttttgctatgttgcccaggctggtctcaaagtcctgagctcaagcgatccatctgcctcagcctcccaaagtgctgggtttgcaggcgtgagccactgcacctggccatgaacactcttattatttagacacgtgttttagactaatataacaaggcttttttttttctttaagccaagacaaaggtatgataaatacaacatttaagaagagtagaagagcagttctagggaagccatgaggggaagatgaaagctatactgtctaggtctcacatggaatggcaggttcaagggtattcatcatcaacgtgatgcttaagttatgattatcagatatctaaactttttttaaaggtaatagaaaaaactacaagtatgcagggagtggtggtgcgtgcctgtagttccggctactcgggaagctgaggcaggaggatcgttcaagcccaggagttctgggttgtagtgtgctatgcccatcaggtgtccgcactaagtttggcatcaatatggtgacttcctgggagcagggaaccaccaggttgcctaaggaggggtgaaccggcccaggacagaaacggagcaggtcaaaaaatacaaggaagagcaagtaaagagagggcttaggactcaggagtccagggtccaaggtatgccctgtcactagacgtctgtgtgctttggactgctcacttaacctcgtggcctgggatttggcccagatgaactctaagactccttctagatggagtgccctctatcctactgcgagagcagacatgcctaaccgccacacccttcaaaacaagaccatcatcctggatttggccgcttgcaggccagcaactgggctacagttcaacaactgtgcactgagtgccaaccctgggccaggccctgaatccggcccaacaaatgagacccagtcccaagcctcaaggaaccaattgtccataaaacagcaaataaccacaaggtcgtgtggtgtgtacaatgatgagacagagaaggtacaaagagacaaggcacagttcacaatacactgatttgtacttctttgtgtcaattattttcctaggacttccctccctcacatggctacaaaataaacagaaggccagtcaggggaagtaaactgtcacctggtggctaagagctctccacaggccagctccttcaaaactctgactggtccaggcacctccttcatacaatgagcttcaccagttccaccacccaatggtgtgttccaggtggaaaggtaaatagtaaaagaaggaccatttctccttatcctctggaattctctgtccattcaattaatcatctgatcattatgtgagtgtttcctaggtaacaagcactgtttctgatgctgagtggtgaacataaaagtctctgctcctcatggagcttatggtgcagtcaaaatcagtgtggaaaaaaaaaatcaaggaagagtccttgttaggatgtcaaataataaggaggggagttaccccattttaagctggcaaggctccaaggggtaggtttagggggttttttgtgttattttcttattttggtatataaactgagataagaaatatttcacctcctgttttcacatgatttaaagaaaaagcataaaattgcttaaatcaccctgcaataaataaaaccaccattaatacggactaaaacaatttttcagaataagaaatcagtcaaataaaaccccaccatctaaatatctgctacagtgttcagacatccgacggtattatgaaatcatctgcatacaggaaaacttggcctactaggcaaactccagggcaaagtctgatttggaaaccatcaagtgagatgtaaccagtacctacactccaagtttggtagagtaaacacaccatctacaacaatgtcaatgtcagagtacaggtgcccactaagtagggcagggagccccagaagatgtctcagaatggggccacaggagcaggttagccctggataagcaggtgtgcctttccaggcagcaggtgcagcaggctaaggagaggtgagccaggtgcgtggaggaggaggtggggaaccatggggcatggcctggggaggtgactggggccttgtcacaagagccagatcacacccaaactactcagggggcagctatgctggcccgaggagctaggctcagaatctcacttctccccgcagttttttgctcctgtccagtttataggtaaggcatctgtgccacattctttaaaatccacttttctgtgaaggttttggagcccctagagatttttccacaggggaatgacgactgctgttgtgacttagaaggcgaagcagattatattttccaaaaatgaccataacaagcagtcccatcccacatgctcctcttgcagcgtgactgtgacactcctcccacttgtggtggggcgggggggggctgtgtcccctccgccttggaaccggaggagcttttgtaactttttatcatcagagcccagcacaaatgatgccctatgacttgtgagcccacaagagacaacgcggcttctccctgcctgctaaacacacaggcctggagcccactcaactgccccgaggccaccctgtgcagaagacttcctgagactccatggacagagggaggcccactgagcccccaggtgctccaggctcccactgttccagcttcagctatctgactgcaatagtatgagaccccaagccagaaccacccagccaaggccctcctgaactcctgacccacagaaaccatcagagacaatgaaatgaattgttcctttaagtcactaggtttcgggatggttttgttagacagcaacagtaaatgacacagaaggatttgtctggtgaccttggggagacagcctgaccagagacgaaactggggacagaagagctagcagaggagcctctacagcaaccaggtctctggctggatggccagagaggaggagagccaaagactttaaggtcacaacagataggacgaggtcagttactggaaatgggaagaagcccaaggagcctgagatgactacgtttcctagctggggccaactgctagaggatggtgccacagcctcaccggagtgtgtacgttttgtgtgtgcttttaaaacccactgtttttaatttcaaagacaggcacaggcagtaactcaaattgctaatgcttgcaagcagaggtcctgcttggcctgctgtagtggctggttaaggcagatttgtgcttaacagcatctgtctgtacataaacaaccaaccaaagcttcaaggccttcagagtttgttcttaagttcatcaagaccttcactcgtttacattcccgagaggcttagcaaataacttcatagacagcacaaaggtaaactctgctggcgcccagaatgacttaccacaaatttatggagtctcacttaaccatggtttgtcttgtataatccgtgacccaataagcaactttgtttaaacgtcgaatctgttttctgccatgtggcccgggaacagtttgtgctgggggcgatttggagaaggaatcctgggccggcccagccgaccactcatctttaggtcactctggaaaactgcacattttggattaataaaaagaaaagtgcttcctccactgcctgagtgtcctctgggatgtgacaatagctgtgcaggagggagatgcctcaaccacaaacacacgaatactccttggatgactttctgttcccatgggaaaatccaataccctcgctgtcaagggaatcacagccacgacagaagtccacttggcggaccaagccttcttcaaccttttggggtctgctgtctaccatcatagccaagtcaatgtcatctttttaaattgaggtttttttgtttgttttgttttttaaaaaccatgcaacataaaagtaaccattctagtcctactctgaccatagagacaaacacaaaaccctgggagatggcagggcaacatgaaggaagaggctggctctgtggatgacccaccagccagaatgggtgacctgttgttatatgagaaataaactcctatctcatctgaggaataaaatgtaaccattttagggctggacatagtggctcacgcctgtaatcccagcactttgggaggtggaggcgggtggatcacttgaggtcaggagttcaagaccagcatggccaacatggtgaaaccccacctctactaaaaatacaaaaattagcagggcgtggtggcagatgcctgtaatcccagctacacgggaggctgaggcaggagaatcacttgaaactggaaggcgaaggttgcagtgagctgagatcatgccactgcactccagcctgggtgacagagtgagactgtcccacaccctccccccacctgccaaaaaaaaaaagaaaaagaaaaataagccattttaaagtgaacaattcagtggctatgttaaggtcatttggattaccgtgaaaacataactgctttatgtgtctctctcttttttcttttataaacaagtctctcctttaaaaaaattctgttgggatcacagaaattagatctggactgacatctcaatttcatctgagtcctgctccttcatttgacgatgcataatgaggtccagcgcaagttttgccaggttgcacagatagaggcaaaatccgcacctaaacctggatcttcttcgtgttttgaggcctggctctgccccgagcccttctcccccgtgagtctttcatccagggactgtgtaagtgactggcagacacaaccgaacagtgagatgagattctcaccctcaaggagctgtgacctaaggtagaggacagccagaaaaaaaaagcaggaaagaactacaccatcctcctacattcaacgcccagcatcccagctaccccattattttcgaggactggtcctcccagtgatttgtccaggtcatcaaggtatcaactttttaaaaaaattctagaagacagcaatctctctaaaatgtattacctgctctacatttttacacaatgcaaatgatcacaggacaatgcaatgaacacagctaaaccatttctcattagcctaaggacagtgtatgagtagccactcttggaacagcaccctgtgtctgctttttacatttatctgcttcttctgccaggctgtcagctacacttcctcaactaatatgttgcttctaatctgctatgaggttgagaacccagaaaattagaaatctgctctcatttcaaacaaaaaaaaaaaagaaactctgagagaaggaataaatcaggttgataacttggggtccagagtcacagcccacaaatagtttgtaagtaccttgacactatatgaagattacttcttccttttcttgaagaagttcaagactctaaaggcagagatacgatatactaataattcctactttcccatacaacctgcataagcaagtcaccacctcatcccttggaacctcagtcttctttaaaacctgggtccgacggtactgtctacctcacgggccactgggaatgaggtaccacgtctgggccataagggcaccgcccacagagcatcctccataaagggtaggaactctcccagagagtaaagcacatggcttatctgccaggacttttacataacattttttaggtgctagagggtcctttctgcctggatttttccctcacttgacacaggttttccattcaggctgccaggagtctctagaaaggtaggcggagtgttatgtcagtttccaagtcattaagcacccacaaaggagggcaggcttgcacagcactcactccacacaaccgcccctgccctgagtacgacggagcacatggcttccctaaagccacaaggagaagagaggcagggacagtgagagctgaaggaattccacatgtgtccatggaagatcaccttccctttgttttcctgcactctagtaactccctcatgcagcttgctttctgaagccctctgctccatttccccagcccaggacagcatcaagaaatatttccaccatctcatctatttgaaccttctccctatttactggtgctcccaaccccatctgaggccatcgaaaccagacaactgtggcagcactagcagagtccccaaactaccctgacaccctccctggcaaggaaaatttccacgcgcctctccctggcatatttattccagaggaaaacttagcaacctacacactacacacaggctctgtgtcaaactctacaacagccatcagttgatctttcccttacacatccctccaggaagtgaaatatccgaaatgagtcatactcaggagtcggagctatacttccactgtagtttttttggataaccaattcactgtttacactccaaaacctctaattgctgaacacagaacagttcctttgcagagatcaaagcttacctggtgaacctggcgaaatgacaaaaattctccaaaaggagttagccatccagagtgccagaggagggtggctgtacaagcacattttaattggcaaagcagagtcgctgcccagcaaggaagagtatgcaggggtttattctgctgctcttctatttcccctttaaggcatatatctcttacccctgcacccaccaactttagtcactcctagcacacagctggcggccgcccacccgcacccgcacctgcacccgcacctcagagagcttgctgatccctgagccgtgcactgaagcttccaagcagctctacctaaaggcaagcactgcctgctttttacaacatatacaatgggctaacctgatgcacagaaaaaccctgggtcacatgacaaccaacaaactcattgctcaggatggctctccgccacgtttctcaggcactgtgcttggctctgctggccaactgagtgagctggagcattttctcttgggtgtgcatacccctccacctgtccaactttaaaacacagaatcaacagggatgttacactaaaggggaccctagaaaccatataaacggtggaaaattgaggcctggactgacccataacaaatgagacatcacataatggcaaatgaaccatgaccagaaaacaaatctctttagtacacagtttagcgcttctgcttatacaggttgaacagccctaacccaaaaatccaaatcccaaactttttgagcgaagacatgaggctccaacgagcatatcagactttcggattaggaatggtcaaccagtaagttctgcaaatattcaaaatctgaaaagaatccaaagaagtctcaaatccaaaatgcttctggtcccaagcatttcggataagaaacctgtagtttaatcatcagtcaaaatttaagaatagagttgattttgggccgggcacggtggctcatgcctgtaatcccagcactttgggaggccaaggtgggtggagatcaggagatcaagaccatctggccgaggtcagcagatcaagaccatcctggctaacacggtgaaaccccgtctctactaaaaatacaaaaaatcagctgggcgtggtggcgggcgcctgtagtcccagctacttgggaggctgaggcaggagaatggcgtgaacccaggaggcggagcttgcagtgagccgagattgcaccactgcacaccagcctgggtgacagagtgagactccgtctcaaaaaataaaaaataaaaaataaaaaataaaaaaaaagaatacagttgattttatccaagaaaatactacttcgggctgcaagcaatggcttacacctgtaatcctagcactttgggaggcagaggtaggcagatcacttgaccccagtagttcaagaccagcctgggaaacacagcgagaccccgtctctacaaaaaactttttaaattagccaggtgtggtggtgcatgcctgtagtcccagctactcgggaggctggggcggaaagatcacctgaggttgaggctgcccagtctgcataacagaatgagatcctgtctcaaaaaaaaaaaaaaaaaaaaaaagaaaaaaaaagaaaatacgctttgactcttttgaataaaattctacattattagcattaacaatggcagtattaagaatatttatatattgtccagactgggcacactggctcacatttgtaatcccagcactttgggaggtcgaggtaggcagatcattgaggccaggagttcaagactagcctggagaacatggcaaaaccccatctccatccaaaatacaaaaattagccaggcgtggtggtgtatgcctgtagtcctagctacccaggaggctgaggtatgagaatcacttgaacctaggtggccgagtttgcagtgagctgagatagcaccaccgcactccagcctgggtgataaggtgagaccctctctcaaaaaaaatttgaaaaaaagaatacttatatattgtccagataattttatttttatttttaagtgaattgatctttattaagaatactaggtatccaaaaggcaaaccaatttcaaacgcaaaagggaaggaaactaacaactgctaagggtggcccggcatgggccaggcgctgcaccctgtgggtttcaggagagcctcacaacagctgcaggaggtggctcttgggtaccccagtttcacagataagtaaaatgaggccctgaagggttaggtgacttgccccagagcactgaatgacacagaaggacataacacaggtcccctcccatgcccaaacattctccaaagaatgttaaacactcccaatgaaataaaattaatttctaacgacttgtagggaacaacttgcaagctcacaaaatcagataggggcaatgagtctcttctcccgggatgaacaaattatggacaatgtcatctactaccaaattctgaaatctgtcaccgtggattacagacggtattctcacaaacactatccctggcaggtggatttgtcgaaaacaagaaagcctctcccacacagtttctctggttgacggtttcctggaccccttgagaagatctgcaaggcgccatcaccttgtgtctgatcattaatgtttcacagatgtctacagctgctgcctccacatgatcctggctggtttcatgtaacaagcgactaatccctgcactttgtcaactggcagttagacacataattatgggcaatcctgagacgtcttcaagggatgccgtacatgttgtccatttcccactcaatggcacgagaaattcaagaagcctttcacaaaagtggaagctgagtaaagcagggtgctcctgtcttccaaataacagttaaaagaaaaaacaattcagaaaaatgtcgaccacgtgttcactgacgaaggctaagaaaagtaaactccttttttcatagcagaagcagccaattcacataaaccaaacagatttataagatggcctagatgaaatctataatatttggacacaggtttactccaacaaaaccctgcacatggcttccaaagacatcggggagaagcttcagtccaacctgcaaacagcacaaacgggcatgtctggatgggaaagcaaaaaggtttaaaggatctggaaaaaacgaaggctccatcaatccaaatattttatctagaagggggtggtgctgcttttttgacttatgtccaaaaggaagcttgaggaaaagaacacagtgcttattgatccaacaaaccacttgggctatttcttccctgggctcttgggctccaatttcagatgcctgtgtgtgactcaatatggaagactctatcaaatctctatttgtccctgtcggccttccccatccagctcaagggtaactctattacagcaccacgctctacactgacaccatgggcccagcactgcagagcacaacagaattctgcaacaactggccctctggctcccctaaatagatcaccaaagttttaaacatattttagtgacagaaatgtacaatgcaacactctacccacccatgatacctttgcaaacttaacccaagacctgtcataacgttgccctcttccaattaatgtcaggacccactgggtagggagatgcctgaaacatgacatcctttgggcttcgattttccagaccaaagacagagtccttgaaggtctgcagctggcagaaagaccttggaagtaagacagacaagagttcaaagcccatactcgccatttcctagcaattaaggtctgaataattccttcacctctctgagcctcgattccttcatctgtttagcggcaataataatcaaacctatcttacagggttattttgagaacaatatcacaaaatatgtgtaaagaaagtagcatagttcctaaaacaacaaatattcaattaaataaaaaaaaaacaaaaacaggcattggctgggcatggtggctcacatctataatcctagcactttgggaagctgaggcaagaggacagcttgaggccaggagtttgagaccaacctgaccaacagagtaagccttttttttttttaagggttaaaaaaatacaaaacaggtattatcaccatcttcttatacagaacttcatttcagaaaacataagattataatgtttctagccaacgcagtggctcatgcctggaaccccagcactttgggaggccgaaatgggaggatcacttgagcctaggagttcaaaccagcttgggcaacacggtaaaaccccgtctctacaaaaaatacaaaaattaactgggcatgcctgtagtcccagctatttgggaggctgaggtgggaggacagattgagcctgggaggtcgtggctgcagtgagccacgattgtgccactgcactccagcctgggggacaaaacacccaaaaggcaggagagtgggtagccacagaacaaggggcctgataatcaagtcagtcaaaaagttttttttttcctttctgtctcaaaggaaaaaaaaaaacacactcattataatatggaattaaacatatacacgcacactctcacttatgtaagttaacattccctaaaggcatgagagtgggtagccccggaacatggggcctgaaaatcaaatcagtcaaggccgctcctttttggttcttttgggtaagccaaaatgatctttactagtggaaacattattcctccatcaacagacaagtttcctgagagctggtgaacatcttgccaacaagacatatttcgcaagctcaaaacctttctttccatccccaatcaaacgctgagtgttatgtctcaagaagaaagctggctgaggaaggagcttaacatccttccatgagcaaaaagaattaaagaaagggaagcaacaagttccagttccaaaatagctttttgataactaggaactaagcccagccctggacagtattactgactctcaccaccacctaaagcaggctctgccaaacacagcacaacaaccaactgctactaacaactttcactaagcaggtagtgcacggcaggcgctgacttagggcttaaaacacagctataatagtaatagctaaaacttattaagccattcttctaagtgctttatatgccaatatctcatgtaatcttaaaaatgaaccaaggagttaagtgccagtatcagtctcagatgcagaaactgaggtacggagagagtggtgagcttacacatttaaatggatggcagagctggggttcaaaggcaggtgcatctgaccccagaacctgtgtgcctactcaatactccacagagcccagcagctgggccacctgtgctaagaaccactgccatctctttgttttaaagtctccaaaagaagaggagcgggttatttagcacctacttttgcacagttgagtcacaagtgaggaaggcagcaccgctctctagttaaggatacaggttggaaagcaagattgtctgcattcaaatcctgactccaccgggtcccagctgtgtgaccttggacaagtcactaaactcttctgagcctcgagttcccccatctataaatgagggtagtaacacagtagtcaccccttatctgcagttttgttttttggcagtttcagttacctgtggtcaaccatggtctgaaaatactaagtggaaaattccacaaacaatttggaagttttaaatttcacgccgttctgcgtgatgaaatctcatgccttcccactccatcctgcctgggacatgaatcatctttttgtcccgcgtatccacactgtacaagctatgtacccgttagtcactcaggagccagctcggttctcagatccactgtcatggtgtcacagtgcttgcgttcaagttacccttattttgcttcataatggccctaaaacacaagagtagtgatgccagcaattcagatatgccgaagtgaagacaaaagggcttctttaagtgcaatttctcaatttaataaaggaagggaaaaactatatgcggagactaagatctatggtaagaatgagtcttctatctaaaattttgaaggaaaagaaatttgtgctagttttgctgtcacacctcaatgcaaagcatatagggttcgatattatctgtggtttcaggcatccaatgggggtcttggagtatatcccccatagctaaggagggacaactgctatacatacattatactgttattttaaggattatgtgggggtaatcctcattcagcatctggcacatacctgggacatagtcactgctccataaattctacatgttaagtcaacagaaaagaggaagaaacaagaaagtaaaagcatataatctaacaatttcacaacaaaggcctcgctggccttctgccaacctccagaaaacagtgctggactctgtgtacccgcagtgtggctgggactgcagacaccaggaagaccttgggacctgtggagcctggatggttcagttgtctgagccaaggagggctggattaggctcagtgatcgaagctgagcaagtttcagcacatacctctacaaagtggacgcccagggatggctgatatgatgattctttaggaagccaaatgctcagtttctcagaaaggtgttttcctgtttcatgacagataaaaaggtttctcatccagacaaataaatctgctgactgagagctttcattaaaagcaaacagtcttgcaataaggaaccgtaagctaggaaggccttccatgaatatatgaaatgtcacaagtcctcagcctgtgtctgagagtgagagagggagaaatttgagaaggtgctgaccagctcaaagactgggatatcataaccctaacaacatccagtcagtacattcctcacctacaaacgaaaatcacaggcaaggccacgcaccgctgagtcccaggagacacaccttcccaaataagtgtttgggtgggttgctgttaacttccaataaagcagataaatgtcatcaattgcttcctgtcttcaggtcttgtcaatacagaatgctaagtccgctagcctcgaaagcctgtgtaccttccacagtcttaaagacttgatgggaaactggaaaagcaatcaggaacagaacaccatgggcacgagactcattccaggtactgtcacagcaagatacccttctagtattccaaagctaggaacacacctccccttgctcccgccagcccagggaaaccgaataagctgtttaccagggaccccagcaaagcgagcctcaaaactcaccagtgggagaacttcatgacacaaagagaaaacattgttgctttcatttgccaatttttaaatacttagctcataagttctgtgaccaaaactaatagaaggctcgggaggagagctcggaaaagcagagggggttgttttcctaggctccttcctctaacacgaaggtggaaatcaattcgctttccccttctaacccttgaatccctggagaacgatcgtatttggatggcctacgaatgctcagctttccagtagtgccccagacgaggaatccatccatccaagtattgttcttacctcccactacctcctacgtcaggggaggggaccgggcacatggttccgaggtcatgctcctcacttagaggatcgtgggaatgcttacggaaacacttgtcacggcgctgccagctggaatcgctgcttaagaagaggctggaaaactagggagtgcgcgatcagagacgggaggctggggagagcagggaggcagatgttgtgtgttatcactgaaacaaacacaagccatccagttgtgcacttcagctacgtgcggcttagcgtacttcgataatgcctccagaaagtcagggaaaggaaatacagaggaagctgggcctctcttctaccacctcgaaactgtcctgctgccaaacagatctgggaaagcaggttttaatgagaaaattcaattaagaaataaacttaagtaaccccatagcatgctgagtgaagagaggagcctttctcaagtgtcttagtgccgaggagtggaccaaggggctctgaaaaatgaccaatgaggcttcccgccactcagaggaagccaagctcagaaaggccacgaagaccatcctcgcttaagcgcggggccagattccaaggccaggtctgctccgcctcatccatttcttgtgctgcttcccagtgagactcagcagaggacacacgaggccacatgaggtactcacatcaggatctcagctctctaacacagggaggggtgcaacgaaggcaaggacacaggtgctgtgcgtgactccccaccggggccggcgggcactgggtggctcagagatcattaggaacggtcgctccctccctttctcctggtttcccttctgtcctctgatagaggaaagtggcttagatcattctcacaggaagattaaatccagagcaagggaaagggataggaatccgtttccaatcaatgatggaaaccagattccctcatcagttgggattcattcttacatgttgtaaacatcacagagctccacccatggctacaagcgttcaggaggtatgaagcatggtggcacatcctgggtgagagctgcctgtggccaagaagcctcccggcttgggctggcccatctgagggacaggaagcaacacgtctcttggaagttatccccaaaactcccatctcagaaaggtgagataaagcacaagactgtcccactcttgtaaatgttctatatttacaggaataaagttttaaaaccatcttagacaactataacctccttcctgtagaacatacccatgtacatttgtactcatatgggaaaatatggtatcaattattaatagtaaagtatttgaattaaaggtcttttgttcttgaagaaccacgggatctcagtttcagtggccttggagtcccacttcccccgtatgaaatccctaaagcactaggtgttttgacccctgcttgatcttgactatggggaaaatgcaccatgtccccagtcagcctgtgtcacgcggtgctggctgtttggcagctctgccttacactgcagcctccagcacagagagtcctctgtccagaaccacctcaaggatgtgcaagttctctgccacatggcatccctcagacacctgaagtgagccatctcagcctccctccaagcagcttccctcccggctgacactcccagctctgctgtgtcctgcacatggcacgcttccgagaccactcgccctcggctgtcccctggggttcatgccactggatcactgggtgcttaataggcgccaaccatttcagaaaccacctcttattcccgtgagagcaacccctgcaagtattctgttttggttttgtttgtgctttttctttttgcaggaatcaaggccctaacatccagaacctcagcagtctctctggctgccatccacatcatctgcccagacacaaagagagcgggacaggaccacagcgtggccaggtgggggtgctaccggttttccctacagctgacgtaaaatacatatattactgcaaatctaataacctgcttagaaagcacttcaaggcagaaccattcaggaaataccttaatacaaaatacctttgtttttcttttctttttgtttttctgaagcagggtcttgcttgcataccaccatgtctggttaatttttgtactttttggagagacggggtttcaccatgttacccgggctggtcttaaactcctgggctcaagcgatccacctgtctcagccttccaaagtgctgggattacaggtgtgagccatgcacccggcccataaaatacacctttgtaatgaatatgtgagaaatagatactggaagagatgatgtaaaaacaattttttatttttatttaatctctcttatgcagattaagcatttcccctgaaatccaaccctcacagctcagtccaaacttttcctcaccgtgaaaaggtgaactccagaccagcctaaggccaaccgttctgaatggcaaccactagattcaaagcaaggtgctgtgatgttgctaggtgtttggtttgtgctcctatgaccagtgtggggggaagggacttgggcagacatccaagctgaggtcccctgggcagagtgactcagaattagtgtctggataggcatccgtgcacccaacgctactgacttactccagttcatcctgaagacagactattacagtaaaagccatgttttaaaaaagttatagctgctaggccgggcgcggtggctcacgcctgtaatcccagcactttgggaggccgaggagggcagatcacaaagtcaggagatcgagaccaccttggctaacatggtgaaaccccgtctctactaaaaatacaaacaattagccaggtgtggtggcgggtgcctgtggtcccagctactcgggagactgaggcaggagaatggcgtgaacccgggaggcggagcttgcagtgagctgagatcgtgccactgcactccagcctgggcgacagagtgagactccatctcaaaacaaaaaacaaaaaacaaaaaacaaaacagttatagctgctaaaaccttatgcagaaagtccacgaaatttgaaaatatacatcatataaacgtaagcaaggctgaaaacacgtgaatcccagttagctcaccctgcattcctgcccatgcagctcgtgacccagctacagccttgggtctgtactctccctgcagtcagaggatggggacaggtggcacactgctggcctgagcacaacaggagtccgtttgcttggggacatttcttggaaataaagtaagtataagggtgtactcaggaacactgcattttatctgggactcggctttgttgcccagcccagcacagggaaagaggagttttaaagtgtttcagaggaagaaagagaaaaccttgttggcctcaggggagtgaggtatagcacactcattcagcttcatttactgagtacctacctagtatacacagcagggcatgttcacccctttttttgcataacaacatacacccagggtggctccagtatactcagaactacggaactgaagaagcatcacatcacatctttcccaagtgatgctgggtggggtccccagtgtagaaggcagacagagaaaaaaaaaaaaaacagcagcaccaagcggctcaaaagctcaggagaggccgggcacagtggctcatgcctataatcccagcactttgggaggccgaggcgggcagatcacctaaggtcaggagttcgagaccagcctggcaaacatggcaaaaccccatctctaccaaaagtacaaaaattagctgggcgtggtggtggatgccttgtaatcccagctacttgggaggctgaagcaggagaattgcttgaaccggggaggcggaggttgcagtgcgctgagattgtgccactgcactccagcctgggcgacagagcaagactctgtctccaaaaaaaaaaaaaaaaaaagcacaggagaggtatccacagcccttaaaaagcatcagtgatagctccaaatgctgaaagatgaagggctctgtcatctttaaaccctgtttgtgatttccagtttcaatgagcctgttacattattactgtaatcctaaaaaaaaggctcacaaattttttaactgacaattttcaaaaaacaaaagtcagtgcttagtcctgttgtttacatcgggtacactattagaatctggctttcagaatggagagacccagactgctcatgacaattacaccagaggatctgattcaaactgattcgagctggggagtgggggggcgtggagtgagcaggagcagctgaaacaacgctgggcacggaggataactgctgaagttgagtgacagataattgggggctcattatatcacgtgcttgaaattctctgtaacaaaaagttctctgaatttaaatcaggcaacactaacttaaagttcccttacggtaaggcctggttgccacctactcctaggctcttgcaagctttaaggccagtatgagtcgaatgtttactggacattaggcagttttctcacactcacactcgcactcggtccaggaaagccctcccggggcagggggccaaacgaaaccctaaatgcagctttgtagcagcccagctgctctgaaggactgaaaaacacagggtcctcaaaaatcaccaaaaaaccctttggcttggacagcttttccttccctggcttcctgtaaagatgccgcaggctccctagaatctccaactccggtttgtttttaggaaagttccgttgctcctgccttcagcttggctgcctactccacgttacacaaatacacctcctctgtgcggcgcaaacaacctctacgccagtggtgctgaaggaggccttcgctacttgcatccatcctatcagcgtccagaggagtgaacacgtagatgtctatcactgacttcatacccttcccccaacaaaaaaaccttaaaatcataattacatccttctctacaatgacctttcttacttttataacaggattttaaaaatccattcctggccaggagtggtagttcacgcctgtaatcacagcactttgtgaggccaagctgggaggatggcttgagcccaggacttccgagaccagcctgggcaacatactgagatcccatctctacaaaaaaaaaaaatacaaaaaaattagccaggcatggtagcgcgtgcctgtagtcccagctactcgggaggctgaggcagaaggatcacctgagcctgggaggtcaaagcttcagtgagctatgatcacaccactgtactctagcctgggcaacagagaaagaccctatctcaaaaaaataaaaataaaagataaaaatccattcctttttttaaaataagacactgtataatattaatatagccacggcagcaccactggacttacggcctggctttagggagacctcagactgttgacgtcagtttctggtccacagctgccttggaaacctccctgagccaaaattaaaacaacagctttctctcagggtatgcttaagttattgttgttgttgttgttgttttaaaaagaaaaaaagacaacaggtttgatgtgacactcagtgtctccggtgtgccaggcactgtgtcaggtactttacaaacaaggaaagcaaggcacagagaggccaggtcacctgggcaaggccgcctggcagatgctgtgtgtggccgcagagtgaggcatgtcccagactcagccttcctcaccaagagggactcaaagccttctggggcactctgtgatgaaagctatgggctctctccccagggagtgcacacacacaaaagtctgaatgaaatatctggtgggttcatagtgcccctctgttccccaaacgtcccctctggttaaaaaaactctattcaggtgaaaccctgtctctactaaaaatacaaaaattagccgggcgtggcggagcacgcctgtaatcccagctactcagggggctgaggcaggagaattgcttgaacctgggaggcagaggttgcagggagcagagataatgccactgcactccagccggggcaacagagccagactccgtctcaaggaaaaaaaaaaattctattcagattttcatcaatgaagagcttcagcaggagtgtctcccatagaaagaggcaggtgtgtctctggcctcaatccctctctctcctgaggtgtacatggccccagggcttgcccctccatcagtctgcaacaccccccagccctgaggtctcagacacccagctgccacctccccaccctgtgacaacttgggcttgtatcttattaaaacactctagggtccaaccctcttaaaacaatgaaaacattttctcactcatataaacaaacaaacctttactgaaaactaatgacgaacacaaagggactatttacagaaaacagcgtgcctagccccatctagattataaacataactgcacactggctctaaggaccctgccatcttcccaggccctggcctggctgttctgccactccccacctcatgcctgaaactgacacaaaggaaccaatcctccagccaaagtaagcaattacaacgtgtagctgaaattcagagaggtgatctaaaaagcaattttgtaagatagctccaaattgggaagaaaacaaatttttgtattttatttttatttttgagatggaatctcactctgttgcccaggctggagtgaagtggcgcaatcctggctcactgcaacctccacctcccaggttcaagcgattctcttgcctcagcctcccaagcagctgggactacaggcgcctgccactacacccagctaatttttgtatttttagtagagacgggatctcaccacgttggccaggctggtattgaactcctaatctccagtgatctgcccgcctcggcctcccaaagtgctgggtttataggtgtaagccaccacgcctggcctttttaaaatttttttgacccacgagatctttgacacaaagatatccatttcagcattatttatgatagcaaaaagtgaaaacagccttcatgtccaacatgagtaaattaaggtacaactgtaagatgaagcactgtacgatcactaacaggaagtttgcaaaggtgttttaagcaagtgggaataagacttatgtgacccaataggaaaaagcaggatgcaaatttcagagccatattttaaaaatgtgctcagaagactcgaacaaaaacccaccaaaaaagcaaaagttgtttcatccatgagggggaattttgagtgacttttttttttttaattctctttatacattttggcattttccaagagtaaaacatgcactttccccgctttgccctttccttctgattataaatggaacataggctctctgtaggaaattcaaagcattacagaaagtgaaacatccccctgtgatctcaccacctagagactccccaaaggtaactgccaataataacttggttcccattcttccagatgttttccaacagggattacttttagaatcaaataatttctctaaaaaataatccgcatgattccatacatatgaaatggccagacagaaagtgaatggtgagctggggcaggagtgggcatgaagaataactgcaaatggatgcaggaggtgttctgggggtgatggaaatgttccaaaattggattgtggttatggatgcacaactctgtaaatttcctaaaaatgtacaaaaccgcactgtacacttaaagctggggaatcttatatgtaaatcagatctcaataaagcagctgaaaaaagaacaaaacaaccactagaggcagggagtgctgggctgtgcaggagggcagtccatggctttatgctctgccctcaagagcacatggtaagaccctgtagcaggaacagaggaagctggaggcctctcggcatcacctggacaaacagccctcggcagagaggctcaacagataacctgagagcggcagggtcagcgaggtcagttccagtctacacgggaggcaggaagagcgccagccctgaaaatgcattcctgaggctcaggctgcactgccaggctcgctttaaagccaggccaaaggaaaacagcactggccggggtgtccaaatactttaccaagttcaggatgcactgcgtgcaggaaaactgagaccatttttctctgtttcaacagaaacttgaaaaccacccctgacaacatgttagtccctggaagtactcaattacggtgaaaagccatcggcaaaagttaaagtgagtaatatgacagtgagccatgtaagaagtaaaggtgagtggaagattatgaactacataaaaggcacaatgatctgagtctagaaaggcaatctggaagcctgaaaaggtacaaatgggtgcaattctcttagaaagtaatgggcaagtaaatgtcaaaagcgtttaaaatattcataacctcctaggaatctaccctaatgaaaccactcaagctgatgaacaaagatgcccactgctctacccactgctccacggcaaaaaaaactggaaataatctcccccaacaacagggaagtgatcatctactgtgtaacccttacaattgcacagtgttaaaaacgtgggaaaatgttttatgtttaattagcgaaactgaatataaaaatttactatcaagtgagtaaaaaaatgcccaaatcctggaaatgatatataaaaacgttaacagtgtttttctttaggtggaaagattgattttttcccctcctttcatatgtatttagtgaactccaagttttttccatcacatgatttcagtctctaaaaatccgtgatccatcacgccaactggattttgtcaattttaccctctatggtttgtactgtgcaaaactaggcttcactttattttccaaacaaaaaatactattactgagtatgttttctcaaattaccaccccactgcccaaaaaatgacacctgccacactcaagattatggtggcccccaggaggtgtgcccatcccagccctcactgggtgcaagctctctctttcttctatcatccttctgcagagaaggattttgtaattgttgttgctttgttttaaagtgggaaagaaaaatattgacgaacttaaaactcgacatagacagagacattgggcagcaccagacctaatcttttttttttttttttttttttttgagatggagtctcactctattcaagcaattctcctgtctcagcctcctgagcagctgggattacaggcacgctccaccacatccagctaattttttttttttttttttttggatttttagtagagatggggtttcaccatgttggccaggctggtctcaaactcctgacctcgggtgatctgcccacctcggcctcctaaagtgctgggattataggcgagagccactgcacctggcccagacctaatctttgagggaactcagcatcatcatagaaggctgaaaccacaagatctattttttgtgccttcctaagagtgttgtgtgcatgcagcaatccagcgaaatggtgagttgcacagatacacctgggggatgccagcctaagatcagggccagggtggcacagcagcaccctgggagctggtggaggagggcacggctcactgacgccatccgacccagccccagcagctcgcaggccacactgctcctctccgcctcggtggccttgccagaatgctgggcctctctgatgcactggtactatctaagcaatcggcaactaacagtagtgaaagcgtagttcattttaggtttaagaattagaacaggctcaatgttgctctctaatcacaccctcactcccctgcactctaataagcttccgtcagtgtgaagaaaagagggcggagggagggcttactcgagggaactgtgaaacacactcccccaggagtgggtggagctcaggacacctctcaggcctggcacaggtgggcttttctttcggaggaaaattaagtagtagccagtcaacctatcagccaactgcgcatcaaggggccacagtctataggatgggaagccaaaatatctccaagcaagaagggtggtgcgccgctgcgcacatcccaaatacccgcttctctccaggcactgcccacccatgagggactttcccttttccaagtggcagagctccactcctggctgtcaaccactgtgaatgggacatctcctctcctcctcccttccaccctttcgggagagcatttgattaatatttttctacttttgttgccccaagttgaggagtgtttagagatggaaaataatacattacttccctctctgacaaccgccttaatccacaaagcccagaggtaaaaactcacaagctgtttcttctctgaaccgcagaaacaaacctggttgcagttggggcactgtggaccagagaaagatgcagtgtttcatcattacctacccatgataaatgctgtaggggttttttcttattcaactgcagatgattcacattagaagctgcctggtgaccagactaactttcctccctacttgggcaaaaagttgtcacctagccaacacatttcctgggggtagactgtgccttgtggattccatcagctttgctatttacttctcccttcaccctggcagttaacatttcaaccctgatggccacggccacctgttgctcctcctcccccctcagatctaaagtgcgtgtcacctttctaggttctgggtcacatcttctgggctggccaaggcctgggcgagagaaccctgtatcctggaactgcctgggcattggaggaggtgatgggttaataacaatcgttttgcaggcaggggaggcgagggggcaagaggaagtggaaacatgacgtgactagggacgctgccccaggctgctcgctgcccgctcctgacttctcccatctggtttccatctgacccaagcagctggccagatggttttcatttgcagatgaaaccccagcagttccattgccacaaaaactcctgaccgtagagtctctgtaaggctgataacgcacaaagtgcactgcggtgtctctgagcaggcctgaaaggtcatgcttcccaaagccggaaccaggacaacaggaacaaagtggggtcttgacacttgaaaattccgatgacagccagaagaggaaatgcactggcctggcgagatgcgagtcacggtcaggcatggagctgaggaacggggaagattttgccagtgaatcagaccttgtctctatgccatccactagcatccttaaggtgaggaaagaaccagcaggtctcagggtgaaccatggtatgtccactcagtggaacagtacgaaacagctaaacccaggttcgtaaagaaaatgtaggctggactggctgggggctgtggcccacacctgtaatctcggcactttgggaagctgagacgggcagatcacttgagatcaggagttcgagaccagcctggctgacacggcaaaactctgtctctactaaaaacacaaaaattagctgggcgtggtgcgtgcctacagtcccatctacttgagaggctgaggcatgagaaaccttgaacctaagaggcagaggttgcagtgagccaagatcatgccactgcactctagcctggttgacagagcaagagtctgtctcaaaaaaaaaaaaaaaaagagagagacagagagaaagaaagaaagagagcgagagaaagagaaagaaaaaaatataggctgggcacagtagctcacgcctgttatcccagcactttgaggggctgagtcaggagaatcgatttgagcccaggagtttgagatcagcctgggcaacataaggagactctgtctctacaaataattaaaaaattagccaggcatgatgttgcgcacccgtagtcccacttactcacaggaggctgaggtgggaggactgcttgagcccaggaggtgggggctgcagtgagcaggaattgtaccattgcactccaacctgggcaacagagcaagaccctgtctccaaaaaaaaaaaaaaaaaaaaaaaaagaaaagaaaagaaaagaagaaaaaatgtagtaatacaatacatggaaatagtgataatgcaggctgagtattagttttccttatctgaaatgctggggacctgaagtgttttggattttgaattttttccaattttgaaatacttgcattatacttactggttgagaatcccaaatcagaaaatccaaaatccatgtcccaaagaacatttcctttgagcctcatgtcagtgctcacaaagttttgggttttggagcattctgggttttaaattttcacattagggatactcagcctgtaagagtgtgtcaggcactgttttaggcatgtaaaatgtgtcaactcaatcttcatagcatgcctgtaagacagcttatgttattaatcctacttcatagatgaggggactgaggtagggagaggttaaggagcttaccaaatatcacacaggtaataagtggcagagctggaagcctggttccagagacccaggtgaatcccaaaaaagagaagctgggcacaaggccccagggaagcaaaaacctgaaaaactatcctttcacacttgtgcagggtcagttgatgttaggcttgtattgcaaaatttatacttctgaagaaggataaagcagcaagagggaaaaagtatctaaaatgcagacacatataccacatttgttttggaaaagacaagtcaggagcccacaaaaggttatgaaaaaccccagtgacaccaccaccaatgtttgtctttggaataatggaaagagatgtgtattacttgtaagaatgatctctgctattacatgactcattcctgcatgcaaggactgctctcatctggtgccaaggaaagactgctgaattatggaattgcaaacattatcactgactgttactcacaacactgcagggcaaactgatatgcgccaaatcagccatgttaaggggttgttattgcacctctcctcaggaccagctgttgctatttcgcattaagactttaaccatatcttagtccaagaactcatcaacctcagcagttgagttgcttggaaatgcccagggtccacacaagttccccaggggaacccaccatgggtctggggactggagtcatgggacaaaaaggggaatggtagaggcagagaacagaaacagggaacggaaacaacagataaaaggaaatcactgacacagatggcatgcaaaaggcctttcagagtggaaatggacaatcccgaaattggcaacatatgatgtgctctttattcctgctccccaccggcatgtggtagaaggatgcagaggaaaggacggtaatgggtaagataatatgaataccaccctacaggcacgtgtcatctaggagcctaccgagtgtcccaccttagtgatctgaccctcagacaaaactgagagggagacgccaccatccccaccctgcagatgggagacagaggctctggggagtggtccccagaaacatgtggctactcagagacaaggctaggaccagggggtgatcactttccacatggacagtgtggaaatatcagccaataatgtgtcctctaatctatttattatggcctccacctctctgatgactttaaagtgcctcaccctcaacatagctgaaaccgaactaggtttgccccaccgaaacctagcagttatcatgcagataacagctaacatttactgagcatttattatgtgccaataataatgctatgaagcaattttactgtttattattgtaatttactgtttattattgtaattattattttattatttctctccacccaagtaccaaccctcccccactttgtccaagagaccacagtgattgccctacacctgccccaacccatcctctctgcacatctgggtcagggcaagctttccaagacttacctggccagtcctcactgcccaccccctgcagtcctcttacctgatcatccctccatccctctccatcccatgtcccagcctgctcctgcccccgactcagctccttcctgccaggcttctgcatgtactattccttctgcctggactgccaccccctcagctcaagcctgctcccccgcaacggctctagggcagcatctccctccagatgccatgaccccgtagttgttgatcattgcccccactgggacataggctccaggggagcaaaggaagaggctgttcttggtcgcctctgtactgcccgagtccggcacagtggtcggctcatagccaatgaataaacattcccggaacaattctatgactctcaaattagcctgagcaccaaaaagaggagcagggtctgagttgtgggctgagctatcctggtgccaaggcaggccttccactgccacgtacacaccctgaaggcagagtcagcacgcccaaatcctgtggggcctgatggtgaccactcaagctcggacaaaccccaagtgtgatctcactggaatccatgtcaacgcccaagtcctcaactccagcagaaactccccatctgttcctctgctctcctctccaccacactgccctcctgccactggaccctcaccactcccctccaagccccaccttcggcagtcagaataatttctttcttttttttttttttttttgtctttttttgagatggagtctcactctgtcgcccaggctagaatgcagtggagcgctcttggctcactgcaacctctgcctcctgagttcaagcgattcacctgcctcagtctcccaaatggctgggattataggcacctgtcaccatgcccaactaattttttttatttttagtagacatacagtttcaccatgctggccaggctggtctcgaactcctgacctcaggtgatccacctgcctcagcctcccaaagcactgggattagaggcgtgagccaccgtgcctggctggcagtcagaataatttattttaacataaataaagtcatcgcccagattgacaccttccagcttcttgtgactgttagacttacaacctggcatacaggcccggtgtcaccgggcccctgtgctactgataactaacagcacgtcttttattctatttttttgttttgtttttttgagttggggtctcactttgtcgcctaggctggagtgcagtggcacaatctcggctcactgcagcctccacctcccaggttcaagcagttctcccacctcagcctcctgagtacctgggattacaggggcgcaccaccacgccagctaatttttgtatttttagtagagacggcgtttcaccatgttggccaggctggactcgaactcctgacctcaggtgatctacctgcctcggcctcccaaagtgctgtgactacaggcgtgagccactgcccctggccaccagcgcctctttctatgtctcaacctgggaagccttgtacccgtggccccttccttgtcttctcctcccacctggaaggcctctctctccttctaggtcttccctgtcacctgacttcacaacacatctcacaactcaaaatgactgtgtttgtatcacaatcacaatctgtcccgcccagaatagcaggggctttgtcttgttcaccatccctgtgaatatttgctgaatccaccccttttactatgtgaatagtgaacaattactgagcccttgctgggggctaggcagtgaaatgcacattagatgcattaactcatcccctggtagacatccctactgccattttacagatgaaaatgaggaacaaagaagctaaggactggggccacttgggactcacgcccaggcagccagctgcagcgtctgcaatttcaaccctcccctaagtgcgctgcctcctggagttgtagaaggctacagactcatcccccagagtggccagggctcctggagggcaggcatcacatcttaggtttctccaggctcaggccctccaacaggaggtcctgaataaaagctcaggaataactgcagttcaaggaagccttggctagaaaaccctacaataaaaggcaggcaagactggccatgagtagcgccatccctgcagtgctgataattcacacctgcactcacaggtaggctaaggcagtccctcaggtgggctgaagaatgaaatgctggccacgtaagatgtaaaccccaaagagcaagtttgtcccatcaggtcccctatgttaccccataatatctgcatcctgatctttaaaactcttttccagagaaagtcaagcaaatgatatttggagggctttcctgctgcttttattttggaaagttatataagagtcctaagagtcactcctgagcgcttagagtagtggcacatttatgcacattcctcacttggtccttacaacaaccctctgagtcacacacgatcatcccaaatgacaattgtggaaaccgaggctcagtgacctgagggacttgcctagggccacagagctgccaagcaggaaatctaggctgcctgagtgcaagctcgcagtctgtactgtaatgccaaaggcttcactaactcatttcagaaagcaattgtcacgatcttctctaaactattaatacttacaaatactcattcaaggagtagagcttagaggctgtgaggcaaaggcagaaccatttctgggtgacacatcagaaaattactgttccgttcatctaaatgatgtttaaaatgcccactgcagcatgaaagtgcctctgctgagaaactgcagacatcagcaggagccataaaggaaagataaactcttggtaaagggaaggaagaggggctgagtgggtgagttacagctgaattcacaggacaccggtcccgcaaagaggaagccaaattgcagtccaagcagccaggatgcggagggcccggagggcttggaaccctgcaggcagcctggctgtggagacagagcaggacaagctctgagacacccccaggagtggcagacagagacaattcatgcctcccgtcccgggagcaggcaagggttcctgggttaaggggaaacaaaggggtccatctaaaaaatatgaaaggcctggctgtgctgagtgtgggtgaataaggtggagtatggttaacaaaacgattccacatcagcaaatgctaacacagggctcctgggatcccatagagagagagtctatttccatttttatttcttaactcaaaaaataaaattaaactttactttctagaagaggacgatgagagaagatcgctgggtggccacgtgatggataagacatgcaggcctcccttgctggtccccactggcctcattaaggctgggactattatttctcaacacacatggtctgtcctgtcacacgctagtggtttccaacaagcgggatgcccacagcaagtgccctccaatccgtcacagtccctgccgcatcttgggtctcttgacctggcctatttactcttatctaccagccactgtgggcctttggatttgcatcctgcttgataaaaatcactgaggagctacaaagagatgagattggccctgacgccaattgtcactcatctcaggtccttccaaaagagctggcagactcagaggtccatggacactgccacatccagtaccacaggctacaacacatacacttcctttctaagccatgaataggtcacaatctcaagcaagttatatacacaggaaaaacaagggccagtttcctacattttataagattcttatatgcaaggctcttgtttatttgtttttcagaccaagtctcactctgttgcccagggtggagtgcagtggcacgatctcagctctgcaacctctgcctcctgggttcaagcggttctcctgcctcagcctcccaagtagctgggactacaggcgcgcaccatcatgtctggctaatttttgcatttttggtagagatggagttttgccatgttggccaggctggccttgaactcctggcctcaagtgatgtgcctgccttggcctcccaaagtgctgaaattacaggtgtgaaccaccaggcccggtccacaaggctcataattttaagggcaaccaacaatctgctgctatagtaaacagaacacattgaagagagaagcaagagctttgagaagtaaacaaaagaaattttaaaataatctgaatactaatgacacctctaagaagagggtcaggtgcaaatccaagccaggatcaggtattccattggaaactagttttttaaaaaaataaatcccacaagataatctctggtttcacacagagactggtatacaacaggaccatctttccagcgttagcctcaatatcccagtcttgggttcccttcaacgtaggtgttcttggttcatcgactgcctcacatggaatgcagaactatccccctacccatgcacgattcccccgtacagaaaaaaattcagagcaagaatactccagcccacagacccagcctgtctttaaggatcagaccatcccacaacgtgacatcctcgaacagactatttcactggggctgcccatggagtctatttgggaaaggcaaacagagcggccgatggcaggggctgctcagatcacaggaatcccaaacctaacaaaaacccaataatgttataaagggagaagggaagatgatgcttaaatctcaaacacaacttcagcaaaaggtattgttgcatgggtcatctgtattcctccaggacagaagatggtaagagcactaataaaggtcattatactcatttgagcagggcactcttgaagattttcatccaggaaatggaccagcattccaaactattacttagagattagctctgtgtgtgttggagggtagcctaaagggttagggttaaccccagaaaggcaggaagttccagaaaaaaggcagtcattctacccaagtcttgttggaactaaagcacagcgggaaaagcgagcaaaccaaaggggaattagagacactcacaaagggaggggccttgggattaatggactctctaatttttgaatttcctgaggtttacggctgattaggccccttagccatactgtaatgtgatcaaatttcaactgggttcacagcacagttgaaggtagaagatgacacagacatcaccagtgggccccagagactacagacaaggtccgcagtgctcgcttccgggcttgatcgcactaattaggcacctttaattccccaaacaatggcgcacaggctggctcagagggcactgtgtgatccaccgcatgcttgaggagctcttacaatactatgtactgataattctctaatttggtacaagcatatttaagcacatggctcaaaggtggagagaaatgacattgcaacccgcaaacacatatgcacaaaaatattcaactttgccaagtgaagacatacaagtgaaaaatgagggacgatgtactgctgactaaattagaaattaagggagaaaagcgcccagtgttaacaaagaagcaataacctgatgctcacactgcggacggtgttatgaatcggcctgacactttggaaagcaacttggcagaatttgtcaagagctgtaaaagtgttcatactgtggcacggtaacgttactcctgggaatccaaacacagaaaccacttcagaaggaccagtcactgtgacatcgcttataaggaaaaaaaagaaaaacaacaacaactggaaaaaacctaaagggcaacatcagggaagttacccccctgccatctgatgtttaaggagtaaacagccagtaagcaatgatggttgtaaggacttcctgataatgtgggaaaagtcttaggtcataataatttttaaaaaggaagatgaataattatatgtagcctatgaccacaactaatcaaaaacctcatgtatataagaaataaaaggagttgccaaaaaaaaaaaaaaaaacactaaactggtgcaagtgacttttttccttctgtgatctgagctttccacaatgatgctttattaagttgaactacatgaaattgccaacacacagccatttctgacctacacaagtggcactttcacatgggtcaacataatattttttgaaagttttaatacttttatgaaagtatttttatgaaagctttaatacttttatgaaagtatttatccaagttttgttttgttttgtttgtttgcttaattttgagacggagtttcactcctgttgcccaggctggagtgcagtggtgcgatctcagctcactgcaaccctccacctcccgggttcaagtgattctcctgcctcagcctcccaagtagctgggattacaggtgcctgccaccaagcctggctaattttttgtacttttagtagagacggggtttcgccatgttgggcaggctggtctttaactcctgacctcaggtgatccgctcgcctcagcctcccaaagtgctgggattacaggcgtgagccaccatgcccagccttatgcaaggtttaataactttagatgttcacagtatctgcccctgctctgcgctaccacccctcttcaatgtctaaggacagatctgtaaacacatgtgacacacaaatagagtggtctaaaagcagtcctcagaattctgtaatccaaaaaggagagaaatccttctaaggtgtgaagcaacggacagaaacaaaatgaccaaagtcagtttcaccacatttaagcccaattctgaaaaatgcaggcaggcttctcctttttaactactaggtggagagggcacctccatgtggaacattcgaagggcagaaacagctcaccaggtcaggaaagccagcaggcaaagtctgttggcaggagaccgttggcaggaaggtgtggtagggaaagtgccaccccacgggcctgaccctcccgcctgcctgcccttccaaaggcctcctccaccttcaaccaggtcccatttttccaggccagagtcttaaaggatgtttgcttccctttgctggcctgaggacaaggctaattttactcaacaaagtaaaaaggatggaaagaacacactgaaaagaacaggctgaacaaccacctgtatgggtagagccatttaaaaatcattcaaacacaggcacagaaaacacctcaacaaatgtctatcaaagtcttagcagtatctcaggggtagaatgaaaagtcgttaaagttgttaaagttctgtgttatttaaataaaataagcattacttttgcaggcagaaagacaattcggagattaaaatatttttaaagagagaaaataggagacctgctttgattgatttttttaaaaccttctaccacgccttgctcagcctctcagcccccacacctggggtagaatttcttcatccaaaaaacgggataggggctgggagaaagaaatgccagtacccggacagccactgtgggccgggcactgtgctgggagctttagccacatcgtccacccttccacttggttgaagaagagtaaaacagtcccccttacctgcagtttcactttctgcagtttcaattacccacagtcaacagtggtctgaaaatattaagtgaaaaactctagaaatgaacaattcagaagttcaaaatttcccacggctctgagtagcatgatgacatcctgctgtaccgccccagacgtaaatcatccctttatccagtgaatccactgtctacaccgcccaccccatagtcacgtagttgccttcttagtgatcacacagttgcagtccttgtgttcaagtcacccttatctgacttaataatggccccaaagcgcaagagtagtgatgctgtcaattccattatcccaaagagaagttgccaaatgcttcctttaagtgaaaaggtgaaagttcttgatctaataaggaacgaaaaaaaactgtatgctgaggttactaagatctacagtaagaacaaaccttctatctgtaaaattgtgaaggaaaaataaatgctagttttactgtcacacctcaaactgcaaaagttacagccacagtgtgtagtaagtgcttagttaagatggaaaaggcattaaatttgtgagtggaagacatgaacagtattggttttttgtttgtttgtttttttatgagacggagtctcgctctgtcgcccaggctacagcactgtggcgcgatctcagctcactgcaagctctgcctcccgggttcacaccattctcctgcctcagcctcccgagtagctgggactacaggtgcccgccaccgcgcccggctaattttttgtatttttagtagagacaggtttcaccgtgttagccaggatggtctcgatctcttgacctcgtgatccacctgcctcggcctcccaaagtgctaggattacaggcgtgagccactgtgcccaggctttttttttttttttttttttttgtatttttggtggagatgttgccccggctggtctcaagctcctgagctcaagcgatccacccacctcagcatcacagagtgcagggattacaggcatgagccaccaagttctgatcaacggtactaaccgcagtttcaggcatccactcggggtcttggcacacattccccacggataggggaggatggctgtatcactccttaagagcaacaggcagccagggaccccagctcaacacccaccgacacatgatgtctactgtgttctgaacatgcataagcatataatttgaactgcattgttagccttcaggaaaggggcaccaggagctgtgctggccaggtacctagatcatttactgttcaaaaccaacccaggagctgagctactgagctcagcctccctctctcaaggctgggaaaggaaagttcatcttcactcagatgcaagcttcaagtaggcagagcagctgtctcttattcacccctgggcgggggcgggggggggaggggcgggttccagcacagcacgtggctcatgggctgagcctccagaagtattgttagtggatgggagaatggatcttcatatgggcttagagaggtgaagggacttgcacaaggtcacccagctagtaagcagggggtggagcccactttcaggtccaaactggcaagcctcagcataggtcactgttgctttgcaaactggcaaccctcagcataggtcacacagagggacaactgaacgttgtaggaccaggctctgcctccttctctctcccccgacccacctgccactccttggagctcctggctgaggcggagcttcacccagcctgagctgagcatgggcatccagaggcactccagtcggggtctgtttcacagaagcaggcccttcgtgaatatgcatgaggggcatgagctggcttccacgcatgcttcctgctcacctcatcctaaatcctaaacccgcagggccattgcccccttgacttgagcactagggtaaaatctatttttgtaaaaacctgatggaacttttacttaaaataagagttttaagtgtttatggaaacgaaatctatcttttagaagccactgcataaatacttaactgaagaagagtttggaatggggcaagcctgagtaggaatccgaatgctatggatcaccagaaacatcataacaggcgaattacctaccctcactgagcctcagttttcttgtctctaaaactaggataataacacctagctcactggggtgaatgaagattaagtcattacatttaagtgagatgatgcattgacttaatgtcttgaatactgtctctggcacacagcaatgaataaatatgtgctattactactgattctattaatgatacaatcataaaaatgactgcacaagaagggacctgcagtctcggctactcaggaggctgaggaaggaggatcacctgagcccagggctttgaggctgcagtgagctgtgatcacacctgtgaatgagccactgcactccagcctgggcaagataccccatctctttaaaaaaaaaaaattaaggccaggcgcggtggctcatgcctgtaatactagcactttgggaggccgaggcaggtggatcacgaggtcaggagattgagaccatcctggctaacacggtgaaaccccgtctctactaaaaatacaaaaaaaaaaaattagccaggcgtggtggcgggcgcctgtagtcccagctactcaggaggctgaggcaggagaatggcgtgaacctgggaggcggagcttgcagtgagctgagatcgtgccactgcactctagcctgggcgacagagtgagactccgtctcaaaaaaaaaaaaaattaaaattaaaaaaagtcatctggtccaaaccctcaatacaggtggggaaactgaggcccaaggagggtaagcatgttagataactcctgatagtccaacagcatttactgcagtgtttaaaaaatagtaggcacgaagtaagcgcattgaataaataataaccacatatgaaacaacatattcacctattcacctaatgtgcttcaaaacagttaaaaacaggtccagttgaatggcattccctctggctcctatccagaagaattctttaaagaaaagttctcaatgggagtcaacattcatcagcacccgcactgttcgctaaggcagccactagccttcgataatttcaatttatcaaattgaattcactgatactgaaatttcagtccactaaaatgaaataaaaccaaatattcagttcctcaatcacactagccacatttcaagtgctcaagagctgtatgtggatagtgattatggaacagcccagatatagaacatttccatcatcacagaaagttccagtggacagcacagctgcaaagagaagatatcattaatgtgtaatttctgttctcatccagcagatttagtttcctaaatcctattgcaaggcagcaggaagggaaagacctcgttagccttgctttattatgcaaatctgcatattcctgtcaagtccaatctccctcagaaagttcaaatagagtattattaggtggctgcgcgggtctacagggcaatgtctggggtctgagggcaggtgagagtacacaggattttatgaaaatgtgttctgtgcaaacacctcacttgtgccgctcttctccacaccagcaaactgagcattctttaacacagttcggcaaccgctggccaagcctcacttacataagagtgccataaaagactgggtcggctgcttctgcaaaacacctgtggttttgcaaaaggatgtgatttcttagaagtcagtaaacaggctcatttcctttacagttaaattttggcatcagaataccaaaatactctatgaccccacctaagctcacataaccttactccccaccttaaatggttgggagagcaaaaggccctgtgagctggaactgcccagggtgccagccttgctgctgggccagtggccaccatgcccacctccaccactttcctttgaggccccaggaggctggtacacactccaggagccaggaagaccacttggcacccttagctcctgggacactagaacacatggccaagttataaagacttcatatgcatcttctcatctggaggtgaggccctttcaaagcacacagggtggagaaacgtggataatatttcaccctctatgttaaaaagaggagaaatgaaatatatttgtatttgcttgttatgcctaaagaaatgaggacagcaggccaggcacggtggcttatgcctgtaatcccaacattttggaaggtcaaggtgggcagatcacttgagaccaggagtttgagccgggccaacatggtgaacccctatctctactaaaaatacaaaaaaaaaaaaaaaaattagctggatgtggtggtgcacacctgtaatctcagctactcaggaggctgaggcaggagaattgctttaacctgggagacagaggttgtagtgagccaagatcatgccactgcactccagcctgggcaacagagcaagactctgtcgaaaaagggaagaaagaaaagagaaaagaaagagaggagcaaaggaggaaaggaagaaagaaaaccgaaaaagaaaaagtccacataaaagcttatctctgaagattttttttttttttttttttgagatggagtctcgctctgtcgcccaggctggagtgcagtggtgcaatctcggctcactgcaagctccacctcccgggttcacgccattctcctgcctcagcctcccgagtagctgggactacaggtgcccgccaccatgcccggctaattttttgtatttctagtagagacggggtttcaccgttgttagccaggatggtctcgatctcttgacctcgtgatccacccgcctcggcctcccaaaatgctgggattacaggtgtaagccaccgcacccggccctatctgtgaagatttataacagatttactctcaacatccaaaaactggaggcaacccaaatgttcatcaactgctgaatggtacgtccataccatggaatactatggaatgctctacagcaagaaaaggaaatattaatacatgcaacatgaatgaatcaaataaatcatgttacacgaaagaggtcaaacacaaaagactccatactatctgcttccatttatttacaattatagaaaaggcaaaaccgcggtgacaaagcagatcagtggttgtctagggatggggaacaaggctgtctaggagggggaaaagggccaaaggggcatgaagggactttttagggtgaggaaactgttctataactcgattgtggtggtggcaacatgattagtaccaaaactcaaactgtacacttaaagctggttaattttattacttgcaaataataccctgattaaaaacaaaaaaaagaagaccctagaaatcttagctgtggttggcaggggagagtggaagacactgggcatgtgagaagagaaggcagtgttttatgtgtgttgtggtctgaatgctggtaccccctcaaaattcatatgctgaaacataatccccaatgccagagttaagaggtgaggcctttaagaggtgattagatcatgagggccccaccttcatgaatgacattaatgcccctataagaggcccaggggagctggccagccccttccaccatgtgaggcgctgtctatgatgcagagaacaagcctttgccaaacactgagtctgccaagaccttgcttacggacttcccagccttcagaactgtgagtaatcaatttctgttgtgtacaaattattcagtttaaggtatttgttccaggagcccaaacagactaagacaatgtatatatttttatttttgaaacctgtgactgaattgcctattccaaacttgagctctaattctttcaaagccaactgcagaggtgactctgtgcaatggctcaggtagaagtggtgtggtccattgctgggttcctgttggtcagggatataggcaccaaaagcttagagggtggggagaatgaaaacctctggatctaaccagagctgaatgtagaaaaccatctatctcctctcctcccagaagccagtgcctcctgtcctgggcctctgggctcatgtgataaagacaagagctaccatttattgggcacttactatgtcccaggtgctacgactcatttgacgtgcattaactcattaacagtgataagaccaacaacatgtacggagccctatatgtgctaggtatgacaggccttcttacctgcttgacctcatttaattagcctcaaatcgatcctatgacaaggaaccagtcccagagagttaagtgaagcccaaggctacacagctaaaagtgtaagggaacaaagatttaaacccaggcagtctggccccaggagcccagctaccatccatgaccaaggacaacccttttattgggacagaggcgacactaatcactgcacgcacttaggctgaggtgtggtgggtggaggatcagactcagaggtgaatctgtgctcctggcctactccaccagctccacagctccgccaggagggtctttcactcccacactggggaggcagagccagatgcatggagctattcaaggtcctgcctagctccaaagcccttactctttgcactagaccaggctgcttccttggctaataaacagtgagagctgaaacccaaacaaaaacaagcagcacacgtgaagacaaaatgttcctgagctgcaacgtttttcaatcttttgagctcatagatcacatgtctaggtcagagtcctgagcttcctcacggcgcaggtgatgtgagaggggctgagtaacctcgaggtaccactgaatggcatcctgcagtcactcaaaacgtgtgagcctggagggaccctggtgctcacatggtctgatatgcaaagaagaaaaagaggcatgggggatcgggaatagttcaacatcacccagcacatcagaggccaggatgcagtcccaagtcacgctccagactcctggtacagtgctcttttcacgcctgcagcatttcccatggcatgctgtgcaggccaatggggtttaagggaggttttagagagcatatggatgaatgcagtttaataattacctatatttaatattcataggaaaaatataactagcacatcaaacatgattttgtagatgtttctgcttacgaagaggctagatagcggtgttaggctcaggccaaagttttttgtttttgtttttgagagagggtgttgttctgtcacccaggctggaatgcaggagttattcataggaaaaatcctaacacacaagctccagggatcctcccgcctcagcctcccaagtagctgggactccagatgcaccatcacacccagcttttatttatttatttatttattttgtagagattgggtctcactatgttgcctaggctggtcccaagtgatcctcccaccttggcctcccgaagtgctgagatccaccatgcctggcaactacgggcactgtgcccagccctcaagccaattttaaggaaagcctcaaataaataataataaaagtagcatacaaatccagcaaacattgtgctggtagacagccacactgggctcattcctgcagtgcagcaggctaaagcaagaaggaataaaaggaaagataaagcaaacagaagggagaagggaggcaaagagaggaacagtcccctccagcggctcagctcttgcgctgaggagtgaggcccccacagcagaggacacggatgtgccacactcattctccctacaaacttatctagcctaagtcaccgctcttctcaccccaaacgtgctaaggtccaaaggtccaaacactgtgtatcagcccaatcacagggagcaaatggccctttaacacccgccctgagactactatcagaatggcctccctctatcccagtatgtgggacaggtatcagctcagatatttaatccattttcttgcctgagtgattcaggtgtccccattaaattctcttccatctgctgcatgcttcccagtgcagagaggccagagggcccccgaaagcctccccattcacaaaagcccaaatgaccagggctgttttggtttaaagcacaatttgggttcacataacacctcattatgcttccccgacatcgtttccacaccagcatcagatgctgggaactagagcttgaaaacactgcagggccgcagagctctcaagagctgtgcccattccacccctgcagggcctaagaatgcagccctcagccaggcgcagtggctcacgcctgtaatcccaacactttgagaggctgaggcaggaggatcccttgagctcaggagtccaaggctgctgtgagctatgattgagccactgcactccagcctgggtgacagagtgagaccccgcctcctaaaaaagggggctaggcactgacaatatgaactccaaactatgcatatagactaagacgctgaaacaatatattgaaaggttaacagtgctgctggcaagctaagattatgaattatttttgtttcttccctcttttctatattttcaaacttttccataataaacatactgcttttataacaaaacaaaaaaacacaataaacttttatttaatgatactatcaggttacaaagggctccctcctgatggggagaggggtcccttgccactggtgctcacactcaaccaagcgccatccactcccctccactagcctgtgggcctttcactagctcggggtccccaaggcctggaacataggaggcgctcagggaatgatgatacacaggggttgggggtggagtcgtgaaaaggaagtcaatgataaactctgaggtatcagctgtgcggcagggtggggcggagcagggcagggcagagcagggcagggcaggagagtgtactgaaatagaagagggtaaatcagagcctccttccacccaggacttccttctcagcatggccctgcctcccacccagctgctttgaaagctctcccacccctcactcttctggctcctctgagtttaaattagtcatttccccagcacccgccatgccctcctgggccactgagtcggcacacgccgtctctctgcctgccatgtctctgggcccacctctcctcctcctggcaaatgagccctctcacctccacttcaacaaaatcggtcccctgggacccgtgccttgaatctctcagcgagacgcctccttcaatgtacggctgcactcagacacagcccctgacagcaattatcttccattctacaagtctgtccgtctgtctgactggctcccaccaatggtctccatatagcgacggcaagtaccttttcatgcccacccccaagctgggcacacaatattaatcaatgtctctttgaatgaatggacagggagacgggtacgaaggccagcagtagtcaaaggaagcttggcggtgaagacgggatagggccaagccctgaaaggtaagacagaaagacacaggcaggagggaacaggcagggaagggggagccacaagctggtggtggccagaggattgtgggtgctctacagatgaacatcttttacggcagtagatgactatatgtttatttcagtgtgtactttctatatacagcaattgatattgttttccattcatggtaaggacaaagtttccttcctaaataatttaagttaaaaagtgaggaaacttaaagaaaaaattaataaataacagttctggcatagagattaatacagcaaaaaccatgagctaaccttagaacacatttttgcaggaagggagtcctctcaacttggccagaacagggagattgaggaagtgaagtgaagcctgctaggcagggaggatgagtcagctcagagggctctggggacaggcagtgaggcggcggccacggagagagcatttgtcagagcaaagtgaccggttcaagaaggtgcagagagaaaaaatactctacactctccctcctggggacttatctcaaggaaggaagatactcaaaaggaggaaaagaatacacacacacacacacacacacacacacacacacacacacacacgcccgcccactgcaagcaacagagagcacagtaaagggcttgcaaattgttcacttctgtaatgcccacaagcacccaggtcggggggtattccacagaaccacaagcccaggacagacggactactgtgcttcactcaacactagcacatcttccaaactacaacaccgtcttcacatgtcacatgttaatggctgcattccattccattgtggcttgagcacaagagtttgagaccagactgggcaacacggtgaaaccccgtctctacaaaaaatacaaaaattgctgggtgcggtagagcaaatctgcagtcccagctactcgggaggctgaggcaagaggactgcttgagcccgggaggtggaggctgcagtgtgctgtcaccacgccactgcactgtagcctgagcaaaagcatgagacgctgtcgccaaaaaataaaaaataaaaaatagtccattgcatagatgtgccaccatttttacctactgttggacaaccactttctccagtgtcttgttacgatgattcctgtccctatgtaccccataaacatgagctacagatcaaagggacctgggcttgaatctggacctttccttagatttcttcttgaactcaggccattggcattctgactgttcgacccaattgccacgaagctctctcacaatgtcctatttggaaaatgtggtctttccatgcatcactgaaaaaggatgttcaaagatgagctttgaaacaggcctaagtttatgtggcagaaaagactcacacaagagtgtagaatctagattctagagtgttagacataggacctgatcccagtgctccagtggtttactgtgggaccttggtcaagccccaaacccctgtgagcagtaaaattccatgacacagcagaggctgagggcaaaggcttttaaattcagagcagctgggttcaagacctgactctgccacttattggcaatttatataaagtctaaatctgtatcattctgaatttacataaaggcctaaattcataggatcccatgcttagaaggattctgggaaggaaacggaacggtgcatgcagaggaccaggtgaagtgcacaagaaccaatgccaccacctggcctgccttcctagctctgaggcctgctgaatgctaaggctgaggtgtgagctgcttgtacagtggcccccctttatcctcgggggataccttccaagacccccagtggatgcctgaaaccttggatagtaccaaaccctatatatactgttttttcctacacatgcatacctatgatgtttaattcataaaccaggcacagttattatcaataactgataacatcgaacaattctaacaacataccataataaaagctacgtgcatgtggtattctcttcaaaatactggactggggttgatggcgggtgactgaaattgcagaaatcgaaactatggaaaaaggggggatgattatacttgttccaaaacgaggcccatcacctaaggcttggaaatcactctttccccatttgtttccctttagattctgacatgtaatgaaattcaagtgggaattttatcagttaacccaatgcctcaaactgacactggagtaagtagtcaagcctcttgaagcactcggagcacagaccccaagggtgcagggctgaggatcccacactcacagtatttacatgtctatgttctgacaatcagtcacgtgatgggagggcccttcgttggaaccatggcaaccagttcttgtctgttacgtcgagaaatgcttcctcggctgggcgctgtggctcacacctgtaatcccagcactttgggaggtcaaggtgggcagatcacaaggtcaggagatcaagaccatcctggctaacacggtgaaaccccgtctctactaaaaataccaaaaaaaattagccaggcgtggtggcgggcgcctgtagtcccagctactcgggaggctgagacaggagaatggcgtgaaccaggaggcagagcttgcagtgagccgaaatcgctccactgcactccagcctgggagacaaagcgagactccgtctcaaaaaaaaaaaaaaaaaaaaaaaaaaaaaaaaaaaaaaaaaaagaaatgcttcctcaacaaccaatatgcatctcacagatagtatgtaaccaagataaaagtaggatccttgaggatattcccaggattctcctacgtgctctccatctggaatacagaaagctcagaaaccatgggccatcagcacacagggaaaaccagttctgtggcaggcaaaaggacaagggtattctagttagaaggttgataaacgcctccagataaagttattagaggaaggacagatgaaatcagtgtttaagaaaatgcgaggcctgtttcccaggaatattacctagtgcaaagtaggatgaaaaagtaagagaggttgtcatgaactgaggacatggagaccctactcatctcgaaggcagatgttgccatctacagcctagagctctaaaccctctgaggttagggatctctttcaacatctctgggtggctcaaacccttggggcatgaactaataacctgtcggttatgtaggcaggcagcagactgtggcctctgctcgtccctggccgcaggtgtaacacagccagggcaaggaaccagctggtcctgagtgtgaacaccagcttagccaatgacagctttatcctcatactatgctctattattccagagtctgcctggatgtgtgcagagaagaggaggagaaagggaagtgaggggcaggactatgcagtacccaaggactcaaaggtgattccagaccctgactaccgattagtagttactatgtagagaatgaggttccattttagatgaagagctgcaactactgcgctttcattcttcattttttttttttttttttttttttttgagctggagtcttgctctgtcacccaggctggagtgcagtggcacgatctcggctcactgcaagctccgcctcctgggttcacgccattctcctgcctcagcctcctgagtagctaggactacaggcgcccgccatcacacccggctaattttttgtacttttagtagagacgggatttcatcatgttagccaggatggtctggatctcctgacctcatgatccgcccgcctcggcctcccaaagtgctgggattacaggtgtgagccacagtgcccggcccattcttcctgcattttaagatgggttccaagtcattaaagcaaaactgagggagtcacctaagaaatactccactttcagctgcagaagtttaaaaaactctaaagaacatctgttgcaatcactaacataaagcactttcccctgtacatgaaaatgacatccttggatcagactccagggtgcctgcgagggacaagttttagaatctgaaaggaatggcttgaaaggccatctctgccccttcctagctgtgtgatgttttacaagtattttttaacttttcaaggcctccatatccacatctgcaaaatgggggcatgccaaggctatggtagtaattgcataaaataataactacaaggttaagcacagaggccagcctaatccaagtccccttgcatgataaaccccataagcagaagtgcaaaggcctgatcagcttaaaggagtggcccaagagcaagcaccctagagcctgaaagtcaggatctgtccttagtgtgatcactattgcttgcattttagatgtacagtatccttcagcacagtgatttttagatctggctgggcatggtggctcacacctgtaatcccagcactttgggaggccgaggcaggtggatcacctgaggtcaggagttcgagaccagcctgcccaacatggcaaaaccccatctctactaaaaatacaaaaatcagccgggcatagtggcacgtgcctgtaatcccagctacttgggaggctgaggcaggagaatcacttgaacccagaaggcggaagttgcagtgagctgagaccacgccattgcactccagcctaggcaaagagaatgaaattctgtcttaaaaaaaagagagagatttttagacccaatccaatggtgttaatagcatgacaaatgatggaattcctatggacaatcacaagcctgtattaaatgtccacatgggagaactaagctatagcattttatgtacattcttttttttttttgagacagggtctcactccatcacccagactggaaggcagtgatgtgatctcggctcactgcaacttctacctcccaggctcaaatgatcctcccacctcagcctcccaagcagctaggactacacgtgtgtgccaccacatttggctaatttttgtattttttgtagagacaggatttcaccctgttggccaggctggtctcgaactcctggctcaagcaatccacctgcctcagcctcccaaagtgctgggattacaggtgtgaactacctcaccgggccctatttacagtattcttacttaatcctctggactaccctggaagaggacaatagtatttccattttgctgctcaggaagttgaggctgagacatgaagtgactaggttcaagcccgcacagttcataagcagccacagtggggtgtggatctgggaggctcctttcgctatactaccccaggctgccttccaacaagccctatttttcttcctgcattcctttatcttgcccccttcttaaacctaaaccctgacacttcacatgccttagaatcaaacacctgcccttaaaatgaaatatcaaaccctgaagcagggcagcttgtaagtacggggcagtttaccaatgcaaacgggttagtagaagctgagagtgcctaggaagacctgccaccttcacaagaggagaaaatggaccagaaaataaacacagtacctgttgagggggtcgtgcgggtgacgaggagcatctaaaggcaccatactttggctgcctcaaaggctctgggtaccaaatgtaactggcatgcctgggtgggccacttacacccagagaaacaaaaaaattaagtcttccagaagagtgacttgtattatcacctgaaacaaaagcaccatttcaaacaacttgttcatggagaggcaggtgcatggtctgcgaggcccagaactgacaaggacctgcagggagctatggaggaggcgggagatcaggtgtccacactaagtccaagctcccaacacaaagcaaagggagtgtccacatgcgaagacccttccggctctaataacacactacgagtccatgtcactgataataacatcgtgttgtggttaatgttaataattatggttaacacttgcctggctttacacatattaactcatttaatcctcataaaatccatcagaaatatctacttttatgctcaccatttcttagacaaggagatggaggcacagagtgaagggaactgccctggtctatacatcttggacctgaagccaggctctctggctccagagtctgcccttcactgcccctggactaggaatcatgactgcctgggatcacatagaaactccaagaaagccaccagtgtgacttcaggccaagcgctcagcgcccaccatgtgcacagcgttcagtaaatgtcagctgctgttaggatcacggctcccaccacggccaaaccctgacaaggccagcaccactggggcagtcctgagcagcagaaccgctcaagagagcactgccccatctcgggggcagaccccgctcggctcctctgttctcgactgagagcctgacactgacaactgggtaggccctaggagaagccaggcttggccgagagctcaggcccagagatctggacatggctagtctcacagtggaattgcctggccccagtgtttagtctgtattaggttgaaccacatgaaaggctggttaattcaacccttttttacctaggaaaatggcaacttcatatggttcaacctaatggagggagggattcttacatttattaaggacctactggacattcagtcattcatctaacacctgtagagcaatggctgtgtcagggccagtgtgtaacactgcttcagcaccccaagactgagagccaggatttttcatcttccctcctaaggataagaaacaaacttaccaggcagaacaagggtaaccaactcgatctgcctgagctcaggtaactactaaaacaggccaattttggccaggcatggtggcttcacgcccataatctcagcattttagaaggtcaaggcgggaggatcccttgagcccacaagttcgagaccagcctgggcaacaaagtaagactctgtctctaaaaaataagtagatagatagatagatagatagatagatagatagatagatagatagatagatagataggcaggcaggcaggcactgtggcacatgcctgttatcccagctggcaggcactgtggcacatgcctgttatcccagctgcatgagaggctgaagggggaggactgcttgagccgaggaggctgaggctacagtgagccaagatggaaccatgcactccagcctgggcaacagaatgagaccctgtctcaatcaatcaatcaaacaggccaattttgtctttcctctcagaatccctgcatcttacactgtatatggtgaccagggctgggatggggcttcataggaaaaagccaaaggatcctgcaaggctttgtcacccaatagtccccatggagggctgtcgcaatgattaagatgtgctgctgccactcacgtcacaggcaggaagagccagggacactgacactactgcacaaagaaccgtcctgtccagtaggccaagccacacagtggccgacgctaggctaagactatctcgccctttcagctgagtggctatcttttggaaaacagattgcagttcacaaagttccatctccttgcatttcaacaagtggaaccaaaaaaacctcctaaacaaaacccagacctcttcagccactgtggctagacgtacaggggaacctctcggccccagtttcctcatctataaaataaacatccccatgggctggtgccagagaggcaggagaggggaattccatcagcatgcgctgagtgcggtggacctggacctccatggcaactgccattaactagctgggggcccttcagcaagttactacacctctctgagctccggtttccttatctgcaaaatgaggaaacagacctcacagggttggtgttgagagaattacagacaatgactgtgggcatccggtaaatactggcagaaggaaggggccactctgtgagtgaacactcaataccagcctacagactgaaggtatccttcatttcatggcatcccctgatgcctgtgccatgagtgcactcctcaagaccaagaatggactctgcttaaccacaccccagcccatcctctctgcctgaacaaggtctcaaatctcaggacaaccaggggtccacaccaccctgtgcccaaaagagatttcaggatagaaggtgtctggagggtatacactgaggacatgacaacagctcacattggaaattctcagcagaggaactaacagccaagcctggccgctgctcttttggagtctgagttcctcagtgtctcaagacttttcacaccagaaggatgtggtggattaaggctcctccttccagtttctgagcacaaaactgcaacgcagggagcccactcatgtgaaaccaacgacagcccatcagggtcaaagcctcacgacggagaagccttcagcagcaacactctacctgccaatcactgctgcaactgagaagggaaaagggcaccggtaccaccggaaaatgccactggctcaattctaattggaagctccagcagatagggtgcaatgcaaaagcatcttttcataactttttttgaaagaaagatggggtcttactatgttgcccaggttggccttgaactcctgggcccaagcgatcctcccacctcagcctcctgagtagctgggaccactgacacacaccacagcacctggtttaactttctattttaagttaaagtacttcacttggtaaatacgatgcctgaatccacttactagggctctgagacagcaagcccaaacactgttaaataagataccgagcctaactcaggagcatcatgctgagttcagcactagaagaggaagctgcacagagcaattgaagcagagggtggagaagtgcggggtctgagccagtggtaacaactgcttccaagctgcaatgtggtaagagctcttgagaccagaaaccctgggctgctgttttcagcagtctggtgtttaaacagaatgagccccttaagaccactctccttgggcaagggactctacatcttggagtctcagaagaaggaactagcacctgccttccaggctggttgggaagttaaatgaaacaccacctatcatccatccatgttaacagaataaccacaataataagagataacactcctactgcacttacaacgtgccaggcatcgtctacactttccacacataaactcagtcctcacaatcatcactacgtgccaggtgaatggcaaccaccagggttgttgccttacaagacacgtgacgacacaactgaaaacctaacactagaaagttgtaggcaaaggctcctgttcacaagcatccagagatgtcagaaacatgtggggtgaccataggaggaagcacggaaaaacgcaggcaagcagcctccctgcctgtctgacgctgtggacttccccaggctggttctgcactcactcctgagtctttcagaactttggacatacttgcttccacccgcttcctccatttaaccttaagactcagatggcatattctattaggtctacctgactgctcagtagacatccacggaatgaatgacccgatggaaaaaaatcactaaagggagcatagcgcagtgccaggactgccaggtgggcctcggtttcctcacctgcataatgagggtgacatgagaatctgcctcgtagggctggctggaatattaaaaagtcatcagtcaaaactagctcctggccaagtacagtggctcatgcctgtaatccccagcactttgggaggctgaggcaggcagatcatgaggccaggcgttcaagaccagcctggccaacatggtgaaaccctgtctctactaaaaatacaaaaaattagctaggcatggtggtacgcacctgtagtcccagctacttgggaggctgaggcaagagaattccctgagtctaggagacggaggttgcagggagtcgagatcgtgccactgtactccagcctaggtggcagagcgagactctgtctcaaacaaacaaacaaaaaaaaactagcttctgttattcctacagctgccatgcagagcccgccaccccaccatctccctcagcagactggtgtcttaggcaccagaacctaatgctgtgtgcatcaggctgaacttggtgccacctgcagtcacagagtcactggctggatggatcactgggctacccagactgaaatccccattcagttgttaacaggctctcaaggctttgcagacaccactatctaggatttagactgacctgaaatagctgtgtgtcaatgataaactgtccaatcagaacacctacatgggacagctctggggcagaccccctcagctccagaggtggtaaatcattccgtgtcactctgcctttatctccttccaccatcccttcctttccacacccacagctgcacagtggccaggaccctcataagctcacaagctgatgcttgtggaggcctctctcccatctctttcacctcccaggcctcctgcatgcacagccagagggctcttcctaaaataccaccgctctgccagcctcctcgaatttctacctgccctgtcaaaaatttcactggctccacactgtcccagatctaatgcaaactccttagcttagcaactcaggcactccacaactcactcctgagactgaggcaccccatgggctcgcatctactgcttgtgtgaccacaccccctgacctctgcttttgtgccagtccccttgaccataccccaccctgtcctctctgcctgagcacactcttcccaggcttcatgcccagcccccaagccgactgcaggctggagtggtctgcagggctgcgtggaggagggggaaatgcaagccaggcctgcagggatgggcagaccacagcacccatgggtccctggctaagtcttttctagtactacttcattcctgctgcacttggctttttggacgcatcttgcctccccctcccagattagaggacagggatgatggcttctatttgtgtcccttattctgtggtatgcagaataagacatgcaacaaccacagctactgtgtgccaagcactggagtaagtacattacaaatttcacccctactccccatctctataaaatgttatcctcatgcgacggaacaggaaaactgagaccaagggaattagccgcctcactgacagtcacatgctgagtggcagacaggactcaaatccagatgtgcccaactgcagagaccatgttctgtggagcaggcagccgcctctcagctctcactcagtgtttatgtagctggcgctaagtgccaggcggccagtgcaaggtgtggggtactcagagggaaccaaacagacaaggtccctgctctcacagagctcatatgctctgtccccagccctgtctctcttcttccaagcctggaagagggcaggaaccctccagtcacagggggttccactggcacaaacaaggaattcgggcctgacatatagcatgaggctctggcaacacatggtgcccagctcacagtgagcttgtctttaatggagaaaagagccccaggctctattaggtaagttgtgcgttcaaggcacaacccagagccagacaaactccaaagcagccatcggcaggcagtacggagtggagaaaaacggtttgctctggagtcagaaaacccaattcctccacttagtagctagacagggactaaccatacacccctttgcacacttttggaaaatggtgataataacaatagttaatgtttacatcactatgtgccagatgctactggatgcacttgacagatattacttaaccctcattacgaccttatgcagaggtactgttatcctaaagcagtctggctcctaactctattttcttgtactatgctgcctccagcctaaagttgaacctaccttgtcaggctgtggtgaggaccgttctaacagagtgcatagcatgtggctggtgctccataaccattaaacctccctttccttccactgaaacatgaatctgtgaaagcctaggtctggaaatagcatatggctctagctggtcccaatatgggtgatcttgcagttgcatcccctggaattccacaccgcaccctcactggtggatctgctgcaaggggaaatgggacaagatcctgtatttacggggccctctgctcactgtgttctggaaaacacagtgagtggggtccagcacatgacttgggctgacagggatccgaatcccaggcctgctgttcacaccggtcactcaagctctcaagcttcaggttccttgtgagtaaaatgggggctgggctataacctaagtcatgtttctgggtcacagcagatcctcgggtacccgggttggacaggctggacaaagctacccaggctggacttccaaggtactgtaaggtttcatttcggggccccagaaagccttggctgtgcagaggagcggactgcgtgcacgtgcaatccaattccacccaatggcagacacaagagaagacacaccccaaaaggcctgggagtggagcctggcacaagcccccagctttctcttcagtttcctgccatagctcatgcagatgtgcctgcaggtacactgaacaaggctctttcccccttaagctttaggtaacgatgacatccccacccctcaacaatgtgagccatgagggcagagatccttgtcttgcatcctcagcacataagcaccacagagtaggcacttaatacacaaaaagctgaattaacattatcctgtagctgcaggtaccccacaacatgcctcagtatttgcctaacaataagcatttcccagcctggagggagggcaggcttctaacgggcgaggcacctgccctgccaccatttccctgtggtcagtcatgtcctgttccccacctcatggaatgtaaaagtataggatgtctgagttataaataggagcatctgctttcaaagacacggcttatcatttccttaatctcaagccactgatcactgcctactttttataagcatgccaccaaaaagaggccaggtgggcttaaatgaacagggctgtatagacagacaagagggatgtgagttgaacaatgtgtcttatccacatcaagagacattaatgtcaactatgttgtttcaccttgtaacaataccaagttcccatcagctcctgccaggcaaaaccatctgtgagctggagcagcaattcctgagggggcctccctagtccccgttcctgctaaagcctcaccatcatcataactaagaataattcccaagtcagaaactgaagctgtgtaaggaacggtgctctgaaattgtacagcactcagacagtggtaagattattacctgctaagggaatgcaaataaattccatttgcctatgcattttaactgggaaggagaaactcatgccaacaaaaatcatggaattcattccaaagtcaaatgcattttagattctcaagtcactatttccctcaatggataacagagatctagctgtattctctaccatcaaatctactgaaaatgaaaaacatggtgatctgaattcatttacctacaatgcaacctcacaccaccacttctgtcctacgccaaccatctacaccggcttaatggtcagagtattcaaataggggataaacgtaacaataagcagtcagaaattacaaggctaagggatactaagaacaagtgactgagagaatgaatatgaaatccaagcaggtaagttcatggacacagacacatgccaaagagaacattccaagtggtttcttccaacgccaggtgctgttctaggccccacggatacagctgcggaaaacacaagacacaaatctctgccctccaagagctcattctggcccatgctaaatatgcctgtatcaccatacagctatttcactataaacatgatttcctatacaaaggatctaaaatacaatacatgggcaataaatactgctcctccccccttgccatgtttgaatatcccattttatgtttttcaaacggtatcattaaaccttctgacatacaagcagcttggtacaatgggaagaacagtttagagcctgccagatgggcttccactgaccaacagtggttcctccactggctgagcaacaccctgaataagtcactccacctcctgagcctcagctgcctcatctataaaatggggacagccccagaagggcttcctgtggatgaaaacagcttgtacaggtgaagcacaccacagtgactggcagacagttcctccaccctttccagccttttcagatgagagctgagtacaagactcctgagaagcttcaggtgtcatgtgctcctcctgggggactgaggcactttcccatcacctggcgagaatcgctgcttcctgccttatactttgtcctgagtgcacactcaggaaacttcagcccactttcaaagtcctcacccaccactgccctggagaagtcgttctccatcaaggcctggggccaggcccacctccccaaacaaggagttttcagccaaagttactggacaaatccgaaggccttaaaagtggcattgcccatgtttttaatcagcatacaggaaggcatcaaaagaaagcttaacccatctcaactactcaccctcgttcagcagcaacatcccttgactaaacaaggaaccatggtcctcaaaacactttgaggcccaaagtccacatacaaacatgctccaaaaatcccttgatcctgtcaggaagaagttctctggcccttccaacctaagtgctgggcctgtcctgcagaagggtcaagtggcaggagggcaggtctatctgtgggggcctatgtgaaaccccaggttcctcaaaagtctggatagcatctgccttctttaccaaaacaaacaccacgagcggagccagcactctccctaggcgttctgctcacctgatccgagggacttccataatcagcagttccaacccttgcaagctgacagttcagagggaaggggaggctgcgcctgcttgggtgcatcgtgtccaggccatatgctggatccagggcctggtggccccccaaggccacggcctcacaagggcgattgtgcgttcatccttgtcctgtgggccacccatcctcgcccctcggctcccactcaggcccgggcgccgtggaccccggcctgccctgcagaatgcttcgcacgcacagcacccacggcggcagcctcgagaagggcccgcagagcagcgcgctgccttctgggcacaccgatgcccgcccttccctcgctggctcctaggcggcctccctagaagcggcaactgagaaggcacagcaccgggaccaccccatccctgatggagagctcccctcgctccccaaaggctgcaaagaaggcgcgccccaggtacagggaaggggaccctgggtcgtgcaccaggcagggggcaggaccctga

SEQ ID NO: 183 - DNA, 146800 bp, Homo sapiens
  source 1..146800: mol_type = genomic DNA
gctaactgcgccccagtttctttttattgatttcttttcttttctttttttaagtatggaggctcaagtataagatgtagatttttttcttaagctttacaaaaaaacaaaataaaacaaaaacctccttttgcattccatagaaattgacagaaaagcacctggccggaagagcggaacggtcggcggcaccccccccagcccccaccccgcggcctccgtgggacgggagagtctgcgcaggacggcaccgagggccacctctgctcccagagctgtcccctgtccccacgacccccaaccccaagcaactcccaaacacacacggaataagatttccagtttttcttctctctttcacacaccacagttagttcataaaatttttttgttttacattttttacaccaatgtaccaaaaaggtgggagggaagggaggctggcagacagtggattttatgcctataaatggggggacagggaggaagacggggggcccgggtgaacaaaaaccacacggtctctatggaaatgtggagagaactgagagcgaggtgtggcagaagcaggctcggagccggaggagggtggctatcggctttattctcagggagagatggcgctgtgcggtcaatgatgcagctgttatgtgacctgtcggggagggaagggacgagggaagggagcagaaaacgagttttctaagaaaggaatctaacgagtgcacggcgtgtctggttagcatgaaacagaggtttagcattgctgctttctcttcaaagcctccaccaggtcattcttcagagcttcttgttttgatttgtctgcaaaagtctgcacagacctgcaagggaggaaaggcgttatcagcagattgaacagggactggtgaggcggtggaggcctgggggccaccatgccagtgcctggctgatttgctgcatggacccgcttcctggggtgaggctctgggtcactgggctgggcatctgcccctctcagaaaggggcaaaggggtacatggccgagacctgcaccctctgcaccttgccaggccctgtgggggtggcatatggcttacatggacaggtgctcatctctgcccctggccaccggtgacccggccatagtccctagaaccctaagttcactcctctgtgtgtaggtccctatgtcaccctaagccacaaggtggcttctgggcttccaaacacaatggaacaaagcccctctgcttcagaacagctaccctgggttgctggctggggactcaggccaggggctaagaggggaggactccggggccatgcgggttcctctataaaagcttctcccttgcccaggccctgcccagcagaagagcctcattcctcatcccacaagtgcaaggtgcagcgttatcccacccttgggagtgggtaagaaccagtgtctctgcgtgtctgagcacactgtgtttatggcccacgcagcaggtgctttcaggcctctgctgtgaggcaccatccgctgttaacttggcccagaaaacccctcagcccggattgcaaagggcggcacaggacagccaagtgcccctgggatccctgctgtcaaattctggatttgtggggaaacgttcagggcgaccgcattcacgtatgtgtggggacgctcatcaacaaagccagaaacaatgaaggcttatggagatttcacagtttacaaaacgcctttcacatatattatctcatttaattttcacgggcatcctggggaagtctcaactatcaacccggccggatgtggtggctcaagcctgtaatcccagcactttgggaggccaaggcaggaggatcatttaaggccaggagttcaagaccagcctgggcaacatagtgagaccccatctctacaacgacaacaacaaaaagcgaagtcaaggcttaaaaaagaaaaaagctatcaacccaatttacagatgaggaaactgaggctcagaggaatgcccccctagcaattctttaatcattttgtcaaatttacccaacatattggttaggcaaagacttcctaaatgtaggttttataacagtttagaagcagtggaaagagtgggtagagggctgctcaagaagagtgctacggagagtgcactcagccggactctcacgtttgattcacaccagccatgggaaggaagaatcagaaaaatcaatccccagaagcaaaaatgggcaaatggaagtgaagcagggcccaggagaagcaacagcacccagactgagttctggctaccgaatccctacaagtcacaggaagagccctcaaaatactcagcaggtgccataagacaagacctggaagcaagctgcatacaactgaaaaaactcccaggagaaacgcagacatttggttcatgctggggaaatacacgtttctgagtatcttcccaggactgtccctggctctgcggcggccaaaggcatcagcccccacggcccccaggctccaaatctcagccgattccccaggggcttcttgccaagctcacagcgggaggtcaacatggccagcgggagatgcggcgggcaaagcagcagcgcacaggacctctagcctgggtggtcactggctcttctgggaaggaagagccaagcccgccaggtcttggctggatcacacgaaggagaaagttccagagctagaatcatgttagacacaggaagttagaagtgaaatggtggaaggcggaaggagcagggggcttatttaagggacaatgcttgggaaggtcacggccaagcaacctcgaatcagcgcttggagacagtgctcgactctgtgggagggaggagtcatcttgagcagacctggctgccagggtttctacgccaggacgcccccagtgggcggccagggaactgcaccatcacggtgtatcttaaaaagagttttttctcaatgccatgatggaaatgcctgatggccacactgtgaggctgacccgagtcgtgggccttaagttggcacacacagaccagactggtgcacttaagtcccacggcctcggaaaagcagctccacctggttttctaagtgcctgaccccacctccaccttggaaagtctgctgcaccccttctggggtgggccttcagtgcgcagcccctggacctgggctctgcagccccagttggcagggttccaaatgccttctttttacaaacaagtttccctcctactctccagggatgctgcctccttccctacatctggatctgtcacaagctcaagtcatggttcttggccattaccaacaagcaagactattttcctttccattagcgaaacctgtttaaaggaacagctgcagctcgttaggggcggaaggttatgctggttgtggccgagtcggcactgggcgtccaggcagctccagcagagcatctgggccagccagggtggagtccagccctgactctgccctccaaccccagagactcagagatcagagagtgaggtcaccccttccaagccagctagccctggacaggcaatgtgccgctgagcagcggggaggcttatgtggcttctgggatccctgcaccagcatcagaggctcctctgaagcatgggggggtggacggcaggcagatccctgccctggggacagtcaggccggtgcacacaagtggctgctgctggagaggcagcatccgtcccttggcctgggcttcttcagaagcaaaagccaaaaaatcagccgtcttccccacacccagcctccacccagagtggaaagcacacacacgtgataggtgccgtgttacatggggccgaggctacacgggaatgtggctgtgcaccgaccgggagcacacgtgggggttagtggtggtttaaatggccgcggagcagcagccggaccggcagggtctcggcgggttggtgagtcctgttttagtggggagggtctcgcggctctcaggcagggtacctggatcggcttaattatcaggctggatgtagatctggcgctgggtcagcacttgagagagctccctctgcaactgcttaaacttttggttgtcagggatagcatcaatagatctacagagagtgttcaagatgagtggagtgggagggaagagaacgacgagaagccaggaacgcagggggccacagctgaggaggaaattcagggagacccacgaggcggaaggggggatgccgtggcggctctggggtgtggagtggtatcgccgctgcagaggtccacgctggcggtggtcgtggtattcaggggctcgccaccaccacccgcaggctcttcggcttctctcccccacttcccagccactgcctggggactgtgcaggttggctgggcgggaaagtgtgtttggtgtatcgggcagtggctgccagtggcaggcctaacgccagggaccactgggctctaaccctgtcacaggtcacgaagaccaagcctcccccaggtgggcaggggatcagaagacaagggtccaaagaggactcctcctctgttttaaaactgtaaagcaggtgactgaaatctgtcgcccaccccagtccacgagctggggcagccccgggactgcagcctgcctctcctctgggctgggctgtgagagctacaccacggcagtgggtgagagggctggccgctaaaggcatagcacagcccgactcacacggtgctgctggactgcagagcgtgttctagattcatcatctcagccgaccgtgcctcctcgactggacaagggcctctgcgaggagtgccagaggccatgcagctcgggatgacagagcttaggggagatcccggcctcctgactctcctgactccaaggccagtgctccctccacagccgtttactgcccccagctgggctctggcctcatgtcagaggcctgcctcctgctctgtccgccgtggacctggagggtccagagagcgcccggcttttgtttgggctgacactgcagagctgagggcacgaggtgggaaggatggtgcaggacactggccactggcagcagagccctggcagaggacgtcagagaggctggggccccctgagaacgcccaggctgagggccctgcctgcatgtggcgtcagggaggctgggggcctgagaaggcccggactgagggccctgcctgcacgttgcgctctgctgtctcggagagcaggccagccagaggcagccgggctgcccggaatgtggtgtcatggctcccctaggcccaggctggagggtggggagatttttgagcggggactgacaaactgcagggctgaggaggctccgggggcaagggcaccaatggctgttagggtgaacatgccccagaaaacaaatggtgcagatagggaccgacagctgctacggagagtgcagatgacacatcaggactttactttccaaaatcaacataatgatcatcccagaagaggggcactgcagcctaccaatgaggacaccgaggcccaagaccacacagctagtaactggcagagccagggttcaaatccctctgtctgcttctaaagcttgtgctttctggtacattacctcagcccattgacgatatcctttgtttttccaaagtagatctcgttcagcgtacttctgattttattttccatgtcctggaagggaggtcggtcagcgcagtggcaaaaggtcaggaaccctgaggcccacgccctccctccacctgccagccctgcagtccccagtgtggccactggagggtggcacacgcctgctctggggcatcagtgagcgcgctccaggctgccaagaccccacctgccatctgtgctcccggcaccttcccatccacagtccacaggcagggaggaagccagtacccagggattggcggccagctctgcccatgcctgggagctgctctaaaccacatcaccaccccttgggctccccactaattttgtgaacaattctgtgaaacccgagagcacctccctgccttcccaaacaacgtggtgacaggagggccaaggcagccgcaactgaagccacaccagggcccactggcattcctgggatctgcttcctctcccagcgcagggccctgttcacacccaggcgatcaggggagacaagacctagtgcgccccagagccagcgcctgagcagtcttctgggagcccaggtctgggggtggagcaggaggtggccctgaagctggagcctgctggcatccaaatcagaggctccaaaaatatgaggccagggcaaaatccaagaagcgctctgccggctgcggtggagctgagagaaagcagcagagaaggaggccagcacagcggctccggggctgcagtgtcactgctgtgggtcactgcaggagccagccagagcccaggtcactcacctctaccaggcgcccgatgttggctatgtgtggggagcagtcactcacagtttcatccttctccatctgcaaaagacagaaacattccaagtcagagaaagccagagatttctgagaacggcagacagcccaccccacctccacggtctgcaaagagcctactgttcccaccgtggagccagctgcaggtatgacaaggccagttttgcagcctgggaactgaagcacaaaccgacttcagtttcagaccataaagagcccagagggcagaagcccagagtcccacttccaagggagaagattttgctgctgcccatggtagagcaggcagatgcccagagccacagcagcagcccttggcaggcaccagctcacccgagccaactggagaagactcactcggtttgtcttcaggcctctactggcaggcccaggcccacgctgggccatccaccccaggttcagggcctgacactgcaggggaagcttctgtgctgctgctgcgccctggcgctcccaaatggtggctttggggtgccatctgctgcagtctcgcagggagggacagacaacctctgacggagacttcaggccagagggattcagtggctcaccctagtcatgcaggtggcaatggcagagcctgggtcaaacccttcctcgcaccagggcctgttcgttctactctgcgaggagagtttgagcaagagagtctcaatatagactctgaggttatgaggggggcagcagcactcaagccccatctcctcttcccaagcccaggaagagctggctctgacccaatcatctcaactcggaggagggaggaaatggaggcaggttagggtagaaggaattcggcactttcccccgaattttttcttatctgaagccttatttccctgacaagaatataaattctttcaggagagatgtgcctgcctcataacgcacagggtacctggaagagtgctaggaacataaatgctcaacgttactacactgaaaacaggaatacgcagctacgatgactaatgttgttgaaataaaatgtggaagctgaaataaataatcaagaaagaggaagaaaagaacagcatcagaaagggtagagtagaaaccatgcaagaagtggccatcaaattataatacaaaaatgcagtactctaaggctaagcatttattgttgagattctaaatctgcttagacattatttataatttttgaagctttattaaaataaaataaaatttgtgagagaagctaaaaaaaaaaaaaaaaaaaaaaaaaagaaagggtagagttcaaaatgagaccaggcccacagaagaaaaaccagcaaaaggtgggttcctctctttggaaccaggagaacagggtggagtctggggggagatactgtctcagagggtacgggctctgttgcttctcacctatttctacatctcctcatcagggagactgactttcaggctgtgaaaggtggaaccaacctggttaagagcggggtgagcagagggcaggagagaaccaagccactttaaacgaccaggcttccagggtcgggcaaaaccgacctgtgattgaaatccttgacactgggggcggcagcactgacccgacttttgtctttttttttttttttttttttttgagacggagtttcgctcttgtcgcccaggctggagtgcaatggtgcaatcttggctcactgcaacctctgcctcctgggttcaagtgattctcctgcctcagcctccccagtagctgggattacaggtgcccaccaccacgtccggcttttttttatttttatttttattttttatttttagtagagacagggttttgccatgttggccaggctggtcttgaacttctgacctcaggtgatccacctgcctcagcctcccgaagtgctgggattacaagtatgagccactgcacctggccgacccaacttttgtcaaaaaaggaagaatggcctctgcaaggaaacgctagctcgaaactgatccagacaacaatttttgatgggatcgttaaaatcatctgctggcacattttaaactcagagatcatgaggagccagccaggctcactgtgaacaagccctgcacgagagcacttcttttcctgttttggtggggatgctgggctggaagaaaacacaactacttaaatagggtcgcatccttctggcaagttcccatctaccatcctgcacctgtggctgagaggaagggcaggatggagcctctgccgataggggtagggacctggccacatttccacagccccccacccactcccctccacacctggtcagggtcagctcgctggcaacaccgacccaccaaaaatagaaccatttgtgcactgcatacactatgtggcaccctgtagcagtctctgcctgcccttggtcaacttgtttgtccaggacttaagtaaaggcccagctgagagaacgaccagcttcctatcgacagtgtcaagggttgagatggtcacagggttaatacggaacccggaaacctgggctagctacagaacgagagcagcaacttggaatggagccaggcggcagccacctttttccatctcagcttcctaggaaccctgttttaaacccaaggaaaccgaagcttaaagaagcaagaatcatacagcactgttagattccgacgcctttgctcctcctacttcaccacgccagttaaatgtaccagggcaaatgcaagccagatatttaggctcaagggtgcatttcatgcagtacaaaatggggaactgctgacttgcaaacagttcctatgaagagacttgtggtttttagataatttcaagtttgacaaggatgagatgtcgctactaggaaagcttttgtgcaactttaaggtgcacagatgacactattccttgtgcccagataaggggcagcattcccaccccatcgcgtgatgaagacactgcagctgccagtttccattgcttgcttgggaaggcagtggttaccctctgttctgtcctggcccagctacatctgcagggctggattcagtttagggcacttttttttttttaattttcttttaaaagacaaggaggtcttgctatgttgcccaggctagacaggaactcctgcaatcctcccacacagctgtaactacaggtgtgtgccactgtaccctgctaaggcactgggttttaaaagccttgaatgagttagcattcatctgcttaaaaggtctgaacaccctgacaccaagaaatgggagagaactagggctatccaggcctggcggtggtgggtggggagggatgtgtgtgtgctaggggagacacaagagattctggcagggctctgaaggcctgctgtctgccaggggaacagacccaacctatgtcgctgtagatggcagaggggggaccgagcagtgagagaacatcacggctcactgggctggactcggtctgttctgatagagctgtccctgacaggcatctgctcacaaagcaatgtggtctgggagaccgacgggtctgagaaaacgggtggcatctgacaaggggggggggcggtctaggtgagggcaacagtccagaacctgctgcctcccaagtcataacagtaaatatctgcagaaaaaagacatctggttctggcaaggctgttttactgaggactagtggaaaagagggagagaaatgctagaaagaccggcttctctgctcccatctgtcttggcatgctctggcaagtcatcctgaggaatctcgaccctcagaccccagggggtctccataaaacaggagtagtgagagtgcccatgagcttgagagtcacagttctcatttcaggtctaataaacacaccaacctcggcagcactggagcgtctgctggaacatcatctttatctgccactagcaaaaccctggtgccaagacgacggggtgggctgtctgctcaacaggagctggggagcaccctcaggagggagggggctccatccacccagcttcaaaaagaacttttgcatgctggcccccggggactgtgtgttctcccagacgtgaaggtggttactgtgcctaggctcagggctgggtggagtcagctcggcaggcagggaagcctgggggttggatggaaatgaatgaggtccttccagcaaatcagagtctctcctcctccccggctccatgtggacggcagattcccggccaccctagggaagggatgagggttttgagctcactgtgggccccattttaaatgggcaccaacagcccaaagagaggccgcggccatcggcaaaggtcctgggtcacctgggcaagtccagtcacatcagcaatttggcctcttggttaccatctttgtgtttcagaatcaagagccatcttaaaacaaacaggcgaaaccccttggccaacaaaggtaggagaggtcgggtggaggagagggctgggtcttgcagtgtgcgacactgtccccaggagcagactgatcccctagaacacaggccccctcagcccatggcagggaagctgagcccacgtaaatggccacgcagcggctggggagggaaggagaaaggtgcttggggagtgaggggcacagggctcggtgcacccggccgtatttccacagcccccttgcccgcccctgctcactcccctccacacctggtcagggtcggctcggtggcaataccaacccaccaaaaacagaaccatttgtgcactgcatatattattacatccttataaaagtggctgccggaaggaaaacattttcatgtgttgtggctgcagatgttccacgaggtggttccaatggcgtctgaagccggagcctggcccgtgtgtccccagcaggcgcctctcctcctccccatggccctaacacaggcaagtgtttggaagctggcagcctttcccccagaggggatgtattacacctcccactgccacgtggcatcttctagcgcgacccgcagggcgtggccctaaggcatgggccccactcaccggcgctgaggccccgcagctcctgtgctgcagcccgagaggaaagggcctgggcttgtctaggcctccatgtctttgccttcacctcgcactaaataaacaaatgtacacaaaaggcctagagcgggacttgccagaatggcagctctcaccgattgtcaaagcacagctccatccccagcactcttctggcctctggcatcctcctggtcaccacactgtgctgtgggttggaggtcaggacccggcgtgcagccaggccagaagatggtggtcagacggcttcccagggaaagttacggttgcccagtttaggaaaattttgaatctagaattgtacatattcaaaaagcctctccttgcaagatatatggtagtagcagtaattgtttttatttttatttttgagacagggtctggctgtgttgcccaggctggagcacagtgttgtcaccacggctcactgcaacctcggcctcccaggttcaggccatcctcccacctcagcctcctgaatagctgggactacaggcacactgctgcctcacctggctaatttttgtattttttgtagagagatggggtcttactttgttgcccaggctggtctcaaactctcgagctcaagtgatctgcctgccttggcctcccagtgttgggattacaggcatgagccatcgcgcctggcaaaagttattatttattgagcataaaactgtgtgtaaaacagttttttgtttctactctacaatgatctttcctttttttttttttgagatggagtcttgctctgtcgcccaggctggagtgcaatggcgcgatcttggctcactgcaacctctgcctcccgggttcaagtgattctcctgcctcagcctcctgagtagctgagattacaggtgcatgccaccacacccagctgatttttgtatttttagtacagatggggtttcaccgtgttggtcaggctgatctcgaactcctgacctcgtgatccacctgccttggcctcccaaagtgctgggattacaggcatgagccactgcacccgatctttccattttttttttttaataaaatttgtttattatgttttttagagacagggtcttgctctgctgcccaggctggaatgcaatggtgcaatcatagctcactataacctcaaactcctgggctcaagtgatcctcccatctcagactcccaagaagctaggaccacagatgccaccctacccagataactttttgttttgttgggaggggtgaaggggtggggggcagtgcaactgttgcccaggttggtcttgaacccctggccaaacaatcttcttgcctcagcctctcaaagtgctggaactattatctttcaaaatgggcattatcaacactgagtttcaaagaggtggaggtctgtctaggtcacacagctggaaagttcctgagctaggatctgaatcaaggtctgggtgattctgaaacctgcttccttttatgagatctctctgctggctcaatttcacatacatcctttaccagaaaactgaaggacaaaccacaatccagggctcagaaaacctgagcagggtccatccctgcctcagccgcctcctgccagggatctccggtcccttcgtctcctgtttccgcccttcacagcacgggatggttgtggggagcctgtctcaggccagctttccttctcagccaggcactggtcactccaccccaggtcatctggcaaaaacccagacgccccttgaagctgcgctgctcaagcatctccacccctgaacccaggcaaccccacaggacacgaggagcgggtgtgcagctgcagccaggcctccccagcgagcgtgcactcctggaactgccaagctgggcccggcccaccctctgttccctgcatctggaagggcaatgggcttcttccctgtgacaaaaatatactgcctggcctaactgccaaacgcaagtcaaagaggatgttcctgctaggatacacaggcaagtgcctctactggggatttactgcctgaagatatattgggggtgtctctgctgagtggggagagactgctcactagccaatgacctgcctgatctccccactcaacaaaacattccaccttcatttctaaatatttagaagctgagaaaatatcaaacgaacatctgcagggcccttccccggatgggaaaccttggatctctttccagagatttacaatctcgcctctttcccacgtctctgctgtcacataggagaagtgacctctcagtacaacttccttttcaacattttggaacttggggcttgcaaccttttttcgcttgctctacaaccctcccatggggggccacgtggcagtgtaccagagggtaccttctgcccgcctttcctcacacacatccacaagcctgggcaggaaggtatgatccggccggcctgcggctcaccttcactccgacagcctcactgctgcgggaatttgccagaatactttagctgtttaccttgtcttccagttgacgtccctgagaaacatcttttggtggttggaggtgggagaagtaaaagccgaaaatgatggaggcagggctaggtggaggcagcatcgcctggtctggctgtgttctggctggctggcaggccacgtgcccaggagagtggcgctctgccccggccactggcctaccaccagccgcctacactggggcacgagtgggcacagggcatagcctgatgtgcccacggaagggacccctgcgaggtgccagcaagccaaagctggcggccttctccagatgggccgtgggaaacaggaagacaagggtgcgcccggggccacacacagggaagggcagctgccgctgctgccggggtgaggcaggctgggccacaggaccctgggaaagctgaggacccatggggccttgctgagggtgctgatgctggctgggatggctcttggggctagggcctggcactgtgggcctggggagacagctccaaaaccaagcagccttccttcctgacacacgtggggcaagggcatgtgagcgtgggtgacctggatgaggccaggtttccagaggaaaaacccaggcccaggttgctgtaaggactgtgtaaggaggaactcgagtgaggggctctcatctgacccccacctcacatcttggtcgtccagcccctgaccacgccacgccagaatgccccccagcctgcccctcttcccctgcccttctgtttctgcccttgccacctcatgcctcagactgacactagcttcttcactgacctctctgctgcagggctgtcccctctgaccctcccagggctgcctgatccaggcccttgtcatctctctccttgatgactgtaacagcttccccctgaccacccatcccccaagccgactggcagagccaccttctgaaaacacagatccaatcagatcattggactccctagaaacctcaaagccctcctgacagcctctagtagtgaacacaccccagtggccaagtggcttccagcaggagatcatcctgaaagacaaaggcacacctgcgggaggggcccagagggcagcgctgctcagcacacacctggggagccttgacgccgtgtgcggctctgcagggttgatcctgcttgcggggcctgcttgctcctgaggctacaggtccactgcagctgctcatgccggctgctgagacagagtcctgtctacactgagctgactgctccatgcacttccatctgactatttagcagtcaccgaatggcaggcacagaggacgaattaagaccaaaacagttgtggcatggtagaaagtagcatatttttttctcaccaggcaaatctgggttcacatcccagctttgcttcttactggttaaattatatgggcaaattatttaagtttgaacttcagtttcctcacctgttaaatgagaataacttgaccttggttacaatctaatccaaggggacagcctgcaaaccatgcatgttcatgctcactgagctgctcacttctcccagaacccttcgcctcccatccaaacaagcacaggcgtttttccaaggctcctctgggacccgtagccaagctctgcaaccctcacttcccctgtttgctcagaagctgtgcatcattaacttagatttgtctacctcattgcaatccctcccccttctgtagttacttacattggaacccagccccagctttaatgcacctcaaatgaatgatgtggtgatcggccgttagaatgatggcagagcattaatttcctcattaaagcccccagagcaaaaggcaacgcaaacaaagtccgaagccctggccaaggtgtgctgaggacaggcactcatcaggcctgggtttagcttggcaggagacactgctcacggcaagccggaaccagactctggccatgggctgacagctctgatttaaactattaggagggctgaggattaaatatttgtccaggtcactgtaaaccgggtggaattatcaacagcctggagtggtaagtgatacaggaagcagtctctggatacagattcaggattttccacccactccccaggtggcaggatgtgggagagtcaggctgcaggggagctggctgcctgggggtttggctgttcctccctagccaatggcccctggaagataggagtccacttccacgcaaaaaggctaagtgccccctgtgtgcactagtgagtagtcctgggatgggactgtgacatccctgcccagaggccaaaaagaggaccgcaacatcccttctggcctccagcccctctgacacaggagaggcagtggagcttctataggtggagggagggtcccaggtatgacggctgacattcaccttgcgccactattttttcaatgcatgtagatgttgttgtaactagtagaatgcaaattcacttaaaagatttactacactgggccgggtgtggtggcttatgcctgtaatcccaacactttgggagaccgaggtgggcggatcacttgaggtcaggagttcaagaccagcctggccaacatggtgaaatcccatctctactaaaaatacaaaaaatgagctgggcgtggtggtgcacgcttgtaatcccagctactcgggaggctgaggcaggagaatcgcttgaacccgggaggcagagattgcagtgaaccgagatcacaccactgtactccagcttgggtgacagagcgagactccgtctcaaaaaaaaaaaaaaaaaattttactgcatcgatcctttcggtcatattttttctatccacagctattgagagcataattatcttaccgaaagagatctctgatgttaaaaggaattctcacagtggacagtcagggactgctggaactgagaacggaagggcatccttgcagaaagtggcgccccgctgaggctctcaaggctgtgccgtttctgccaataccgacttctccgaaggcaaagaggggtccttgtgaaacccagttgtgcttggtctatgctttctcttccccctttacgccaagcatcttgtggcactgcactggcacaggtttaaggccttctcttgggatgggaatgtaaagggtcctgaacatggacctttatacaaggttcttaaacccacccagatgcttatgggagcatctaaggtagaagggcgggcaagtttgctcaggggaggcagtaccttccagtccaagtccaagtttgccttagacagaacctgggaacaacatcgtggagaagggttgctagtgatacccaaacaaaagatggataagagagaggtatccagtagggcacttctgaaatttcaatgtgcacacattacctgggcaattttgtgaaaacagagatcctgatatgctaggtctgggtgggacctgatatttctgcctttctgacaagctctttggtgatgctgatgctggtccttggactactctgagggcagcaaggtgcagacactctgagctcaggtaagctgctcccagagagctggcctgactgatgggctgggcatggccacagagacggcaaacagggccaagcaccacttctcacagcacaacatgagctgaagcatggggatgtgcggggccctgaggggtaaggaggagccacagccagcacccggcctccctcagcaggaggccagcagagtgccagcagctgtgggcaaccttgcacagcccagagagcttttatttgaaaatgcaaagccctacttagatggtggatttatagctggctgaacatgcttaccctaaatggggcacctgctcactcatctctgcaggtcagcactgaggccagcacctgtgggcactggcaagtggctatgagcgggtaactctacctgtctggtaaggctgcctccgaggttcatggtgccagagccagatttgttggtctgcagccacagcatcaccgtggaggtcaacttgtaatgggcggtgcgaccgctggatttctcctggaaggacaagacagagatctgttgagctgagggagagcctgaagtggcccctggaattcagggtcatcctaacatctcccttcctaggtcattatcacaatattaccttttttttttttaaattggagacaaagtctcgctctgtcacccaggctggagtgcagtggtgcgatctcaagtcactgcagcctccacctcccaggttcaagcgattctcctgcctcagcctcccaagtagctgggattatgggcgcccgccaccacgcctggctaatgttttttgtgtttttggtagagatgcggtttcgccatattggccaggctggtcttgaactcctgacctccggtgatctgcccacctcagcctcccaaactgctgggattacaggcccgagccaccgtacctggcctcacaatattgtctttcttaaaaaatctcaactggtttttaaagggacatttgtaattatgtatttcttctgggaacttaatcatcaatgactactgcagacttatctttatccaaatggctttgaggcatttctcagaattaggggttcagagatcacagcatccccctactgcatctgttagagagcagcgcggcactggttggtgtgccatctgtacttagtggcccgggccaccagctgctgggaggcagtacctgcacttctaccacgtggatggaatcccagcagcctttgatcttctttgatccatctccagccttctttatgaggatcactccagcaaagccatgatccagatcccagaggtagacagatgagacgccaccttcaaaatacctgcaggaaacaggccaatgtgcctgttagatgctaaaggacagatcatcagcctgggtcccaggctgctgctcagcaaagattctgggattcagggccctccctgcgacagttatgggagccgatccttgggtgtgttctgatcgttctgtggctgggggagggggtgcagcattcctgggggtgtagtaggtttaggcgtcataaagatgaatctgaggttggactctgccacctcctctatctgtgtggtctttggcttactgaacctctctgggcgtcacactcctcccagataaagaatgcagcacgactgacatccagtgacaatccatgcaggccatgactactggagtcaccacggttgttcgatatttctgtcttttgggatattttacagggcagatgagaaaatacagcaacaaactccctacaccctgatccctcctgagcctggcagaccagggctccagttggtctttcggagcaacctcctacaaagcgctagccggaaatgaagggctcagcttgagacagtgcttcctcctcaaatccgacgcaatgcaaaaacatcttttctttttttctgtttttgagatgaagcctcaccatctcccaggctggagtgcagtggcaccatctcggctcactgcaacctccgcctcccaggttcaaacgattctcctgcctcaacctcctgagtagctgggatcacaggtgtgcaccactgcacttggctaatttctgtatttttagtagagatggggttttgccatgttggccaggctggtctcaaaaccctgacctcaagtgatccacccgcctcagcctcccaaagtgctgggattacaggcatgagccactgcgcctggcccagaaacatttctaattataatcaaatggaagagggatttctaattacgatcaaatggaagagggaacgaaaaggttagatgagaaatgggaatcagtctgggatcccaaacccaacagacccaggtcaactactgtggctcactgggactgccgtgagcagaggtgaggggtggagtcagctgatgggaaccgcaaatgctgttgataaccaacaaaaactatgcgaaatctcatttcttgtggcgaaagtctgtagcctctccgaccccaattaagccccaaagagagaaatctcatctctcgtggtgagcacatctttatcagaaagtctggggcctctctgacacctattaagccccaaagccacggtgtggcaggtgcattctgggagcaccctgccctcagccctggacagctgggaaggtgggccgcagagtgcactgggtgggtacaggcttgggagtcagacagacccaatgacagctctagcacgcccagctatgagttatgctcatgcatgcatgtgtccaacaactatttactaagggaccagcggtgtgaatatgggcctcagggacttaatctactttctacggctgttgagagacaaaaacaattaggaaaagtagacacctgccaaacggttaatgtaaaattaagtactagaaattaacatgtatctgtagattatgtctcaccaaagctattatataacaaaaaatacacatttacagaatgtgggtgatgggtatacaagaattctctgtactcttttttttttttttttttttttgcaattttacagtaagtcataccattccaaactaaaaagcttttgtgaaaaatcagtacacgaatacaccggagtgtaatgtaactaagagaccaccagaccaagaaagcaaggcatcctcccaggagaatgagggtgccctggctggtctgccctcactccaacccgcagacctgcggagcatccagggggccgatactcaggtgggctacccttggccccctgcccagggctccctcaggcaggctgcggccagcccctgcggcaggaccacatcctgtcccattcccctctccggcactacccactatgattaagctctcaaaccgagtacaccatggtgtgtccacgggtgagtctacaggagggcagatgagggcagggctgtctggctaaccaagtgtcactcagggaacacctgtcggatggaggtgtcaggtgtcagatgctgagcccatcgctggtcaaactgcgcagggtggggaagggtctggctctggccaggtgcagcacaggcatcctttcctacgagaggaaaaggaccactggatgaacagacacacctgtgaggcccagagctcactgctggcagaggtgatgtccaggaaaccggccaacactggcactcagagatcccactccagaagatcatttcctttattccggtctgctccaaagtccccattcttggggcgaggcgaggtaagcagatgagtgttttggtccagggcccaaaaccccatctgcctccatagagccctcctggtctggaccgggcccacacagagttggagagatcaggccattctgcaatgttcctggaacacctggagagggatggactgcccctgctggacctgagggttagcagggctcagatgactggcagcatgggctccgtgagcctttctggcttgttctcctggattcttgcaagttaacttacgaggcacatcaatactaccaacggaagagcaactcataacagacctgctaatacccttcctgttggcaacagatggcttggttctagcacaccgttttccctttcagtcggcttacagggagagcagccccacatcaaaagagggggaagaaaaacaaacaaaaaaaccctactttgctggcaaaaaggatgggccaataatccgttctttccttcagcccttctggaaagaaggcttgcagcccaggggcatttcatccttccactccttcacagatccatgcagagctgcggtgctgtgcctgcccaaggcttgctctcctctgtgtgctgggacactggggagatgcaggtcaggatgccctggaggggaaccaggagaaatcccgatggcctgacagcccttgtcgacaccctccggtgaccagttcaaaagcaccaggtggcccacggctgcttcccctcagtcccatccctgagcgtttcatttcttccagaaaaataaaacaaccgcattaaagttttatagggtggaactggccgtttccactccaatgtcccaccctgtggcctggctcccactacgggcagcttctccttggcgggccacggtgaccaggtctaaagtttcaaatgctggagccaggggaggtaaaaatgcaagctcaattgtcactccttgtggggttactattcttttacccacaattttaaaacttactgcaggaacattattgttttttaaaaaaggaaatctgaaaattagcccacaatgccataaatcaacttatcccataaatctgatttttccaaattcccttccagtccagatgcatgacttttatataactgtaagcacagcaagagtaccatgctgaatttggctttttacacttggcacagaatcattagcatttttccatggagccgcatgatctccataatcatttttaacagcaaggatagtattcagtcgggtagtatcctaatttaccatcaatctgacttttaataaagaaacaacggcgacagagttagaggcggcgtggtcaatctctcacttcgaatctgttccctctctgaatcggggtgttccaactgaggtgagtcagacgtgctgagacctggcctctgcaggtacagctcaaacactacaataattcaagaatggacttgcattccattcaccaaaagggatctccagggactggagcagccacaagtctcaacctgacattccgagacaaagggagcagaggactgcatggttagaaaggcctgtttcagaattgcccagaagcaccagcctctcctgcgagtgccatcagggcgctccggcaccttcaggagggaggtgactgcagggcgcacagacagcgcccccgctacatggtttatggctttgctctgcgcgtgaagcattaattaaagggggaccacaacacgtttttgaaaatttatttcttacctactgtactttgatcataatgatatgaaacaaggaaaaaataatttttatgtggtttgcatttatgagtttttacataaaggcttttgtgggtattttaagaatgtgctaaaacgttgtctgaaaccacataaagccatctgaggagtcgcccgccagaattaacagcacatacatggaagcagtttaactggtctttgtatatttaatgagtcaaatagtattaatattgtttaaatgctaacatgctatttcaataaggtggctctaccatcgccagcgactcactctcaggccttgtacttccatgtgagtgaatgatcaaatgtggccaagcgctgagagcaggctgcagaggaattaatccgccctgccctggcccctgcccatgcctgataatttcaaaatctcccaactctgcagggagggaggaatgggcccaggactcactaccacagctcagctgatttgggctcaagaggaaaatcccagagagtccctgcagtgaggtctctggtcaaggaggtagaagggggaaatttttattatatttttttgagacagagtctctctgtcgcccaggctggagtgctttattttatttttttgagacagagtctcgctctgtcgcccaggctggagtgcagtggcatgacctcagctcactgcgacctccacttcccgggttcaagtgattctcctgcttcagcttcccaagtagctgggattccaggggtctgccaacatgcctggataattattgtatttttagtagagactgggtctcaccatgttgcccaggctggtctctaactcctggcctcggtctccactcagtgttgggattacaggcgtgagccaccacgtctggtcaagaacctcttttaaacatgcaggcctaggaccaggcgcagtggctcacacctgtaatcctagcactttgggaggctgaggtgggaggactgcttgagcccaggagttcgaggccagcctctataaaaaaaagaaaaaagaaagaaaaaaaaaaccgtggaggcccaaagagaaatgcatgagcttttcctaggcttctttcctaaatggaaagccagacagcacgggcagcacagggctgaaatcaatccccacagtcaagaggctgaatgacatgctcaaatcagagctccccagtggccaggacaacacagggactagcttgcaaagactgcagagaagtcaacttggacaagtgttgaaccatgaagtgggggggcctcagaagctccaggaagatgaggagggggtgaaatgacagaccaacttgggaatgactgggagcaaagtgctggagtcacctgtttgcttgcgtccactgaagagctaactctttcaactgagtgccatcagttttaccaacggtcccggcgccttttaagactttcctaacacagattaacatcttgttttgttttttgagacagggtcttgctttgatgcccaggctggagtgtggtggtgcgatcaccgctcactgcagcctcgacttcctgggttcaagtgatcctccttccccagcctcccaagcagctgggaccacaggcatgcaccaccatgcatggctaattaaaaaaaaaatttttttttttttttttttagagacagggtcttgctatgttgcccaggctggtctcaagccgtttatcagcacagccaattacaattaaacatctggttgggtttttgtctatcgtcaccttggtccctaaacgtggatcagctaaaagcctaatgtgtcagtaattctcttcttctcagagttttaggtcgtttctccctgaaaatcactcttccagttgaataatgtcatagtcacggatatagattctatgtccgtaacttttcaaccacaggacttctggggggaaggagaaaaaagggaaaacataatacttcacactcaaaatgacctaattcacaaaagtaaaaagaaaagaaaatgtttcagctccaaaagctttatggagtgtctgaagctgaggtgtgcgtggggtggaaacgtgctcggggaatctgagctgtaactatgaatgacccaattcccaggcctggccaacacggggctgcaaatctaacagggaaaacgggaggggaagaaggggctttgaagctgctctttactccttcctttcacatcacctcctgggagaagagctggattcgtggctcgaatacaaaggctcccaacagataatgagtacatgccacatgccacaagaaccaaggccaggacagacctgctgggagcagggctttccagcatgagccaagaaacagactctgtggttctagggttcactgagacatgtccttctggctattagtgggctgggccacactcacaggacttggacctctggcctgagatacctgtgacgctgaggcacaggcagcagccaagttaggggcattattaaggtgagctccataggtgctggaacagggctttctcttgcagtcaacttcactgaataaagccaagggaaaggcaatatttggcaccaacacagtgcaaaagacttttttcttatttgtaaaatcaaagagctggatcagaggccagcgtagagggtcctcccagttctgacattccaggatttggtggttgcatcagggcctgtatgaggcagactgagcaccacagggcaggttcctaacatcttagtctctgtcaaactgctgcttacacacctccagtgacagtgaactcattacattcctgaggcaaacatttctgttctgaacaactgagacagttctctctggacttgagtgaagacttctcactactgccttccagaatcacaaaaaaacaaggacttcatgccctttccttgcatagtcctttcaaacatttaaaactggcttacaccaagatttctcttttctggccttctcctccttgtaattcctcatacgactcaataccttgtttatccttctgaacatactccagcttgtcaatgtccttcataaaagaacagaaaacaatgccccaactaagtgttaaccaatgcatagcagggaccagcacatctcttggcaaacaggctactcctccctccagcactcaagaccaaattagctttcattagcaatcacacctaatccatgctacacatactgaacttgcagtcatctcaaatggagtattttttctttttttttttctctctttttttgagacagggtctcgttctcttgcccaggttggagtgcaatggcatgaccatggctcattgcagcctcgacattctgggctcaagtgatcctcccacctcagcctcctgagtagctgggactacaggtgcatgccaccacacctgggtaattttaaatttttttgtagagacagggtctcgctatgctcaggcaggtcttgaactcctgggctcaagtaatcttcccacctcggcctcccaaagtgctgggattataggcataagtcaccgtgtacagctgaatattttttcttatgtgttgccatgaaaatacctctcacatcctggacttgagaacttggtagactggacccaagaatatcactttccactcaaatctgtgacagatcactctcgtagacatggcttcaacatttcaacgtctcttttgggatcccgaagctgttgtgatctgtattctatccaagccactcttcccccgaagtctttatgcacaggaatatacgtgaaagcaggagactgtgcaaatgaggatgtcactgagttccagatcgcgtggatttccagaaagagcacgggcagccctagtgaaggcttctgtggagaaactgatggtccaccaggaaggagggctctggtctgggcacttttttcatgttggagtcagtataaagatggaaaccaggccgggcatggtggctcacgcctgtaatcccagcatttagggaggccgagacgggcagatcacctgaggtcaggagttcgagaccagcctgacccacatggagaagccccgtctctattaaaaaaacacacaaaattagtcgggcgtggtggtgcatgcctgtaatcccagcgacttgggaggctgaggcaggagaatcgcttgaacccgggaggcagaggttgcggtgagccgagatcatgccattgcactccagcctgagtaacaagagtgaaactccgtctcaaaaagaaaaaaagaaaaagaaaagatggaaacgcccacagccttgatgaggcagaagtagaagggaacacaggaggtggggctggctggaatgccggctgaagagctcaggctaaaaaatttgaagtgttgatgtaactgaaaaaagcagaattcctctatgatctggtgctaagctaggaacctgggccctcaaacagctccaacatgtaagattccacgagtctttcttctcctaccctatgttctcccgtcacatgtatggtgtgttctgcttctgggatctcaccaaggagtagcagcaagacttgggacaaataagtggtcttaggtcaggcatggtggctcacgcctataatcccagcactttgggaggccaaggtggggggatcacttgactccaggagttcaagaccagcctgggcaacatagtgagaccgtgtcttaaaatatatatatatatatatatatatataaataaaataaatggtcatgagggacactttttgctgtactggtgcttggtcatgacaaagacaaggtcatacaggcatgagttcaaacaaactcctggccgggtgcggtggctcatgcctataatcccggcactttgggaagccgaggccggcagatcacctgaggtcaggagttcgaaaccagcctggccagcatggtgaatcccatttctactaaaaatacaaaaattagccaggcatggtggcaggtgcttgtaatcccagttactcaggaggctgagacaggagaattgcttgaacccgggaggcagaggttatagtgccttgagatggcgccactgcactccagcctgagcaaaaagagcgagactccatctcaaaagaaacaacaacaacaaacaaacagaaactcccaagctccatgactgattttatggcaaagaggaagagaataaaacccagaggcagagccattccccggcagctgaggttctggccctaaaacaatgcctttttgttccctcctagggtaaaaaagaaactaaaatccccagctatcagcagtagtttgtttttctgatcatccttaacatccttacaacaaaacaggcacctggtcttcacaggtgggaacaatccaactccacctcaggaaaaagagaaaactgtccattctgctcagaggggcatccaaaacctggctcccttcctcgtggtgtagaccaacgttcctttttgctctgctggctgccatctagccaacttcaaaaagaagctgagcgcatcccctgtccaatggatgggcgtgggtgctgcccagtgggcacaatgttgcaaagtccagagagctgcagacggcacacgaggggctggagagtgtgggttctcttccttacactggttataccagcctgcactcaagatgcatctggcaaacaagcatgaggagatataaggaagatcacaagaaaaaaatgaacgggcaagcacttgccatggcacctggcagagcaagcactcaacaagtggtggctgctggttttcatcaggctcttactttctgaacagaggggaggagaaggcaacctcgacgtgttgtgagctgccctggaagtgtccgtcagaaacacaaagtgccgcttactgggagcggttccgtacccactggcacaggctccacacaaaatggagaaagatcaatgcttggctttgggcgggccatgtccagagctgatgctgaaactcaaccacccttgtttgtgtgttgagaccagctgttttcaccatggtttagggaacacggcccagaggctgcccatggacacgggacaggtattcagcggaaattccttccagtacacacaggtgcaacaatcccccgagtcaacataccaatcagcttaggcatgtgcgactttaatgccagctgcacttagaaggcacatctggactgtggctgccgcgctttagtgtctcgcttttacgaggcttttatttttttacttaaagaaataatgaaggcctctctggaaacaatggtgccgctgcaggggccggctatctggctctgggatctggttttgggatctggccaaactgtccacacttggcaccactgcgactgtcttctgccctctggactacttgtgaaaacactgctggccccatggagctacctcatgagccgtcaacagtcagggctttctgggcttccaagtcatcactctcatccaaagctgccattgttgagaactcattctgtgtcaggggctttgcatatcttttttttacagttaagaaaactgtaacccagagagataaggaacgtgcccaagtcacaggctgagaagcagggatctgggagtagatgtcaggcttggctggccccagtgcccatattctgccccatgccaggctgcctggccatcctgagacgtgccagctgtggtgggatggagcgcaggcggacagaacagggtcagccagtaggttagatgcccgtatgaagccacaccactgaacacacagctgccccaaagaggagaaagtcaggccaagtgcagtggctcatgcctgtaatccccagcactttgggaggccaagatgggaggatcacttgaggccaggagtttgagaccagcctgggcaacagagtgagagcccccgtctccattttttttcttggaaaaaaaaaaaaaaaaaaacggtggagagagtccgagttaaaaaaggaacccgctgggtgaccaggaatccgggacatgccccgagcaccctgtactggggattttggagggttctctgcctcactgaggcagctggggctgctggctgggtcactgcaagaatgccttttttttttttttttttaattagacatggggtctctctctgtcacccaggcagaagtgtggtggtgggaccatagttcactgcagcctccaccttctgggctcaagtgatgctcccacctcagcccccagacactgagattacaggtgtgagccactgtgccccaccgcacctattcttgatacttgcacaaagcagttttccatcacagaagcctcggaaacatctcagtgaggggagtgcagggtctctggcaggatgggggagcttgaccaagggagggagctggtccctgcttccagcagcagagtttcactccaacatgtgcaacggcccaaaccaaagagtgactgtgtgccatctggttagaggaacccaagaattctagaggcatcagagtccctgatgctgacgtggggatcatgttcataagcaaacttgttttctgcacactcctgttttccatttaactttctttcagcagatgaaaatcagactgcacatgccaagcaaccagacactggcctgcagccttgggatgccagatgaaagggaaccccaggacagggggcaacatgcaagcctgtctagatccactctttagggacttgataactgtagcagacacccccactaggagcagtggtcacgaaagagctgaaacgcactgcgagagcaggaagcaggctcagctgtacccctccaaagctgtgaggtttctccagacctttctctctgctctgtgaaaacaacacaatagaggtgggcttgggtttccccattaagtgcttctggcactttctcacaagccccaggcagtggcaagccggtgtcccacagcaggcagggcgggttctcagaggccctgtgcgcacatggctgaagacacaaacatgttcaaacccaagtgctaattacactgtggacatgccagaagccagagacggcctggctccaccctgctgtcccgagtgcaagatgagtggcaagcggtgcccgtcacgggatccctctggaggcctttacatctggggaaaggtcctacctctaggcaaggaaatgagaacacagacctcgctgaagggacagggagtgaagggggatgtccccaaccaaaccgtccctgcagctccaggatgttcttaagcattctccgttactccccttactctgcccacctcccagtggggctctgagtccgcaggcctggccgtttccagcggtggaaaaagcccccggggcacctggaactgcagagttcactcagccagagcaaaggaagcagccctccactctagctgagctgtcaggcccttcctgctcctggcctctccaatccagcctccacactacttccgaggaacttctttggatgcacatcagagctgtcctacccttggaaccttccagacctttcccaaggctcccagaatgacacccagagcccgcaccccacaggcctgtgcgcctctccccactgccctgtcctgttccggcctccactcactgcccacgaccactgggaatcccttcagggcgtggcccaggcggttcccactgctcagggcactgtccttgtcctctcccatcacagtacagggctgtgcccgggatccccagaccacccgaggctccataattcgctacaaggactcacggaatgtggcacaaagttgccctcggggccaagggttattgaagggaacagagcaaaggaggctgagggagaaggcgctggggctggggtcctgagaaaccaggcaccagctttcaacgtcctgctccatgacgtcacacaggacgtgatacactcccccagggatgggcttgacggcatgtgtgaagtactgtctactggtgaagcaagccagggactcagtgcccagggctgtactactaagcaccctctacctagcacatggtgaaatttcagatgcccacaaggaaaggagaaggaaggccacactgtttgcacacagttcagacgtcggaagtcactcttatcagggagtggtaagagccctcctgaaacccaagttcccagctgccagccgcgggccaagctggcaagcatgcctccgagggacagcagtctcaggccagctctgttagccctttccactcaagggcaacccccctgtaaccgacccacagttccttcctcagagccttccctaacatccacaccctttgctcttccccaccgcaggacccagctctcattcctttgcagcgtttatcaaactgtgcaagtactgtgttcatctgctgacttgttcctgtgttgaaacatgggccccatgagggagggactgggcctgacacatttgccactgaccctgggcacatgacaccatccccggcaggttctcattaaggacctggtgaccgatcccaaggattctctctccagtcactgcagacgggcactaccagcatctctgttcagcctcactacaccctgatgatgtggattgagcaggaatcattaattccatttttgagacagagatttcctggaggccttgctgtgggaggtggtggaagagccccatcccgaaactacggccttctcgcatgatcacgaagcctgctaccccatcaggtccgccacccaaatggtcccgtatctgtgatcataaacgcacagaatgtaagatgcaggtacagaatgtaagatgcacgtacagatacctgctgcacaattagaagagccctgtcacccagcagcctggaaggtgctggctggacgcaaggcgtgagtgcagcaggggtctgacgcacagtgtgtcactgagtgacgcctcagcccacagcatgggtaaggaaacggaggctcagagaggttaactcactcgcccagtcagtcagcaagaaaagacaaagagagaatccagtccaaagctctttaaagccaaggtcctctccattccgtggctgggcctcagacgccatgggtgagggtcagaggcttttggtgggaggtggtggtgccttctgcctgggaagccccccagcacctcagctgcccgctcacacttctgcactctttccctggaaaatctccccctaccgcctgcagttcctccacactcacgtcccgaggaaggggtgccctgaggggtctggggctgggaacctgcagtttcaaggaccccggaaatcaggtgcaaacatttctcacatgtgaacatggacatcctgcccttcctgggccaatgttcctcaaacatcaaatggcgggaaggagcaggaacaactgcagttctgaaatggcccagagaggggacaggtgctggggagcccaggccggggggtggggcccatccacccagctcctggctgctccactcctggagaggcccttgggccctgggactgccatgaggacgccagccttgtttcactctataaacttcttccagacaaggagggctgattggaaaagctaattaaagcttttgaagattatctcagaactgaagcaaggaagaacacaaaataccctcccaccctgctcctccactccccagactctggccttcattaggctttgatttcaatcaattgcacacccactaaaattaacttataaggccaataaattgcaaccgcatgtttgaaggtattatctgctccaagccaagagccaaggacttcagagcattgggcgagatgtctggcgcagatgggagtaatcatctttggaagaaggcagtgccagccctttggtcagaacatctggtcccaggcagaacccggggccgacacaggccagggccagacttgatgtgaaagctggagcagggaaggtttcctatcttctccaggaacctgaaaaatcaaagtgttaatcttggggttcatggcagcccactggtcgctcacaccagcaagatgttcctctgacagctgctggtgcctgacctacagcaaagtctccacttctaagtctctcccaagaaagatcacttaggtcaaaagatgaggttttgtgactgatgagctagcctaggcttggacctaagaaagcagagtcggctctgctgagaaagagtgtcaaatgatcctccgagccagctgcccaggagtcggcccgctcggctgtcttcccctctgcctcagtgctcagttctcgtgacatcccctggatgagtcaggcccatcaattacaggcagaaaaccatcttggggcttggtagagagaatagcctagatgttggggaccaggtgggtgggctggctgggaggggaagtgatgaaaatgaaggtgacttgcgagcagataataccctcacctggccccagcacaccagcaaaatgtgcttgtcatctcctaagcatttgcgcaaactggctcttttcatctaaaaacaaggctgtttgggtagtgacagttactctcctagggaaagtactactatgatctctttctgcccctgaggatggcagagaagggaatcatcagcatggaagggacctggacgtgagaatgccgcagggacccagcagaggcagggcaagccaggagctagtggacttcagagggagccgtgaggacacacggctcagccccctgcacccctactcgccttttgcccaccttaaggagtcacgctcccaactgctagccctttcaatccacaggggagaggggctgccacatctccaaggagttacaagccagaaaggcctgctggtcaacccgtcccctggcccagctccatcattctgacattgattccatgtgcttatgattaaatccaactccctacaaagtcagagcctttacagagccagggatcaaagcccagagcctgaagacagaatctacgtctttccctcaggatccagtgaagaagatttttctctccggtggcagagggagcctctggggagacggtaagttctgctatctgaggaggctggtgtggcccgtgggctgcctggatcatgctctaggtctctggaccctcaagcctatctctttaccaatgtctcctttcacatattttttattttttagttttcttttttttttttccagagacaaggactcactctgtcacccaggctgagtgtatgatggcatgactatagctcactgtaaccttgaactcctgggctcaagcaatcctcctacctcagctgagtagctaggcctatgtgtgtgtgtgcctctatgcctgactaatgtttatattttattttttggaggtacagggtcttgctatgtcgcccaggctggtctcgagctcccggcctcaagcaatcctcctgcctcagcctcccaaagcaccactaatcttttcaagcagggcctcaaggagtaaggacaaagctaatgggttaatgggtggggggcaggcacctcgttcctgactgtggcacacacacggccagtgcctgtgggtgctacgtcagccgacaacaaacatgcccacagacagcaagtccagtcttctggcatgagccagcagggtacggcgggggcaggaacaggggcaagacagggtatccaaggcctctttattccttttcttgggtcaaatctctgtgtgagcaaagtccagtgtgaccttctcagcataaagagactttttaggccataaaacaagcggctccctggaggctggctgcagcacagtgtccccacgggaggattctgagctccaacgtggcaggagcctggcagctctcagtcattcgatggggttggtggtcatgaggctggagctcaagccaaacatagtcctgattgcgattcatcaggatccaacaattcagaagcacctggaatcgtgaattaaagaccctgtcaacacagtctgctcttccaacccccaaccaccaggggcgcaggccaagctctagcttgaagtgtgtggtctgaaagtggcagctgcacctgtgcagccctcctgggcacaagggcgagcccagcctgctctcaaggggtggcttctccggccactccccttttctcctggcagggtgggtctggctgaggctctggccatctctcacaggccggggacaccagccactttcctggcccctcaggcagcagctcagggtgaccaagccagcagacgggagcattgggtggaggtctcctctcagaatgacccttgcctgaacccatctgccaacctgaacagaagataggtgggagagctgtggccttgctcaggggacaacaaacaagtctttctgtgagaaagtgtttgtatggggaagggctagataaaagatgaagagaaagggatggcctactgcctctccaccccatggaacagcctggtccctagaaaaccgagtgtgaccctggccaatgcccctcaggagacaaggccacccagctgactcccctctgctccaaagccacggggaaaagagcttgcattccagggcctgctgtggtcacttatgtggccaccaacagcctcgcggggcactctgggaatgggaacttctggagatgagcaatgtaccacaatgtaccaagatgtttttaaaaaagaaaaaaaagagacttgttctcataatttttagactataaatgggttggttcgtcacatgtggttcagctgggaaaacgttcctcgcatgtggtcccaggagagagagctcttcagcacactccgatggcactgggtgagtcaaaattcatgcctctggtatcccggatggcagctccaactgctgtccctttggtggtctgcggtccctgtcacccaggaagagcctggccccactgcccctgcacatgcaaggtaaggaagggcctcctgcctctcctgcggggccactctcctccttcctcccgaggtgctgggaacagaacggcaccagcctggatcccactacacactgttgcagaccctcggggtctgggttatccagttcgacccccaactgggggcaggatgctgtcgtcacccctctttcaactcccccgagtcagtttaccttcagagaggagtgtgtaggcaagtcaaaggcacacagaaatcaaaagccaccttacaaatacacatttcccagggaagggaaaggcttcaccagaggcagcgtgaagagtgaggccttagctatgactcccggctcctgtggttttctagctgtgttaaccagcttgagtacttatctgagcctcagcttcatcagctgccaaatggaataactcccacttgtcctatagtcactgtaaggattcagtgattattctgaagagttttaatgatagtagggaaattctcatgataacaggccataaaagcccctgcagaaccatacaccatgtatcattacatatgtgaacgatgagatgggaagggagaacaagggaagcagaagtccaagatgaaactgggctcttccccaaggctggccctaaatggcgaagtaaggcaacacatctgattcactttattaagggagtaacaacatgaacacttaagtctcataaagaatcagaatcacccccacctccatatctcaacatgcagcccagtaataagccagagtacagcctcctcatagaacagaaggggtgaggccaggcaacttcctcaggcttaggggatgacacgcatggcacgttagctccccaagctgggggaaaatctagcaaacactttcaagggggaactttccacttccaccttcaaacttagctgaaagggcaggctgtattcctggagtatcctgagatggctcccaagaagcttacatataaaaggggccaattttgcccaaatctctttcaaattgacttccaatttaaaagaggctgagggtgtgcacttgctggttgacagctgtgtgtgcacattaaggggcaccagtctcagggccttagacaggtgagtttgcccctgcctcagagaccctggcacaaccagcccccctgcctggctggcttcctcaatgtcagacctcagtcaagtgtctcctcaagaggcctcatgggccactctacataacaagtcagctgctccctgttatcactagcagcaatgacttgttcactggtccactgtttgtttttccacaatggagtgtggtgagggcaggggcctcatctaccacgtacgaggtgcatccctggtactcagcaagcacccggctcatgggaggcactcaaatgtctgctgagtaaataaatcgatgttggactctggagctgggtaaggatggtttgatatcccagttccaccacttactagctctgtgaacctgggtaagttatatcacctttctgatctgtcagctcgtttgtaagagggggataaccctctctcatgggttcttgtgaagaccgaatgagacagagaatacctggaggcccacttgcatggccactggtaactgttatcatcaccatcgttattttattaccagtattatcactttaatattaaaccaattctacttgggcattcttgtttaatagctggattggcttcttaccaaatgggcaggtaaaagaagatagtaaaaaacaattacaagtaaactaccatagagcaatgagtcagcttttcagtatcactggggaaggaactattctacaataggacaaagttctagatgtaagaacctttaaaagactgaagcctattttaactgtgaaaatcaacaatttgtgggaatttcagataaatatgggttcaaattctagcttttcacctccatgtcctgtggtcttgtgtgagtcatttaacctcttggaaccttggtctcatttgtaaaaggaggaacaaaaccatcttccccagaggttcttgttaaggagtaaagataatgtatataaaatattcgtatataatagaactacagactgggggccaagccccacccacctcaaagctcaagaggtgaattttacattttaaaggttcaacagaaaacaaaccaagaagcagcaacagagaccttatgtggcctgcaaagcctaaaacgtttaggatctggttcttgacagaaaaaagtctgccaacttgaattagtattgcctattttacagttttgctgtattttcagtatagagcttaattataaatgagattctgttgattatggctaactttctctggagcccttccttgtaagcctgaacaattaagtgacatgttggtgctgtggtgctgggaggcaggattagacggagcaggaagaaatctcaacagatctagcaaaacgctttttaaggaaggtgccgaggccacaaacaactcaggattcaggaagatgtttgctgctctgctcctgctctgtaaggactgcacttatcttggcctgagagcagctggaggcagaggcccctgagctccaggtcagaagtgagcgtgtggtatggcaaaaaaatccatacgggcctttggagataaacaggtctgactttaattcctggctctaccccttgctgtggacaaatactttaatctgtgtcttaatttcttaatctgagaaacgaggactaaactagctatgtttgtgaggatttgagatgctatgtagaaatacctggcactgtttcttatacacagtaggcactgtaccagtggcacctgctgttattatgaatcacgatgcaggggaacagcacatagtgaagtctggtagcattctatgaccgagtcatctcataaccaacccaaccaccaaacgagtgccctgcatcctgctatgggaggctcccaattttagttaggtgagccaggtaacagattcaagggagaatgcttggccgggtaacagattcaagggagaatgcttggccaggtaacagattccagatagaacactgccacttaggatttacctctcaaaactcacaagcgctaaagtgcaacaggagaaaatgactcacaggtctcgatactggtcaaaggcattgttggcttccacctccagctttctcagccgagctgacggcatggccccatcctccaagggagggtcatacttgttactccatggtgacctggagggaaggaaggaaaagtatataccatgaatcgttccatgaagacacggccagcgagcagggagcctgagccctggctatctgaaatctcggaggcaaagccgctaactccagcaaagatttttctgggtcctggcaacaaacagggctttctggaggtttggagaacaagggctctgatgcgggcagactggggcacacgcccgtgctccacctctcactggctgtgaatgctcagcaagtgtcccaactccctgagcctcacttttctcctgcgtaaaatgcggctgctacttgctccgcacacagggtcgtcatgagaaatgagacaagcagatcaagcgcccagcccagagcttgccagactgtcagtgttcaacaaatgctagttctttcttacccgctttctcagttttgtgttcaccacctatttttttttctttcttttttttttttttttaagacagagtctagctctgtcgcccaggctggagtgcagtggcgtgatcttggctcaccacaacctccgcctcctgggttcaggcgattctcgtgcctcagcctcctgagtagctggaattgcaggtgcaagccaccaggcccagctaatttttgtatttttagtagaggcggagtttggccgtgtcggccaggctggtctcaaactcctggcctcaagtaatctccctgcctcagcctcccaaagtgctgggattataggtgtgagccaccgcgcctggccatgtgttcaccaccttatagttcaacagatgcccctctctcctccctgatttgctggaggctctacataaactttaagaccttcttacatagtaagcgttaagaagagagctgtcagttacagaggcgggcaagagatacagctccacagggaaatgctgattacattagaaaacctgagcaatcaggttctccacgtgaacacaggatagcttttccaacatccaagagctatgcacacatatgaagactgctaagtaatgagaaccagtctttttgcagcccaaaagacttgctgtatttcttgaaatgtattttgccacatcaggaaagcatttaatcacactgagaactggaaagggggttataagggaaagatctactcattaattcctgcaggtggggttcagagggccgagtgttcagagaaagtagcagaattaaaaaggtgagagaggaatgaaaagacagagaagacaacatggaattcagaaaaagtccttcacactcttggtctaaacgcctcgctgtttccactgtcagagacccacaatgccttttccgcatcccctcctgaccacatcattgtgatgtggaatgcatgttaaggaaaaaaaaagtatgctcatcatcttccaaaccccagttttaaagaattctgcacgcagacatctttcttcttggtaagtgatgctccaccaggcacctacgtcagtagatcatggagtatggaaccagaataagctgggcggcctcttccaccagccacccgcaggcagctttctcagaggctggttcacaaacggtatgtaggggaagagttgctgtgcttggtgtccccaaagagtctccaggcaggaattacactcctgatcacctcaaagcagaaggagccttggaaatccttgtttccaagctgaccactttctgctgctcaccgcagttttggtagagactttgcaagaatggggtgagacaccccctgctgccccatgagcagcagccagctttcatggtcacactgggccatcgcacaccatgggaagcaaactgtcaacaagctgggaccccagatggctgggaagacaggcgtgccgcccacaatcgatgcctcagttctcctgagaagccaagcgcgggctgacctgtcagttcttgtagcctgtcgctcctccctctgaaacggggctgcccaacagaacttcctgagacgatggagatgttctaaatctgtgctgtccaaaacaagtcactagccatgtgtagctacttgcatacttacaatgtgaccggtatgaccaagagactcaattcttaattttatttaatgggaatcaatttgaatgcagatagctcactctagaacctcagctaggaggcggcaagagccttttctgtcatcttctcttcgggttgctcagcacctagaacagtgcctggcactcaactacacgctcattaaaaaaaaaaatgtttttaagaatgaatttggccaggcgcggtagctcacacctgcaatcccagcaccttgggaggccgaggcgggaggatcacaaggtcaggagtttgagacaagcctggccaacatggtgaaaccccatctctactaaacatacaaaaaattagctgggtgtggtggcatgcacctgtaatcccagctactcaggaggctgaggcaggagaatcacttgaacccagaaggcggaggctgcagtgagctgagatcgcgccactgcactccagcctgggtgacagagcaagactccatctcggggaaacaaacaaaaaaaaatgaatgaattcttcttgtccaatcacagttgtaaataaataaaataaaaaagcatgaattcttgcacccccgcccccccaccacaacagaaccaaccactccctcctccctctcacacagatgttgatcctcatgcctgtcatatccttgcccttcttccctcaccctcgactgcaagaggtctttgacagcagagagcctgtgctgcctgcccttgtccccagtacccagccctgagttagtgccaagcagatgctgctggtggaccgaagcctcacagcccgggagaggaagaaaggggaattctgctggtgttccacttctccaaaccaagagatggagcagctttctggctttttcatgctggtcacgggcatggcgcccaggtgctgtccttcttgggagcatcttgctctgtcgcccaggctggagtgcagtgatgtgaacatggtccactgtacaggaccataggcatgtaccaccatgcccagctaattttttttttttttttttttttttttgagacagagtctcactctgttgcccaggttggagtgcagtggcatgatctcagctcactgcaacctgtgtctcctgggttcaagcagattctcctgcctcagcctcacctaagcactaaaaaacaaaaacaccaaatcaacaaaagcctctcatcagatctcagagacaaagatccaggtgaaaagatgctgtcgccatgatttatctataaacaaggcttggttcttctgctggccgggggagtggataagaatctgagggtgtggagctgaattccctccttcccctgggtggccctttgagactctgcagcacactcatacgcaggaccgttcccacagttcgatgacagccatcgccttcctgtaggctgggaagacccgacccaagtggcgttcatttcaaggcaccctgattagacacaagagcccatctttcgggcagactgggggcctgcaatttgcaagaagcctgtaactcacatttctactggctcacagacgatagcatttcaagctgttagtcctgaagccagggtaattgtagctgagggaaatatcataacattaaccagaatattcttagtggaaggggcactcagaacacacttaagagcttaaatggaggccatttgaaaaaagacagatggacaggaatgcctagatttcaaaagtcaggactttcatttccctccgagaaggctttttgtttcagctaacaggtttcaaacggtgctgctggcaacggtcacaccataaggatcttatttaagcaaaccatcaaacacagtcaggatggaaatctgtggacagaatcagaagaccttgaagtttcatatcgagaagaggagaaagaaagacatactttctgcctccacaccccaggctcctctctaaaggcctgagatcccccagagctggtggtagggcctcaggaatgcaggtgggggacaaaggggtgacctggaagggctgcaggtaccaagtctcccgcagagcctggcctagccacggacctagacatgatcccgtccttccaccagctcctgcagaacagctgccttacacagtcaactggagtttttaggtggaaataataaatataataatgatgttgattaagcaagaccagttcaaggaacacctcctccaggaagcgttccctgaactgcatgccgggcgagaatacttctccctgcctgctccctggtctgtcagaccactcaccatcttcactggacttctctctctaagggctggtccacccacttcatcagtggctccctggctgggcaatgtggctcacacctgtaatcctagcaatttgggaagctgaagtgggaggactgcttgaacctaggagttcgaggccagcctgggcaacaaaatgaggcccccatctctacaaaaaaaaaaaaaaaaggagagagaaaaagtcaaaaaaattagctggggctgggcgcagtggctcatgcctataatcctgacattttgggaagccaaggcaggaggatcatttgaggtcaggagttcaagaccagcctggccaacgtggtgaaaccctgtctgcactgaaaatacaaagactagctgggagcgatggcgtacacccgtaatcccagctacttgggaggctgaggcaggagaatctgcttgaacccaggagacagaggttgcagtgagctgagatcgtgccactgcactccaacctggacaacagagtgagactctgtctcaaaaaaaaaaaaaaaaaaaattagctgggcatggtgatacatgcctatggtcttgtgcagggggccatgttcgcatcactgcactacagcctgggcgacagagcaagatgctcccaaggacagcacctggacgccatgctgtgaccagcagttccaggcacagaatgagcccttcaaggatgaatttgatcggcctcagggctgtatcaccatctatatgctgggacatctgcagccacatccccagcctaaacctctctcctggaactccacatggtacatccacagcctacctggtatctccactttgatctaatgggcctctcaagcttaaagtgtccctatgcctgctcctccccgagtcctcctcacctcaatcaacagtggctcaggtccgaagccttgtaatcacccttcacaccccacctcctcttcttccatccccacctacctgcagaggccgctggctctacttttaaaagtgacctcaaatctcaccacttctcaccatttcaactctagtctgtggtctgaaggagggcaaaatataatctctacctaatttccatttaaagccaggaaagggacatgattataaaactgttgtctagtctcttataagtcagtattaaactttttaagtatatgacaatgtctgtgccattcaacatttcacgtgtgttacttcttttatccccccaataaataaccctgtgctaacttttattaccctcagcctggccttcaagaccctgccagacctgccctggccatgcctcctccctcatctccgcccccactgccctcccctcactgccttctccacctctggccttctgccagctccatcctggtgagctcatcacccagggcctcagcacccagcaggctcttccccagacctggaccttttcatcctccagttcccacttgtgggagagccttccctgcctgcccgtcctctccctccctcccactgtcctctttattttcttcaggaagcattctgttgagtaaagaaacactactatttccgttttacagatgacaaaactaaaagaccagcgacaataagtgatttgtcaaagtcccattgacacagggagctgtgctggtttgaagcccacactggctgactcctgatcatttttcctgctttgacttcccagaagccttgccccatctccaaagagagcatcagggtgaagcttcaagacaaccctggttctgtggtctccaaataaacctaaagcaggctgtgttcctctaccattctccaaggcagtgactactgcaattcatcatggaaacactgggccagtttaaggattcccactcttaaaaaatagaggtataactcctacatgcccttaaaacccagctcagacatcacctccttcaggaagtcctcctggagttgaccatggcctcttctgtgctaccgtcccaccctgaacagactttgcactggctgtatgaatcacatcatacagttaccagttacccaatgtgtctcctatgctagacctggtgatcagacacccagggcagggactaatgtcaacttagttatttacagccttgggcgaggtgacggaaagagagaggagagttgtgtatctgacagagctgcgttcgtagatcccttaccacagagaccctcccagccctcaggatccccatcatatgcgcaccctgtacactgccctccgcaggactgaatgcaattataatagaacagttgtttttgaacaacatccctctcccgttagactggaagatccatgaaggcagggggcctttggtccgctgctctatctctcatgcttgtgggtggcactcttcaaacgtctgctgcatgattggaataacagatggaacgatgagaagaatggggaggacaagagaagaaaggagaggagggcagggaacaaacggaaggaaagctgaatgggctgccagctgcccaagtccaaggtccccgtgctctgcagcaggtacctacggcagcccgcgtgtgcctgctgtgcctgctgcatccccggggcatgagctcacctataggagtccccatctctgttgtagtcacacaaaaggtaatcctttcccaccaccttgtctctggcaattttcagtggctggtcaacagaagacaggagatcctcacatagactggggacctggcagagagaaaggacaaggtcgaaacagaggttaaaacagcacaccaaactcaggtggctaacaatactgcagccatattgtggtcagtacctttaacatctggccctgggcactgagacaaaattatgggcctgttcttttcttttccacatgtgtctgacaccaactgtgtccctctataaagaaacccattcttgaattacagtggagcgtgatttctaatacagtcttccttccaaaaactgtgtgcagctttaattacctggtcaccagggtggcctagtaaatttaagtgtgtatgtgcttggtattggtctctggtgggcaaagtacaagctgaagtcccgagaagaaggtaaacatttcaaatacacaggaatctaaagaactcggagtagaaaaactcgtccgtgccgggaactcccacaggctcctatgctgggtggagtctccagtactttccaggcccctagccaagtgttaccagttggcttgtagagtcaactctatctgctgcaaagagagcttcaccccggctcccccacagcacagagccccagtgggctcacctccggctggcctgccagggggccgcctcaccaagaaagatgaccccgcggtcgggggctggcaggactcaaactctgggccaatgttgcgactctgacacaaggctctgcaagtaaccaggccactggcctcctcctcccaactcaaacatcaatttctaccaaaatatcccagaaagggatggcagcactttcagaaatggattccttcaggcctgagtcacttccacgctatattttcaatgtgctgacttatttgtttcatgggcctgggtttatgggggctccaccatatcgtttaccaggaaagtgcctgccagttgcaccaataacccttcccagtggaaaaattccatcgtatggcaaagacaccagcagagcagctcagcagacgggctgacagcgacagtggttcctgtgttcttccagaaggcccttgccaccatccaagagacaggcagggacagggagtcccaccaccacagggaccacccagcctccacgggctcctctgctgcccctccagggtgctttagaactcagcttggaaagcaacgcccagcacaactaaaggactgtaaccctgcctcataactcacagaaattctggccttggtgagatgatctgtttcttatacaggggacagtacccaaagagatagacatacaccaccaacccctgtgtacaatgtgctgggcttacaggtgtgagcccccaggcctggcctgtacctgtgcttgttttcagaattctttctccatgtgtatctgccctttcctaacaaacataataaaaatgggggctactttcaaagttggttttggtgataatatcatgcaccttaccatttccatgtgcctgccatgcaccacgcactatggtagagcatattgttgacttgaaagctcacacgcattctgcaaagtgggtatgcaaagccccattttacagattagagttgaggccgggagccataaagttacccaagggccacacaagaagcaagcagtggagacagaaaacaaaaccagggccagatgagtccaaagtccctactcctcctactctaactttggtttaatgtccagctaaggggaaggacagtgcatgctaaaggcaccctctggtggcaaacagccctctcctagccccagccctgcttagctgtggccacagagcccttcaactggaaggaagtcctggctgaggaaggaaggtctaacagcttccacccgaggccatctgggacctgaaagaggccttgctgtgctgccacagccaatgaagccacctcacctaacacatcatgcctgtccctaagcatctctgtttataatgctgggatgctgccttggcttatctgttgggcctcaacttttgcctggaacccattctctctggttggagtcctgacaccatcagctcaatttttcctcaattacagtagagactgagcaaacagggtctgaagttagacctcctgactccgctgcgtacaagtagccttatggcctgggtaagtcattttacttctctactaagacttggtttccgtacctgtaaaatggggataataaaaccaacccatctgggtgcccatgcccatgtgattttgaggacccacatgacacaatgcattccgtgttcagggcagagcctggcacagggaaatgcacgtatgttactgcctgacacgttcaggttcctttcccttcctttagacaatatcatctgtcacctgttactctcagatggcaacaatagcctggatcatacctgaattcactgtgctgcttcagacacagggtacaaacgtacctgtgaggatccggtgcttcaccccagttccacctggagccagctgtttcccttctcctgccaggcacactgcttgcagctaagtcccctcaacgtaggaaagctcacaagaaaatagggtttggtataaaagaggcttgactctactcctatccaagagattcatctatgaatcgaaagcatctgagtaatctcttcctagcacttaacaccaggtggagtattttttcattgatcagttatctgtatccctcactagaatgtaagttttactggggcaaggacttcgatcttactcactgcaggattctcagtgcctgtggctgtgcctgacacacagcaaatgcttaatatatttgggaggaaggaaagaaaggagggaaagagggaggaaaggaggagttttacaacacggagcctcccaaactccaatcaactttactttaaaattaataaattggcaggtaataggaatctttagcaaaagcacttgtccagaactaaatctgaatggatgctgatgacaagtttcctgtgtggttccaacccagcactctcagatatgaaccatggtatggtgggaaagcactgaacaaagagaaccggagctgtcatgaaagccctggcattttttattaacatatgacctcaaggagccacagcattggtggaaagagtgagaactaagagacctgggttctagcctctgctctgctgtgagctggccacggaaccttaggcaaagcccaagactgttcatttgtcaaacacagtagatgagctgcacggagacagaccacccttgaagatctgtgatgggacttctgaaagccagtatgccaggtactaaccaaccccagaaaaacatacatttaaactggaactcaaaaactggcactgcttgtcctacagtgaaaagcctctgggacttgatatggccaacggactccacccaagcaggcaccatttttgccttttggatcaactcttaagctgggccatagttttggccatatttccatcagcgctgtttcttttgatcaaagataatctgctctggaataataacattttcgttgtcatggggaatgagaaatgtggaataatacatggtgtgcccacagacttggaccacagcagctgcccaaaggtgcattagtcacgacctggcaccatcactgatcccgtctcatacccacgccgtccctccacctctgcccgaaactcctcaaacaaccacacggtcccattcaccactccctgaacatgcacgtgcattcccccacttaaacatcttccccattgagggttgctggataaaacagagggaggccagttcagtctgaatttcagatacacaatgaataacattttagtatgactacttcctaaaggttacatgggtcgtgtgttttttttttctcaatgagatggagtccagctctgtcacccaggctggagtgcagtggcgcgatctcggctcactgcaagctccgcctcccaggttcatgccattctcctgcctcagcctcccgagtagctgggattacaggtgtgtgccaccacgcccagctaatttttctatttttagtaaagatggggtttcaccacgttagccaggatggtctctatctcctaacctcatgatccacccacctcggccacccaaagtgctaggattacaggtgtgagccactgcgcctggccaggccatgtatttttatttgctaaatctgacagccaatccccactgctctcttaaatcttactgatccttcagggcctggcccaaactccaacttctttatcaagatgtcaaattcttcagaattcctgcagtaacactaatatcaactgaatcctaaatgctttggggatggctgttctaatactgccaatgactttcaccttactccttcctcaccacttagcatttttcattgtgaattgactccacacctacagaggccaagacaggccctccagcctcagcgcagcatcacgcccgctgcagcagggatcagtcaatgcatgctgattccatgtaagtggatattaatcctgtggtctgaggccatattacagaaccagaatgaaggcagtgtatctctgtaatctaaccagtccctacactcatctgaaccccggcccccgccccctactcatgtcgagtgcttagagcagtggaagaaatcacattaagtgtcacagaccatgggtttgtacagtgatttaaatgaaacgacaggtccaaacaaagccgagagttcactttggggtgcatgtggcactggctctgtcgcctccaaagccagggagggcctctgaggaggaggagcggtgctgacacgcggcagccggatggtttctgtctaaaccacccatctgaactgcctaacggccttggagggaaggttcagataacaccaaaggtgtcagaccaatccaggctgttggggggatttaaacataattcccagtgacttggaataataaacactacactggtcaggacagtgcctgccgtctttctggtgggagttcagggctccaccagttcctctgctgccacaggagtgtgcccaccccagggagcaggagccacaagtccttcaccaccgatacttttgccgggctcggtggtacccaggaggccactggaaagacgggtggggagtgggtaaagtgaactagggcagggaaaagaaaaaaccccagaaggtagaaggtaagggagagactaggatgccattggcaacggcctcaggtgacacctgaataataatccgtggaaggaccaggtgatcgtaatagccctgccctgcgtggcaggcactatgctagcagctctccctgcccttccctatgatcctgacaatggctcttcacacagacacgcactccagtccttgttttaaagaaggggaaacagggccttagagaaataacttgaccggagccacgcagctacgggccaatgtctgaggaaggacatgcagttatatacagcacagctaggttcaaaaagaaactgcttttcccaaactgaacactttttttttttcttaaatcatccaacccaacagctgatcacacgaagagatacaaatcagaagtttccggccacaagtgaggttcgtgtttgtgccgccatatggttctactttgcctcttcctcttctccattagttattaatgttgaaaaaaattgttcaaccagaaaaagaaacttgagatgaacccttaaaaaaagcacaaaagccagagcagctcagacccacggagtctaacccacggcgcccttgtctttaagaagtgcacccttgtacctcggttttttaaaaaatggccaaatgaacacattccatcttttgatctgcctgttggccgagagcccaccaccagcaagataggaatcaaaaacagattctgcgtacttgggtgcactcagaggaaactgccacgccagaatgctgcagctgccgacgtccagcagagggctctgtgacaatttgttccttttatttttccagaaggcccaaaactttcttaaaaagataaaagagcatttcaagtggcacatacactcgtgtcagaaacaaaatatacagtgtggcattctgtaaaaacaccaacctcgaaaccgaacaggttcaaatcctcggtcagtcacttgctggctgagtgtaaccttcctaagtctctggaactgggggttacaacatccatgtcaaggagaaattcacactgttccataaaccccgaatgcccgctccaggcccgtgtcaggtgcaagggctcagcacgggaagagatggacatgggcggccctgctctgacagcaaagtccagccacagaggcatctccaagaggcaagggtaggccaggcatggtggctcacgcctgtaaccagcactttgggaggctgaggagggtggatcacttgagttcaggagttcaagaccagcctggccaatgtggcaaaaccccatctctactaaaaatatacaaaaattagccaggtgtggtggtgcatgcctataatcccagctactcaggaggccgaagcaggagaatcacttgaatctgggagatagaggttgccgtgagccaagactgtgtcactgcactgtagcctgtgcgacacagagagactctgtctcaaggtaaaaaaaaaaaaaaaaaaagaggcaggaagcgaacctgcaggagacgacagaagggggttgctgtgggggcaagtcagcagtctaggaggtggcacagagatgacatgtgaataatgaccaaggagccggccctccaagactgcagggaaaaataacaggggcatcccaagaagagggaagagctggcatgaggctctgctgcagaggccactgaggcaagtgcaagaacagagaggagcaaagcgcggctggagtgagacccagtgaggcagcacgcagcacctcctgggtcactccaagtgtgagggcaggccctggcacactgcttttcttaagaattaaaaaaaaaaaaaaaaaaaggccagctgcggtggctcgcttgagatcaagagttcgagaccagcctgggcaacagggcaagactccgtccctactaaaataataataataaaaatagccaggcatggtggcatgttcctgtagtcccagctactcaggaggctagggtgggaggattgtttgaacccgggaagtcgaggctgcagtgagccgtgtttgcaccacagtactccagcctgggtgacagagtaagaacctgactcaagaaaaaaagtgtttacttatgtataataggtaatacattcacataggtcagaattcaaaaaggtacaagagcacatgctgggaaaggcctcccagtgagggcctgcaagctggctgtcctcgcctagggagatggcctccaggtcaggatcccttcagtggggctcccttcaccggtctgtccagatggacacatggcctccaccagcctatgagagatgcaggaatccccaccccaccaccactacttagtgtagagaaaacacaagcctgctccccaactccccaagggcagcttcgttacagggaccccagtttgtcattaggaacactgagccacggaagcacagcttcatgtagccgaggctggagcttccgacccattttgcctaatggctctctgagcatggccacctctgcaatgagaaggcacctgcacaggcggcagcttcgcgccgggcctgaaagtcacacccgggtggccaagcttgtttttggacgggaagcagctgtgctcccagagactcaggcaagtggtacccctgagtaaccagagggggaccccaggggctcccgctcaccccaggaagcatcaaaacatatctccttaggataatagccacgtgagctagggtatggcgcacctattcggaggcaggattgagggcaccccccaacctgtggatgagaaaacccaggcacggggaagctgctggccccggctgtcccagccaacacgaggtggagaggaatgagaatctcaatttgagactgacccagctcttccaaagaccaggccccaccgggtcaacaaggcgagctgcccccatccccagtcaggctcaggggacaggggaggaaaaaagaatagaattgggggaattatgggactgtgaggaccaaagctttttcccccaagtgcccggtcacggcagacccaaggtgcctggggtcgcctgggaagggctgcagggctgggctctcctgcccctcaccacagcccacagcccacagcagatccgacatgtgacctttccactctgggcctcggggactcctggcgtgtgggcaggggctcagtgcctactgcccagcagagcctagtgagaaactggccccccgcctgccagggccacacacaagaggacacttccaggtccagcctctctcctctttaagaagtcacttggcgctgagggccatatttttttgttttgttttgtttttgagacgaagtctcgctctgttgcccaggctggagtgcagtggcgcgatctcggctcactgcaacctctgcctcccaggttcaagtgattctcctgcctcagcctcatgagtagctgggattataagtgtgcaccaccatgcccagctaatttttatatgtttatagagatggggtttcaccatgttggccaggttggtctcaggtgatccgtcctccttgccctctcaaagtgctgggattacaggcatgagccaccgcgcctggccaagggccatattctttaagtgcaagcacagcctgctttcttcctgtgaaggctgtaagttgtaagatgcaccagtaattataacatcgctaagtgtacacattaagtgtaagaagcaatttcccaattttggcaacattaaaacgcaagcgatggctgggcacagtggctcacgcctgtaatcccagcactctgggaggctgaggtgggcggatcacctgaggtcaggagtttgagaccaacctggccaacatagtgaaacgctgtttctactaaaaatacaaaaattagccgggcgtggtggcgcaggcctgtaatcagctacttgggaggctgaggcagaattgcttgaatccaggaggcggaggttgcagtgagcagagatcgcgccacagcacttcagcctgggtgacagagcaagactctgtctcaaaatacaaaacaaaacaaaacaaacaaacaaaaaaagtgagcaagccacgcaacatagatttgagataatggtacatacagcacatctggcggagtaacacagatgtttctgacttaagatttttttgattctgcgatagtattcagtagaagctgtagtttgaattttgatcttttcctgggctagcgatgcacggtctgatcctccctcatgacgcagggagacagcagctcccacagctccccacaagccctgtgatcaaaaaggtgagcgatgacactctacagccaccgcgcgccaggtgctttcaccaaactgtaggtgtgttctgagcacatttagggtcagccagcctaagccacgacgcttggcaggttagggggattaaaagcattttctacttccagtggatttttcgtcacgtaaccccttcgagggtgcagcagcatctgtacctgctcatatgaggcacatgactcaaggcgggggttgtggttggttacctagggtttaatacaactgaggctggccgagagggccaacattaggaagccatttttgaccaacaaatgatttattctacttagaaatgagtcttccacatgccattaacaacaaagagctttttcaggaaacggtaagtcccctccatctctttcttttctcagacaggtgccctgaccatccagagataaataataaacaaaagcaggcctcctgggctcgctttcagccattcatactccaaaccccaaagctttgccctctggaatctcacagcctggaaggggccacaacggtttcctaaagaaagggtcaggaaggggcagaacaaagaagacaaatggaaaggagaaatgaaaatcactacatttgggtcaaccacaggcacacacaaggctcctgttgtccacatgtaaccttaagcttccctgaaggggatgaaccaggccctcggagcctaattaaatgaaccatttcctggccaggcacacaacccatcacctgtgtgcagagaagccagggtctctctaagctcccggctgcttttaattaaggactcgtccctgagagatgaagcacaacatacaaaaccaccttcgagtcaccagaatggaagtcatcttggacttagtgctgagaactgcctgcagccggccagccagccggcaggagaagctgccgcctacagccaggcgatggcctcaggctaaggagcacagggaggctcccctgactcaggcttgccccacacccagcatcctgcatgtctatccagaccacctttcttccccgtgttccacctaagtcatccttcagggtctgattcggccacgcctgcctcttccactgcaacctcccaaagccgcgacggcagaggccgttgccccgcctctactcctgcaccctgtgcaggatgcggtcttgagcctcacaggtttgtgacatgcatgtgtctccccagggcagtgatgagctgtctggacggcctcatgcccggcttgatgctggcaggacttctgaagcgttggtgggatggtgtgggatggtggaaaactagggccacttgggtcaggttctgatcttttgaagcccaagcctgccttggtgggaagcaagttctcagcactcttcagcacctcccttaaaggagggactattcttcggtgagtgggagacagaccgaaacttgacgtggatggcatttcatcttcctgactgccagccctgagttggatgaaggtgtgcacccactgggcgtgggctgccgcctgctgtggagctgccgctgcccctcgtaccctacacaggctcctcctaaagccagacccgcagccttcccagcatgaaggcaagcacggggtagctgctgttctcttcccggacggtcctcagtcctcggtccagctttctcagtccacatttttattaaggattattggccagacgcagtggctcatgcctgtaatcccagcactttgggaggccgaggcaggaggatcacttgaggccaggagttcgagaccagcctgaccaacacggtgaaaccccacctctaataaaaatacaaaaaaaaaaaaaaaaagaaattaggcactgtggcgagcacctgtaatcccagctactcaggagactaagggaggagaatcgcttgaacctgggaggcggagggtgcagtgagccgagatggcgccactacactccagcctgggtgacagagaggactctgtctcaaaaaattaaaaaaaaaaagattatcgtattggcttgtattcttctgtcacctgaaatctttttgggaaaagaccaggtaaaaatacacaaacataactcatatataagttgatttttctccaaagacactgtaatttcacagaggatctctgtcctctcgtttaagtgaaaagatacatagtgaaaccaaatttttgttctcgtcaacattttaatgaaacattattcaagggcctgctgtaggtcataattcccaagaacctatggacaacattaagtgaggacttactgaactatcaaagttatgattggaataacagcaaagatgtttaggtcttaccatttaaaaggcatgtaacacacatcctcattttatcatcacagcaaccctgcagaaggcaggggtgttattatcccacattactgtttacaggtgaaaaaaagaggcacaggtaggttaagcaacttggctatggtcacacagcaggtaattcaatgaaagccatgcgatcccaccctaaggccgtgcggactctagaatgacacctggtgagtaacctagcaggcaaaataattcagctgaaagagtcaccagctggatggtggcagagagaagtacttggcaagattggtttttcacacaaggtcaacgcgaacggaacctctcataccagccacctactagggtacagcatcaagacctaatttcagggagggaaatgggaaatgcatccatttcatcatcactggatactaagggttaggcctggcctcaggctttataaaccacatgtgtgccaaatgtccacgtctaaacctagagtttagggtgaaaactatgaatgggctaccatggaagttacaaaataagaatgcagggggaagcctgagggcgcgcgccacccgaatgcgggaggagccagatggggcagcataggaagggctgttctttaccactgatctggggggctcatgatcgcccagagggacagaccaacagcatcggggtctgtgggttgatattcatctgcacgtcgacactggtggggatgccagggaaatctcacatgttctgtttagcagaaacgagacacctgaggcagaaagtgacaataaggagtcacacggccaggcaaccatgggcaatggcaacgcaggggatactttagaatctgaaagcctgtgaaacaccctcaagtccgagaggatctgctccatgatgaggaactccgtgacctccagggcccacacacggaggtgagccacagtcatcctgccacacctgctcagtctcccgatgagccaggcgaggtgctgagccctgtactcctcgccccaggggtcctgatagccccttgggaggcgaatgacctttgaagccacagcagaggctgaccagctcagagcacggagccactgagtcagagggcggaggtctggcttcctccaacagattctccaaaaatcctcacgatcacaagcttctaaacctccatgacctaccatgattccagtaatacttctgtttcccttcaagtgggagtgtttgtgccatgtttacgtgtctgagtgggggagcgggtgctaaggcagactcaacaagtcgggttgcttcgctgttctcagcacaaaagtcacccaggctgtctggccacaatgtttcacactggattccttccactggagggatgtctcatcaggttttgctgtaatttcactgagtcacccatagaaacgaccaagcaggggagactggaggggacatctccagggggccacatctgagctgagttacagaaagtgaggcagggctggcagttagggcaggtcgcaaagcagcccaaggactaaggtgcagacagagagcatctctgtctgtcaaaggcagacagcgtgggatgccgaatgctgatagctgcacaactctttttttttttttttgtcacccaggctgcagtgcaatggagcgatctcgagtaccgcaacctccgcctcccaggttcaagcaagtctcctgcctcagcctcccgagtagctgggactacaggtgcttgccaccatgcttggctaatttttttattttttagtagagacagggtttcaccatgttggtcaggctggtcttgaactcctggactcaagtgatccgcctgtcttgccctcccgaagtgctgggattacaggcatgagccaccatgcccagctagctgcacaactcttgcgtgtgctaaaaaccattggaccgtacactttaaaagtgtaaatgttatgttatgtgaattatatctccagaaagctgttgttaagaaggtgaatcaagagaggatattttaggcagagagaaccacatggatccaagacatcacaggtagacatccaggaaaccaacagtttcagaatacgagtacgtcatgtgacccagagttaggttggtaaaaagtgaccctgggtgtcaggaaccatgggcagtgttgtctttctcctcactctcagtcgtagctgtttgactcttcactcttactacccagagcttttcctacatcaaaataaaccaaggtactgcagggacttgccactggcctggaagtcagagctggttctgccatgaaacggtgctacatggggcatgggccacagctccctggtctctgcaatggatggttctctgagagaggagcactttgagggctgtgagtacagagggaggagctcagggtgtcaagagtgggagaggaagtctgggcctaccaccttctacctggtttattcaagttctaagattttgcttaaaaaaagggctgtaccaattttccaaatgtttgaaaaccactagatgagataatcggtaaggttcattttagtgttgacatcctacgaagtttcatagttcaagacttgagagttactcaaaagtttgtgtcatccctcctaaaacaaacctttactaagcaaggtactctgaggctcaaaccaactgtggactgcccagctcttcggttcacagccttaggacacagatgcaagcagctgagtgagttattcacaagaaggggaagaaggaaaaggcttggaacccataatcttctcccctgaatgccatgttcaaatttaaactcttagggaatttctatatttgtatacagaatccaaattcccttctcttttctcttccaggagagattccgagcccaccccttgcctgcctccgagacctcaacaccatcctgcttactaaagggagcccagtttttcccgctacccatggcacaggtcttcgtcaatttcagtgtgcccttcatgaatctggcatgtggtcactggcagttaaagggggtgatgatggagaggagaaaccccaggctccaactacaaaaccctgcgggacacgcaggctcctctgggcttcccggcccacattcctggcctatttcaaacatcagggaagcagactgagcgtgccatgccctcctcaagtatttttaacctgtttccaaaaccagacatgttctaaggggggcgacccaggaattcctcatccagggccagtgcctgccaaccgcgagatgttggctttctaacagctctgaggagggagttgttgtctgccttttctggcacgtggggaagtgggatctctctccaattcacttttacgtctcacatttctcatcaaccagagggcaggatctaacttaaagtgagagtcttcagaccatcctcaatggaagctctccaaacactgttctccggcttccaacaacaacaggagtccataaggttccccaaatgaaggacctggatagatcttgtaggaaaaaaaatcctatgaggacaaggccaaggaacgggcctatatgcacttcacttgaattatgcctcctggctctaggtgacaagagccatctttttcaccactggagagctcagcctcctaccaccttgccccgatcctgacctggttcagattcctcgctaacatacttctctcaccttgtagcactgttgcacattgaacaggagggaaaagctcttttgttcattttccttagaatggaaccaaaatgatactccagtagctccatctaaaagctcaagtggcagctaacagcacggacaccaggggcatcccttgccagcttccaatgccatggtgagagacactcatcatggtttaaaaaaagaccagagagcattttcacaagcaattcctaagagacttaaatttcctacacataggcagaataaaaaccaaaaaggaaaaaaaaaaaacttcccccaaacaaaagtgagggctttcaaggagacttgctgagtgggcaaacattttggaaagatggaattttaaacacaaacacaaaagggcaaagatttgcagcagaagagctatgcacacagccgggaggactttaattagggaaagctttgcaaagcccagggagcatcagcatcggcaaatctccccttggtctccggaatggaaagaatgtggaaaccaatgggtgatcaaggagttcgaattttgcctgacactcttgctgggaatgaagcatgcagtcctgtcttttgccaccttttcagcagcctcaggtgagccttttaaaaaggtgaaaaacgaaggaccacctagcctgggagaagccagggtggatcctctccttcctagggtgcttcctgcagatggcacacagccaaagctcttctggtgttttaaggcagaaacagaattcaggggaggactaaacaacccctttagagctacgtgctgtgttttttgtttgcatttttccaagtccaggcatttttccaggtatttccaatgagactgaaatggcctacacataggctgacgacctataataacataagaaagtgatgttggccccctgctccacccagaggggacatctgcttatttggcttccaggtggtgggagcagtggttttccccaaacagctaatacccttcaattctttgctttctgtatcatgaagttcactggagtttggagcacagactctttaaaccagtaatttaactctacttttgaggataccctatgcccccagcagttatgagaagggttgccaaatcttaactcataagggtgacaggatcaggaacaaaggcctggactctccacccttctcctctgccaaaatctacgagttcaggaaaatggcaagccaggagtttactttaggttccctcaagagcagcagctgttcccaccagggctgcgaaggaatcaacaggaactgagagaacacctgaatggtctgattcagaaagtcccagctccctgtgaggtcaataaagaactttgtctcaacagaggcaacaaggccactgcctcctaggaaaggactgatgtgggcttttctagaggcaggcaggctcttggatcaacaggcttacaagggcacatttctcagttacgatcttaaaattgcagggaacctgctgatctctgtcccttacccatctagaaagtctgagtgggagctaacagctgatcctcagcaaaaccagagtgtgcgcccatcacctgctttctggtaagggacccatgtggcctgaatcaaaactcaaagctcactagacaccaattcacacgctctatctaatcaggcagaaacccagctgctcctgctcagtccctgcccagctagtaccttcccaccacccaccagctgtatctcaggctctgcccactctaagctttccctgggatttgcctgccaagggtgggccacggtgtcctctgtggtgctctgcagtgcccatgttcctcacatcagaagccttgcattctggctgggagcggtggctcacctctgtaatcccagcactttggaaggccgaggcgggtagatcacctgaggtcaggagttcgagaccagcatggccaacatggtgaaactccatctctactaaaaatacaaaaaattagctgggggtggtggcaggcacctgtaatcccagctacttgggaggctgaggcaggagaattgcttgaaccagggaggcagaggttgcagtgagccaagattgtgccatcacactccagcctgggcaacaagaacaaaactccatctctaaaacaaaacaaaaaaaaagaagccttgcattctatccatcctgggttatctggctcccaccgtggctatgagctctttaaagacacaactattctgttgtcactctgaccctggtgcttcagcttaggcagggccttgcattcatgggggctcaagtaggcatgcactcactgaatgtccgcttcaggcttgacagtggggatacaaaggtgaacaaaagaaaagatccctgccctccaagagccaaagctcctaggatggagcaagtccaagagacaggagaagcaaggggcatgctggggggcagggtgagggaagtgaggctccagcggagatgggaagatgagcagttagagggagcagagttggtgtggacatgtgtcccagtcaaggaaacggcatgtacaaagatgcaacaagacagggcacaggcctgggagtgtgcaagacaaggagacaggaggaaggggcagggccagatcaagagctcttccacctagatgtgttctccgggcttgatcccgacaatgtggagtcattaagggacattatccgaagtgcattttggcaagactactctgtatgcagagcaggcaggggatgacaggcaggaaggcctgtctacaggctattataacactccagtaatgcagggaggagcagtagcaataaacattcattgaactgctctaaaatgaggattgggacataccttcacccaacaggctggataaggtggatggcactctgtaaaaaagtgaccccgctttgggcaggtggaactacatctccactggccttcagcagcctgagctgcacccagtgccccttctgcctgcctccctcctggactccagccgcagttcctccctgtcacatgccctacttaacgcctgcagcatcaagactcaagaggttgaagtacaagaggtaacagtagtaggccgggcacggtggcatcacttgaggtcgggagtttgagactagcctggccaacatggtgaaatctcgtctctactaaatatacaaaaattagctggctatagtggtacacacctgtagtcccagctactcgggaggctgaagcaggagaatcgcttgaattgggcaggcagaagttgcagtgagccaagatcgtacaactgcactccagcctgggagacagactgagactccatctcaaaaaaaaaaaaaaaaaaaaaaaaaatatggctgggcgcagtggctcatgcctgtaatctcagcactttgggaggccgaggcaggcagatcacttgaggtcaggagtttgaaaccagcctggccaaattggtaaaaccgcatctctactaaaaatacaaaacttagccaggcacggtggtacaggccagtagttccagctattccagacgctgaggctggagaatcacttgaactcgggaggtggaggctgcagtgagacgagatcacgccactgtactccagcctgggtgacagagcaaaactccatgttaaaaaaaaaaaaaaaaaaaaagaggtaatgggaaaaatgctcgcttgtcattgcaagatctgagctcacctcacagtccctctcccacctggaagaaggcaggacatttcagagcccgatcaagcagcattcacccacctatctggccaaacagggaaacgcaggctgcttttgacaaggggcacgcaccctcctccttaaaaggacagctcagcaatcatgggaaagcagtggattccagccgctcctgtcagggattccaccaccttctttggatgatttgcaccaagtattttccctacatgacttcctttaatattcacaattgtcctcttttagagtgaggcaaatccagaattctctccattacacagatgaggaaactgaggcctggagtctggtagcttaccgagggtcacctagatattcaggatgcatgctcccagccccagctaactcatgactccgtgaccttaaagactctgtccatatactgccacctgccgggaccaccagcccttgagtcccaggggctgaggtctcctgagtcatagctcagctccaagaggcatccgtcccttctcatctctgggtctcagatcacacagcctagaatgtctaatgtggactcccctcagaatttggggatagcagggtttttggttcattatctcatatttatttgtggccatatcgacatgtggccaggcactgtgttagggtctggggatagaggtgagcatcatggcatcccgcaggtgctcggaagccagagggccctccagtgctaagagtacagttacagcacacagcagtgctttcagtgcgttagataaaacgtggagatttggctgcccctacaggcagcgtttgggactaggaaggtcaatgagacaggaaaacaatgcgggcgaagaagtattaagcctctttaaaacacctgatgtacatatctcctctactcccaactgatgttcaacacatagctagaaagaggcaaaaaaaaaaaaaaaaaaaaaaaatccccttgtatgaaggataatcctttcagcctggggcaaatctcctgaagagttttgttctgaactaggagtgttgttttagcttccagtcaatagtaattaagagtcccaatatattccagaaagagggagagggagattaacgatcattaaatctcttctgcatttggctccaaatctcttttcggaggggccggctgtcagatgatccctccaaagcgtccatctgacagcactcccgccgccaccatctggaacatcaattcgagagctcgcctgaaggtttcaattacataaaaggcaatgggcccattaggacccgagagtctggagcttcacaagcgctgctcacaccccctctcctgtacacaaagcctctagaatttggttggcagtcatttgcaaagggactcattttggtgggggcatggggctggccagccccttggcaaggcctctctcaggcaggctctgtgcgtgctatgactgacagggtctctaatgaaccttaattgtgagctcgacaggcccaggaaggcagccacagatgtggcaaagggcaaccgcaaaccgtctgattagtgaataagaagtgtccggcccagtgagggccaatgacccaaaaaaggaggagggcgggactattcctcccccacgcatcccttctaaagctctgaagcttctttatgtaagcaatgcaaagcctctgggtgcactggaacccaacgcacccctccccccggcactactgcttggcagctggcagctgggatgttggggtcttgtgcttgttaccacggatgcttccgtctccatcagcagtgcacctttaaccacaggaggccagaacagaacgccctttcaacgtgggaagggggaagctacccactacggagactgagtaacttcttgccggtgctaagaattgtgaagacagctgcattcagagtcagccatcctctggtgacctgcagtgacaaggagaaagctactcctggggcagctttgggcacaaacagcgtgacggagaagacaggctttgcagacgggtagatcccaactctgctccttactaattagctgtgaggcttggaccaactcatgaaacctcacttggtttcctcatctgtaaaatgggcataaaagatcaaccttgtggtgtgcagtttaaataagcaaagggtctggaacagtacctggcacacgatagtcatctcttaaaacccgggagaacagcagagtattttgcgcaagtttgacatgacctcagaactccatgcagacagctactacaagccaggtactatgctagaagctttacaccccccatctctcattcttgaagttagtgtcatgcccatctcacagatgaggaaactgaggctcagtggtcacacagctaagacgtggtaaagacaagagctgaacaggattgtgcctttcgatttcaaggcactccactatcaacttcaatgctcctaaccaagcatttcaggcatcctcagactaacagcctagaaacacctaaccaagaattttgtagaatttgaattcccaaatacaccaaaacaggcttctctggcctggcatataaaggtgtggtagggggcactaaatggccaatctgtttccaaggaagtctgcaaaacaaatgaggactccacttccagccttggtctgcttcttggctagtggcacctcacaagcattttctgcatcagggtcatgaataggtagcagcaggtgagctgctaaaatagcctccccaccagaaagcagtcccaggagaggcccagagatacagaacagaggcccatcactgggaggttgtgtaggaccctcacacatagactggggggctctcaagctggggaaaagggtacctggggggagactagagatgtaggttcaagaaggggacaagagattcagaggaaagaggagcaagaggtgagcagtgctgataaggaagagggtaaatggcaaggaagctgggaaaccgacagaaaggatcctgaggacccaggtttcacaggtgacctggcacctctggaaggctgaggattgaggggtctgatgacctgggaggctgcaaggctggcttgtccttggacactgagatcaacctaagactccttcctgccgccttagaccatccagccacgctcttgtctagctttctctcccagggcttccgaagactttcccaatgataaccggggtcagctcctcattcagggagcagaagcaggaagaaaagtgcctagcaagcaatcaggaagaggagggggagagaccctcaccagggcggactgtgcagctggtgtcagatgacccttatctctgcagaatggaaaccagccagccaaagtctggaggctcaccttctgacctccatgactcgcctttgggtggggggccgtggcattttcagcttcccattcagggatccttaccttgacaagttctcatgactatctacaaggcctcaatggagggcctcttaatctccttcctcagttaaataagccaagtccttgcaaacgtgcactgggttataaaatgccccactgtgggagccaaggctgggacttggttcacctgtgaaaactcagcccaaaaggctgcccagggcatcagggcacagcctctaggctggtggaacccaggagtgagccaatcggccctaggaagccaacaaaggcagtaaaggcaacagccagcatcaattaagtgcctgtcttccactcacatctgcagtttacacgcaccccaaatcctcacaaccgtctcatgaattcggctttcggaaactgtgggagatgaagtgccttgtccaaggtctcaaagctggaaggtgaccaggccaggattcaagtcctagtgagccttctcttctggctctagtgagccacccagggacaaagactgtgggctggagtatctgctggaggcccctgccggctctgttctctccacctatttaccagatggggcagctcataggcctgagagaaactgaggtctcttctgccagcaaaaggggagcctgaaagtggtgacatcaacagaagggtatccatggtgatgttcttttagttctaggcaacagacctccagttctgagagactgagagaccatcaggcctgcacttcgcagagtgggggcccgagacccaaagacctgcaattcccaaagcaaattagtggcagactcaaagccacagcccaggtctcctgacttccagtaagatttgccaaggcaccttcttaatggacatagtgcttccttttcatctacctttgtccctcctattgaagcagcaggaagtttcctgaagcagttctctatttgcacaaatagataaataattccaaaaaagctatgtttccttctaccccattttaccaaacacttatgaaaataaaaggtttggctaatatcacacttagggccattgtcaaaaaagggtgtagaatccaggccacttagtgtgtaggttatgatccttcccaggaaaacaatgtttcccaaagcacattccttgaacgtgagttgggataacaggttcagttctttttttattaactgtgggacttctcagagcctttaatatgccaacatgggtgatgatgctcttaatggataatggagtctgattatccagactctggatttctcccagtcaatcgctgccctttatccctcaagagactcaatgccaaggtgaggggatccacttcattagaaagtcacgaaatgtgcaggtcacagtccaacaagaaacgaatccacccaccaagcagaaggaacagtcatccatgaaggaggcttttccagccatcccatctcggtttattttgcacttctaactactagtgaggaccaaagtttcacatattaggcgtttgtgtttcttcctctgtgaattgcctatgtagccagctctttcttctaacaaagtattcctacttctcctattgatggaggcaatgccatgtggtagttaagagccccggagtcaggttgtctgggttcaaagcttagctccaccatcatacttggtgaccctggataaactgctggaggccctgcttcttcatctgtccaatggggacaactctaatagcctcagcaggtgttctcagatttaaagagagaagcgttttgccaaaaggtacaaatgcttttcagagtgtgttccttgctttttaattttgtgtaaacttctaagttaaatttgcatgcagtcaaagctatcatttcggcactggcttatgcaccttctaaaggcctcttccatctcaagatcaaatactgatgtttgctctctgggtctttcatgttcgtttaatagttaattcttcagtccatgagaaatacgcaatatgactacatgctgttgcaatagagttttagtgtgttttccttcaaaagtattagctgtttcaacacatttattgaacaattatttttctcccaaataggaataccacttgtgattgttctaagttcttccattactgagtctgtttctgagaattctgactgatttgcttccgccactcagcctggagctctgcagctgtcttcacgcactgcctgcttgcctcttaggtgactgcctttaaattaaatgtaccaaaatcagcctgtgctccagcataaatcagttagaacagataggatgccaggggagatggagggacaagagcccatttgtaacagcaaaaggagatgccacctagaaataagctcccttactgaaccatcccgttggttcttgcagtgcactgctttttccaaaatttttacatttgttttaactgaaagtatagtgatatactacttgtgtctgggcaggatgctttcaaaatagcactttccccccaaacacacacaatgcaaagtgtgtatgggtggggggtggtggggggctgcaataggaagctttgcctctgccccactgttccaactgagcccgggttccccacagcccagccggttgaagggagcggcggctcctctgctggtcaagctctggaggaacatcgcctgcccagagctccacaccagcagtggcaggaagagaagttcaagtccttttcccttaggtacttccatggtgaccattcttcccaggccctcattataaatttcctttacattttcacttttaaaagattatttagctttggcaggacatttaagaaatggcatactataatattttcatttgtaaggctgtaattcagtggaaaatactgactggaatcaagaggtgggcttgacacctcttccccgcaaccccacagcacgcatcacctatcaggtcagagactcactgccctcctccattcctcagtttcctcccactcacttcacagaatggctatgaagacagataaggtcctggatgaagcgtattaataatgagacccatctgtcagtacttgctgacatctgatggagatccattaaaagttacttattttggccaggcacagtggctcacacctataatcccagaactttgggaggccaaggtggaaggactgcttgagtgtggaaggactgcttgagttcagaagtttgagaccaacctgggcaacatggtgagacccccatctctattttctatgtttaatttaaaaagatgaaaaaaatttttttccatgtaattgaaaagtattttatagggaatgaaagagggaagagtcaaattgttaatctgagaccaaacaaaaaatactttctgttttgaaatttgtattctctgaaaaataaccaaagcttactgcgtggctatcttaaagatgatgggagagcatcaattttcaaaatagttggctttggagaaattcaagccccttcccctaatggaaaatcaaccattactgttctaggacagctcaggactggtggatacatcgttgcagtctcctggaatcagtctttgctccccaaggaacacacacacaaaataaagccaatggccctactaatctctttggttcatttcctttctcttgcactcctctctttcattcattccaccgtaattgtctggattgcctttacagaaggcaattaatcgcattcttaattggataaaatgaggaaccattacgctgcatgtaacagaactcatcagaatctgaaatcacttctggccaaatctatgagggagctggtcaggtaagagcaccccaggaagccccacttcctctttctaagcaaatcatgccatttcttcctggtgaagggctgcctggctgccacctggacacaaatcagaggctgcactactaggtggcaggtcctcaggttgataacaggccggggtcatgaagggccgccatcctccggagaggccaggatgggcaggaaacgccagcttggcacccaccgtccagagcatgcctcctgctctccctgcctcagtccccacagctgccgcccattcacagagcaaaaggctcacgtgaaaagactcaccacaattttccaaggaatggagtttattaaaatactgctggaggcttttggctggaatgttttttctccttgtaaaacgggaactatagcagtgttgtctataggaaagctcagaatacgctcagaaacatcagtcacaacagagactatgtaggggctggtgcatattaccagtgattccatccattccgcggctcctgctccagagataacattcggctcagaggagaaaacttccaggcagaccctaggatgggtaggagagaggaagccaagtttccccacccttaacataaacccacggggaactctggtggaaaaagcatttttttaatgttaaaatgtcttgcatgtgggcatgttatggattggaatacaatttattttttaatttttttcttacgagatggggtctagttatgttgcccaggctggtcttaaactctgggttcaagcgatccttccacctcagcctcccaagtagttgtaacttcagatgaatgccacatttccagagagaaaacaatttttaaataagacaaaacatacaatgctctccttgaggcaggcacctgtggattttcccctaaaaccccagaaatgtgtatttgctcttctttcttcctctattgacatgagtactttggggaaagaatgagaagcgccaaggcacaagtcactgagaaaccggttaaaaggtggcgagcaatggcttgcagaagtggacaaacatttactgatagctgggcacgaccattaaagagcctctaacacctttatgagtaagtaaaaacaaataagcacagctgccagttatcctgttcaacagatgtacagcgtgcaaagctgaccacagccaggtcctccttccagaaattaattccccataaaatgtcagctccatagagcgaggcttttcatctggttctccacgaaaaccccggcacctagaatagtgtctggtgcatggatggtgcatttaataaatgtttgcagaaagaataactcagttctgcagctcttgctactcatcctcagagcttattcactggtcaatgaccaatggcctgagagaatccaactagggtcattcttttcggggatcaagctgaagaatccttgcattttgacccgtggaggagaaggcaaggaataaaggctgcacttcttcccagaattaaacacagtgcctgacttccaggaggtgctcaataaatgtcgactgaatccattaccttttcacttacttcagctgagacccttttagaaaggcaaaaacttaaaaacaaaacagggtctcattctctcacccaaactggagtgtagtggggtgatcatagctcactgcagctttgacctcctgggctcaagtgatcctcccaccccagcttcctgggtaactgggaccacaggcgcatgccaccatgcccaaaacattttttaatttttagtagagatggagtctccctatgttgcccaggctggtctcaaactcctgagctcaagcaattctcccaccttggcctcccaaagtgctgggattataagtgtgagccaccaggcccagcttaagtgaagacattttaaatgttgtctttgaaataaaggacgaaaaatgctggtctgagattgtttgaatgacaaggctaaaggggaagctagggaagaagaaaatgtaagcctgcttactctattaacacagataaagcagatcctatctggccttcaagatccccaaaggcaggggtagtcgtcttgggtcccaggcccagtgcagcttcatcacctgggggacaaaactgagttttgcttcactccacacagctgtccctggaaaaatgatttccagatttcattgctttgactattaaagactgaaaactgagcagcactgcttagcagacatcagatattctgctaatcaatcgtattaatgaactattgactaatagtatcatccttaacgtcaccagtcaattacaaatgtgtgtgagctggctccatgggctgcttcacggagagcaggtttttggaaacgtaagcagcgggtgtccactcactcgttcactaaggctcgaatgtggacacgtcccccaagcactcagccttctcatctgtcaaatcacactccctgcagacatcatgctgccccgatgggggtggcgatgcgggggtgacagggataatttcaaagcatggctaccgctgaggctggcagtgtgaatacctgtgcccagctggctctatttctagagggctgctctggctacttaaaaagaagaatatgctgaaaacagttaacctatgaagttatcaactccccggtaaaaaatcaggatgtctcttccacctttacctcactggcctggatactttcccagccctgatgtcttccccttgatagagtaaagtctggggacacccaagagctgagccttaggacaactgtaagaaagaaagaagtgaaggaactaaaaacatgaagtgaccaatgtttgcaagcagagactttcttgcctagttaaacagattcacggctatttttggtttgctcttaaaaaggcaaaggatggaaggcctgctgggtgccaatatgcagaaacaaactccttcctcagctcagggctcaaaatacaccccagctgagacatttctgctcttgctgccagtgtgcagagtaaggccatagaagggccaagtttatgaagccaagggaacatcttcacatcatatgattcttggccctcatggatgtgtgggtatttttgaaacagcttaacaacggatttcagctggattcactctagcacaatgggattaatatgtaataaaatgatgttttggccatctgcaaaggaaggtcatttcccaccaatcagagcaggcctcataatcccaaggcagcaaaaactctctgatgctgggaagaaaaaagaaagctgacctggcatgataaattgggctgccttggcctggctgccaagcatccctcacatttctcttcaataccactctgtaatcagaccatggtggactggatccattcccccacagttccctggccctgacatcttaagcgaggccattcccttcatggggaatgctggcaaatcctaacattctcgtccatcttaaaactggagacttttcttgaaaacaacaatctcccccccttcattatcttgggcaggtgagcagggaggaatgactgctgtttgcatggagcagcagtgcattagctactttcaaaacatctgactgatcccagattacacgagacaaaggcctggatcctttgcctttagacaggtgcataatagtgtgaattttctgaaactaccgctttgggaagaaactaaaactgcatgtgaacttcaatgctacaacagtatactcagcacagaccaatccttacagaataaaagcatttcgtaagttcagttaaacaggaaaaaagaaaaactgtcattcccagagaacactggcagtgatgaaaataaaacattcaaagaagaaacctccaggatcagtcacaggatccagtacaaagccagcgcactgccccttatatgagcatcgcacgtagcgaggagttcaaagccaggccatcaatcagaaagtggcttctgaagcatgtcaatatagttttttttcagtagagatgggttttcgccatgttggccaggctggtctcgaactcctggcctcaagttatccacctgccttggcctcccaaagtgctgggattacaggcatgggccgccgcgcctggccaatgcatgtcaatatagttttaatgaggcatgcattaccagatcctaatttgttgaaaagtcatgctccatttccattttgacattcctcatacttcaattaaaaaattaatgagaacaccgtttccccaacccactctggacgatgggaatccactctggcctcttgttcagcctctgaggtagacaaggccccaggtggcctccacacagccggtgaagggagctggtgcctctcaggccgtcccgaggcagtggaggaaagagaaccactaatcataaatggcctggttccgagaagggtttttttgccccgtgtctagttcttgcttttaaattatgtgaatttaacattattctccataatatacctatgtgttaacattttagattactaatgaatttaattaacagtttctctcccaacaggcaaaactgacacagcacatagacacaccacatttactctgttgctttcagtgtgactaacccaaaggaacctggcaagcaggagaaaccagacctcccggcgctcccaagccacatccctatcctggcttcttccccatagagtctaaatcatctaaaggaggtgaggtggccatatgtaccttacaggggtgttgtatgactttgaagaaacaataaacaacacaaacagaagtccccagcttagtcctgggcacacggcaggtattcaacacgtcagctgtccacctcaacctcagcccacctccaccagctctagcatacattctacagaagacaaagttaaaaacagaaaagtaggattgcctgaggtcagcagttcgagaccagcctgggcaacatagggagaaccagtctctatgcaaaataaaacattttaaaaaattggccagatgtggtggtgggcgcctgttgtcttagctacttgcaaggctgaggcagaagatcatttgagcccaggagtttaggaggctgcattgagctttgattgcaccactacactctagcctgggtgacagagcaagaccctgtctcaaaaaaaaaaaaaaaaaaaaaaaaaaaagtatgctctgacagtaatctatagaatgtcacacagtacaccatatatcagtggtagatacggcctggcacttcaacctgtgtccaagtaccatcctgcaactaagcctcagaggtgatctctctcattatctggctatggcgaaagacagctcttgatactctccttcattcaccatcaatgctgcaatttccctgttgagcccagggaaaacccgcacgggcagcaagggagccagttgaccaggttttcataaaagcagctacatgcacatccctgaaagagagagtgatgagggagtcccggagaaaagacacagctgtagtaaaacacttcagttgccataagaacaaaatagcctattaaacaccaggaagggtccaatgagaaaaatttgctcatcatttcctacttctatgtttggcttatttctaaaatacagtaataactaaattggcaaactaaatttaaactcagccaagcatgctttcatgctgagtttagaggaaaaacaagcccctgcagctgaccaaattaaaggcagatcacaccttcaacttttgcccacctcttccacgtaggatcaatcatagatttctgaccaagaaaaatgcaaagccattaaagcacttcccagaccacattctgtagtcctacctcataggactgatgagagtttaaatatggctgcgcatgaggcactgcatacaagttcagccgtcagtgggctgatggtgaccattctcaccacatcaagtccaaggtctcctcactttcaaggatacctcctacctatccaactttatacttcagtatttctcaacaaaggacatctcctctaacccctccagcccacactgcccgaccgcccccagctcacatttcacatgctcaggcccaggttctacacaaaactggacccggccaatctaacgtgcagcccaatgtttaaaaatcaggatattctgctgggcactgtggctcacgcctgtaatcccagcactttgggaggccgagacaggcagatcacttgaggtcaagagtttgagacaagcttgaccaacatggtgaaatcccatctctaatgaaaacacaaaattagctgggcacggtcgtgggcgcctgtaatcccagctactggggaggctgaggcaggaggattgcttgaaccggggaggcggagattgcagagaaccaagatcaccccactgcactacagcccgggtgacagaatgagactctgtcaccaaaaaaaaaaaaaaaaaaaaaaaaaaaaaccaccacacacaaacaaaccaggaaattttacataaaaccccaaatatatggctcctctagaaaaatgtgaaaatgagcaacagaggcttccaacagggcaacaagcaccaggagtaacgagggcagctgctcttcccacaggggcctgtgcctccagatcccaccatgcccacttcaatgatcttcctcactcgctggctcctggccggggacccctgatcctgagcacacagtgggttcatttgcatcacaactatgttactacccccctgaaatgtcgactgtctggcaggaccctctctttttgatacctgccttctctccgcttacatcacaagcatgtgcagttgtctctctgagcagccagtgacctcaagaaacctctttcttcccacttcctgaattactatgaatgagatacagcaggttcccaactccctccacaggctccgctctgtgtcacacacttgcctctcagctgggagtttgcatccctataaatatacaaatagtcgcactacagacctttcgggctgctgtataaagttttctgtgaatgacatccgtgcctctcctagcagtcatatatttttcctagtaaaaatgttctgaatgcatacaatggaattaaataaatcactacagcatatgaacaagttcccaacccactctaaaaagatacctcactgatgagccatgcttggcaatggataattacatccaagaagacacaggacacagtggaaaaaacagaggaccagactcagggactcacgttccaaacccagcaccagaactcactgccaagtgatcagggtgattcggctggcctcttaggacctgattttatttctttccaatatttcctatggctttatagatgtttttgaatattttgagcactcttcaaataatatggtgctagtgaatttgaggcaacatcttgagaccaatcattctgagcataaaaatctatgaaaatgaatagaatatttaaaaactagatgtgacgggccctttaacaagccaacttttgcttgttataccttttcaaactagaaatgaagccacggaagcatcttacaggtagacgcttgtactgtgttggctggagaaactcacaccatagcagagactgacagcgtctggcctgcgtgcactgctgaatgcctgcgggatgggtatggcctcttcctcaccacgtctaaatgcaagcttctagaaactgaagacaaggcagctggggagggagcagactgtcattaactttagaactcctaacttgggcttcaacaacacagatggttctgaatgacagaccaccatatgaaatccatcttctctctgcctggaggaatctcatagtccagtggcatggtctgccagggagagaaaaggtttcctgtgttgtgaattctgcatggaaaaagctacacaaaagcaactaactcttagccgcagtctcaaatggaaccatatgaaggaggcacgtaccaggtcgatcaggtcgctgaggtttttctcgatttgctggggaggcaggcgcctcattaggtccaaggcacagtccagctgctgatcactctgtggagggagaaatacaagtgcgtcagtcatttttgccagaaggaatatcaaaaactccttttaaaaagcatgcttgcccaaggcattctaaaacccaaagagccacgcagtgggccctccgccaggtctctgtgtgccagcagcctggagcggggggcgactgtgcaggctgtttgctcccctttgacagcagtctctgtctcaagtgggggcatccaaaagaccctgaaagaagtggaagcaggctggagacgtcagaaagctccctcaccggctcccctgctcctgctcaacaggccctggtggctgcagatgtcgtgccccccagttggttccatggtgaacacactccagtagcggattacttttgccctttgttgtaacctgggtgtaaacatcaggtaacatccccaggccaggttccttgagaagctccaagggagggagaaaagccaggcaaagaacaagtggcaagatgcacacggggttaaaagtgcttcattcattcaatagaaacttaggacactaagacctgaaccacactacagtcaagagctcactccacccagcaaactggactgcaaatgcagtaaactatgtcactgcagaggcaaggactggaaagacaaccattactcttgtttatcaagcactcttttaaaaaatgtttttcattttttaaagatagggtcttgctgtgtcacccaggctggagtgtagtggcatgatcttggctccctacaacccccactttccaggctcaagtgatcctcccacctcagcctccaaagtagctgggaccacaggtgcatgccaccacacctggctaattttgtagttttttttgggggggagggggggaacatggggttttgccatattgcccagggtggtcttgaactcctgggctcaagcagtcgaactgccttggcctcccaaagtgccgggattacaagcatgagccatcgtgcccagcccaagcacctttttaaagctatgcatcctgtgcttcaccatactctcctcacagtacatatgctgcaaatatttactcagagccaccatgtgccagtcaccataaacatataaaaaataaataaataaagggagggggagaggaagggaacagagcggaggcaaggctggtaaaatgcaaagtaaattcaatgcacagtgggttctaacacagaaggctagacctcaggagatgagacaagaaataaagtgagaaaggtgggccaggtacaagggtgaagacctgtgtatgcaactcttagaagtacaggtgactccaagtaaggcagatggagtccccaacactacccaagcagccactatctgatttgtatctggaatctgctctgctcagaccaatttcaggatttttggaaggcctaaatcaacaagctacagtctcataaaatacacaaagtaatcctcaaaatgccacatttggccttaacgaaatataacttttgaatattaccgtttacactccaggtctgttaaccacaagtaggccgtggggcaaggacccacttcatagtcaccagagacataacacattattaaggagagtcaatttcatttttttaaaaaaagatattgacatggcatatacagccagctgttttaaaaaagaatgaaagaaaagaaaaagcctgtcccttgctcaagatggctatcagtgacagttcatcctggaacacacaacgaactggctcccctgcaaagagaaaagaaaaacaccacaccagaaattctaccacttgttttgctgaatgccagcaaccatgaattccctacttgtgccacgcatttctatgccaacatgtgtcagccaaggccacagtgatgggtttggcccactggcatgagaggaaattttaacaccacgtcttgggcagaacacacagataagctgattcgactctagagagacatattcaattcccaatactgccattcattaacttatggccttgggtgggtttcttaatctctagaagtctctatttatttatccataaaatgggaacacagtatcttccttagagagtgacaataatttagtaatgcatgtggaacatttaatacacagtagtatgtgtttaatgattggggatattgagtgcatacaaataaacatacagcttttaaatctttttaaaaattttaaatgattcccctgcccaacctccccgcccctcaacccagccctggatctctctctctctctcttgctccccttaaactagagctaatgttcaaactcaatacaaagctacgtattctcttggccaagcaagaatagaaaaccctaaatgattcaagtcaaactcgttaaaaggtataaactagtatttctcaactagggatgattttgcacacgtgcacacacatacacacacacctccaacaaccctgccaggagacatctggcaatgtatggagacatttttgtcacaactgggagagaagaaactactgacatctaatgggtaggggccagggatgcttctaaacatcccaaaacgcgatacacagcctccccacaacaaagaatcacccggcccaaacgttaatagagttaaggctgagaagccctgggcgaaaaataattggtttgggggctgcagattcccagaatctgattgacaataaagtccccctcaggaagactgcacatgcaggcaaacgttttatatataattctaatttaaagaccacacatacactttgggaggccaaggcgggcggatcatgaggtcaggagattgagaccatcctggctaacgtggtgaatccccgtctctactaaaaatacaaaaaaattagccgggcgtggtggcgggcgcctgtagttccagcaactcgggaggctgaggcaggagaatggcatgaacccgggaggcagagcttgcagtgagcccagatcactccagcctgggcgacagagcgagactccatctcaaaaacaacaacaacaacaacaacaacaacaacaaacccacacataacccctaaaaatttctggtcttcagaaagtatctcaactagatattagcaatcctccttataaatgaaaagcaaattaagatataagtaagcctgtctaatttgaaacggtgatccagacagaacacagaagggattaactagaaaactgagcagtgttatctaggaaaagacctaagttgaccagagaagctcaaggtgaaagacactgttttaacccttcttcggtgcctgttcacaagcccagttccaatatgctgatcacatccccaccccgcaaggggccggacagtcctctgtagacctgtatctagttgacagcactagaatactactacaaaaggatctgactcatattttgcattaatcccaattaatcttaattggaaatgtttcactacaaatttctaaggttaaggatgtttaactatcattcaatgaggaaatgactaaatgcttcccataagtgaagcaacatgggaaagcttaatgacagcttttaagacgttaaaattagagttaactggagccatttgcttgggagtcatcccaaaccctaaggggtccaaacaggaaacggtaccggagaatgaagcagatgtggatgaccttcagctacaagcaacaacgtaagtgacccaggaaatggaacgatggggacagagggagggggctagtcccaggggcctccctaggatgctgtcacttttatataaagctcaataacaagcaatagtgaacattctttttttttttttttttttttttttaaagataggctctcactctgtcgcccaggctggactgtagtggcacaagctcagctcactgcaacctctgtctcctgggctcaagctatcctcccatctcagcctcctaagtagcttggattacaggcacacaccaccatgcctggttaatttttgtttttcttgagacagggtctcactttgttacccaggctggagtatagtagcacaatgtcggctcactgtagcctccacctcccaggctcaagccatcctcccacctcagccctccaagtagctggggggccaccatgcctggctaattttttgtagtttggtagagatggggtttcaccatgctgcccaggatggtctcaaacgcttgacctcaagcgatccgcccacctcggcctcccaaagtgctgggattacaggcatgagccaccatgcccagccaatttttctattttttgtagagatggggttttgctatgttgcccaggctggtctcaaagtcctgagctcaagcgatccatctgcctcagcctcccaaagtgctgggtttgcaggcgtgagccactgcacctggccatgaacactcttattatttagacacgtgttttagactaatataacaaggcttttttttttctttaagccaagacaaaggtatgataaatacaacatttaagaagagtagaagagcagttctagggaagccatgaggggaagatgaaagctatactgtctaggtctcacatggaatggcaggttcaagggtattcatcatcaacgtgatgcttaagttatgattatcagatatctaaactttttttaaaggtaatagaaaaaactacaagtatgcagggagtggtggtgcgtgcctgtagttccggctactcgggaagctgaggcaggaggatcgttcaagcccaggagttctgggttgtagtgtgctatgcccatcaggtgtccgcactaagtttggcatcaatatggtgacttcctgggagcagggaaccaccaggttgcctaaggaggggtgaaccggcccaggacagaaacggagcaggtcaaaaaatacaaggaagagcaagtaaagagagggcttaggactcaggagtccagggtccaaggtatgccctgtcactagacgtctgtgtgctttggactgctcacttaacctcgtggcctgggatttggcccagatgaactctaagactccttctagatggagtgccctctatcctactgcgagagcagacatgcctaaccgccacacccttcaaaacaagaccatcatcctggatttggccgcttgcaggccagcaactgggctacagttcaacaactgtgcactgagtgccaaccctgggccaggccctgaatccggcccaacaaatgagacccagtcccaagcctcaaggaaccaattgtccataaaacagcaaataaccacaaggtcgtgtggtgtgtacaatgatgagacagagaaggtacaaagagacaaggcacagttcacaatacactgatttgtacttctttgtgtcaattattttcctaggacttccctccctcacatggctacaaaataaacagaaggccagtcaggggaagtaaactgtcacctggtggctaagagctctccacaggccagctccttcaaaactctgactggtccaggcacctccttcatacaatgagcttcaccagttccaccacccaatggtgtgttccaggtggaaaggtaaatagtaaaagaaggaccatttctccttatcctctggaattctctgtccattcaattaatcatctgatcattatgtgagtgtttcctaggtaacaagcactgtttctgatgctgagtggtgaacataaaagtctctgctcctcatggagcttatggtgcagtcaaaatcagtgtggaaaaaaaaaatcaaggaagagtccttgttaggatgtcaaataataaggaggggagttaccccattttaagctggcaaggctccaaggggtaggtttagggggttttttgtgttattttcttattttggtatataaactgagataagaaatatttcacctcctgttttcacatgatttaaagaaaaagcataaaattgcttaaatcaccctgcaataaataaaaccaccattaatacggactaaaacaatttttcagaataagaaatcagtcaaataaaaccccaccatctaaatatctgctacagtgttcagacatccgacggtattatgaaatcatctgcatacaggaaaacttggcctactaggcaaactccagggcaaagtctgatttggaaaccatcaagtgagatgtaaccagtacctacactccaagtttggtagagtaaacacaccatctacaacaatgtcaatgtcagagtacaggtgcccactaagtagggcagggagccccagaagatgtctcagaatggggccacaggagcaggttagccctggataagcaggtgtgcctttccaggcagcaggtgcagcaggctaaggagaggtgagccaggtgcgtggaggaggaggtggggaaccatggggcatggcctggggaggtgactggggccttgtcacaagagccagatcacacccaaactactcagggggcagctatgctggcccgaggagctaggctcagaatctcacttctccccgcagttttttgctcctgtccagtttataggtaaggcatctgtgccacattctttaaaatccacttttctgtgaaggttttggagcccctagagatttttccacaggggaatgacgactgctgttgtgacttagaaggcgaagcagattatattttccaaaaatgaccataacaagcagtcccatcccacatgctcctcttgcagcgtgactgtgacactcctcccacttgtggtggggcgggggggggctgtgtcccctccgccttggaaccggaggagcttttgtaactttttatcatcagagcccagcacaaatgatgccctatgacttgtgagcccacaagagacaacgcggcttctccctgcctgctaaacacacaggcctggagcccactcaactgccccgaggccaccctgtgcagaagacttcctgagactccatggacagagggaggcccactgagcccccaggtgctccaggctcccactgttccagcttcagctatctgactgcaatagtatgagaccccaagccagaaccacccagccaaggccctcctgaactcctgacccacagaaaccatcagagacaatgaaatgaattgttcctttaagtcactaggtttcgggatggttttgttagacagcaacagtaaatgacacagaaggatttgtctggtgaccttggggagacagcctgaccagagacgaaactggggacagaagagctagcagaggagcctctacagcaaccaggtctctggctggatggccagagaggaggagagccaaagactttaaggtcacaacagataggacgaggtcagttactggaaatgggaagaagcccaaggagcctgagatgactacgtttcctagctggggccaactgctagaggatggtgccacagcctcaccggagtgtgtacgttttgtgtgtgcttttaaaacccactgtttttaatttcaaagacaggcacaggcagtaactcaaattgctaatgcttgcaagcagaggtcctgcttggcctgctgtagtggctggttaaggcagatttgtgcttaacagcatctgtctgtacataaacaaccaaccaaagcttcaaggccttcagagtttgttcttaagttcatcaagaccttcactcgtttacattcccgagaggcttagcaaataacttcatagacagcacaaaggtaaactctgctggcgcccagaatgacttaccacaaatttatggagtctcacttaaccatggtttgtcttgtataatccgtgacccaataagcaactttgtttaaacgtcgaatctgttttctgccatgtggcccgggaacagtttgtgctgggggcgatttggagaaggaatcctgggccggcccagccgaccactcatctttaggtcactctggaaaactgcacattttggattaataaaaagaaaagtgcttcctccactgcctgagtgtcctctgggatgtgacaatagctgtgcaggagggagatgcctcaaccacaaacacacgaatactccttggatgactttctgttcccatgggaaaatccaataccctcgctgtcaagggaatcacagccacgacagaagtccacttggcggaccaagccttcttcaaccttttggggtctgctgtctaccatcatagccaagtcaatgtcatctttttaaattgaggtttttttgtttgttttgttttttaaaaaccatgcaacataaaagtaaccattctagtcctactctgaccatagagacaaacacaaaaccctgggagatggcagggcaacatgaaggaagaggctggctctgtggatgacccaccagccagaatgggtgacctgttgttatatgagaaataaactcctatctcatctgaggaataaaatgtaaccattttagggctggacatagtggctcacgcctgtaatcccagcactttgggaggtggaggcgggtggatcacttgaggtcaggagttcaagaccagcatggccaacatggtgaaaccccacctctactaaaaatacaaaaattagcagggcgtggtggcagatgcctgtaatcccagctacacgggaggctgaggcaggagaatcacttgaaactggaaggcgaaggttgcagtgagctgagatcatgccactgcactccagcctgggtgacagagtgagactgtcccacaccctccccccacctgccaaaaaaaaaaagaaaaagaaaaataagccattttaaagtgaacaattcagtggctatgttaaggtcatttggattaccgtgaaaacataactgctttatgtgtctctctcttttttcttttataaacaagtctctcctttaaaaaaattctgttgggatcacagaaattagatctggactgacatctcaatttcatctgagtcctgctccttcatttgacgatgcataatgaggtccagcgcaagttttgccaggttgcacagatagaggcaaaatccgcacctaaacctggatcttcttcgtgttttgaggcctggctctgccccgagcccttctcccccgtgagtctttcatccagggactgtgtaagtgactggcagacacaaccgaacagtgagatgagattctcaccctcaaggagctgtgacctaaggtagaggacagccagaaaaaaaaagcaggaaagaactacaccatcctcctacattcaacgcccagcatcccagctaccccattattttcgaggactggtcctcccagtgatttgtccaggtcatcaaggtatcaactttttaaaaaaattctagaagacagcaatctctctaaaatgtattacctgctctacatttttacacaatgcaaatgatcacaggacaatgcaatgaacacagctaaaccatttctcattagcctaaggacagtgtatgagtagccactcttggaacagcaccctgtgtctgctttttacatttatctgcttcttctgccaggctgtcagctacacttcctcaactaatatgttgcttctaatctgctatgaggttgagaacccagaaaattagaaatctgctctcatttcaaacaaaaaaaaaaaagaaactctgagagaaggaataaatcaggttgataacttggggtccagagtcacagcccacaaatagtttgtaagtaccttgacactatatgaagattacttcttccttttcttgaagaagttcaagactctaaaggcagagatacgatatactaataattcctactttcccatacaacctgcataagcaagtcaccacctcatcccttggaacctcagtcttctttaaaacctgggtccgacggtactgtctacctcacgggccactgggaatgaggtaccacgtctgggccataagggcaccgcccacagagcatcctccataaagggtaggaactctcccagagagtaaagcacatggcttatctgccaggacttttacataacattttttaggtgctagagggtcctttctgcctggatttttccctcacttgacacaggttttccattcaggctgccaggagtctctagaaaggtaggcggagtgttatgtcagtttccaagtcattaagcacccacaaaggagggcaggcttgcacagcactcactccacacaaccgcccctgccctgagtacgacggagcacatggcttccctaaagccacaaggagaagagaggcagggacagtgagagctgaaggaattccacatgtgtccatggaagatcaccttccctttgttttcctgcactctagtaactccctcatgcagcttgctttctgaagccctctgctccatttccccagcccaggacagcatcaagaaatatttccaccatctcatctatttgaaccttctccctatttactggtgctcccaaccccatctgaggccatcgaaaccagacaactgtggcagcactagcagagtccccaaactaccctgacaccctccctggcaaggaaaatttccacgcgcctctccctggcatatttattccagaggaaaacttagcaacctacacactacacacaggctctgtgtcaaactctacaacagccatcagttgatctttcccttacacatccctccaggaagtgaaatatccgaaatgagtcatactcaggagtcggagctatacttccactgtagtttttttggataaccaattcactgtttacactccaaaacctctaattgctgaacacagaacagttcctttgcagagatcaaagcttacctggtgaacctggcgaaatgacaaaaattctccaaaaggagttagccatccagagtgccagaggagggtggctgtacaagcacattttaattggcaaagcagagtcgctgcccagcaaggaagagtatgcaggggtttattctgctgctcttctatttcccctttaaggcatatatctcttacccctgcacccaccaactttagtcactcctagcacacagctggcggccgcccacccgcacccgcacctgcacccgcacctcagagagcttgctgatccctgagccgtgcactgaagcttccaagcagctctacctaaaggcaagcactgcctgctttttacaacatatacaatgggctaacctgatgcacagaaaaaccctgggtcacatgacaaccaacaaactcattgctcaggatggctctccgccacgtttctcaggcactgtgcttggctctgctggccaactgagtgagctggagcattttctcttgggtgtgcatacccctccacctgtccaactttaaaacacagaatcaacagggatgttacactaaaggggaccctagaaaccatataaacggtggaaaattgaggcctggactgacccataacaaatgagacatcacataatggcaaatgaaccatgaccagaaaacaaatctctttagtacacagtttagcgcttctgcttatacaggttgaacagccctaacccaaaaatccaaatcccaaactttttgagcgaagacatgaggctccaacgagcatatcagactttcggattaggaatggtcaaccagtaagttctgcaaatattcaaaatctgaaaagaatccaaagaagtctcaaatccaaaatgcttctggtcccaagcatttcggataagaaacctgtagtttaatcatcagtcaaaatttaagaatagagttgattttgggccgggcacggtggctcatgcctgtaatcccagcactttgggaggccaaggtgggtggagatcaggagatcaagaccatctggccgaggtcagcagatcaagaccatcctggctaacacggtgaaaccccgtctctactaaaaatacaaaaaatcagctgggcgtggtggcgggcgcctgtagtcccagctacttgggaggctgaggcaggagaatggcgtgaacccaggaggcggagcttgcagtgagccgagattgcaccactgcacaccagcctgggtgacagagtgagactccgtctcaaaaaataaaaaataaaaaataaaaaataaaaaaaaagaatacagttgattttatccaagaaaatactacttcgggctgcaagcaatggcttacacctgtaatcctagcactttgggaggcagaggtaggcagatcacttgaccccagtagttcaagaccagcctgggaaacacagcgagaccccgtctctacaaaaaactttttaaattagccaggtgtggtggtgcatgcctgtagtcccagctactcgggaggctggggcggaaagatcacctgaggttgaggctgcccagtctgcataacagaatgagatcctgtctcaaaaaaaaaaaaaaaaaaaaaaagaaaaaaaaagaaaatacgctttgactcttttgaataaaattctacattattagcattaacaatggcagtattaagaatatttatatattgtccagactgggcacactggctcacatttgtaatcccagcactttgggaggtcgaggtaggcagatcattgaggccaggagttcaagactagcctggagaacatggcaaaaccccatctccatccaaaatacaaaaattagccaggcgtggtggtgtatgcctgtagtcctagctacccaggaggctgaggtatgagaatcacttgaacctaggtggccgagtttgcagtgagctgagatagcaccaccgcactccagcctgggtgataaggtgagaccctctctcaaaaaaaatttgaaaaaaagaatacttatatattgtccagataattttatttttatttttaagtgaattgatctttattaagaatactaggtatccaaaaggcaaaccaatttcaaacgcaaaagggaaggaaactaacaactgctaagggtggcccggcatgggccaggcgctgcaccctgtgggtttcaggagagcctcacaacagctgcaggaggtggctcttgggtaccccagtttcacagataagtaaaatgaggccctgaagggttaggtgacttgccccagagcactgaatgacacagaaggacataacacaggtcccctcccatgcccaaacattctccaaagaatgttaaacactcccaatgaaataaaattaatttctaacgacttgtagggaacaacttgcaagctcacaaaatcagataggggcaatgagtctcttctcccgggatgaacaaattatggacaatgtcatctactaccaaattctgaaatctgtcaccgtggattacagacggtattctcacaaacactatccctggcaggtggatttgtcgaaaacaagaaagcctctcccacacagtttctctggttgacggtttcctggaccccttgagaagatctgcaaggcgccatcaccttgtgtctgatcattaatgtttcacagatgtctacagctgctgcctccacatgatcctggctggtttcatgtaacaagcgactaatccctgcactttgtcaactggcagttagacacataattatgggcaatcctgagacgtcttcaagggatgccgtacatgttgtccatttcccactcaatggcacgagaaattcaagaagcctttcacaaaagtggaagctgagtaaagcagggtgctcctgtcttccaaataacagttaaaagaaaaaacaattcagaaaaatgtcgaccacgtgttcactgacgaaggctaagaaaagtaaactccttttttcatagcagaagcagccaattcacataaaccaaacagatttataagatggcctagatgaaatctataatatttggacacaggtttactccaacaaaaccctgcacatggcttccaaagacatcggggagaagcttcagtccaacctgcaaacagcacaaacgggcatgtctggatgggaaagcaaaaaggtttaaaggatctggaaaaaacgaaggctccatcaatccaaatattttatctagaagggggtggtgctgcttttttgacttatgtccaaaaggaagcttgaggaaaagaacacagtgcttattgatccaacaaaccacttgggctatttcttccctgggctcttgggctccaatttcagatgcctgtgtgtgactcaatatggaagactctatcaaatctctatttgtccctgtcggccttccccatccagctcaagggtaactctattacagcaccacgctctacactgacaccatgggcccagcactgcagagcacaacagaattctgcaacaactggccctctggctcccctaaatagatcaccaaagttttaaacatattttagtgacagaaatgtacaatgcaacactctacccacccatgatacctttgcaaacttaacccaagacctgtcataacgttgccctcttccaattaatgtcaggacccactgggtagggagatgcctgaaacatgacatcctttgggcttcgattttccagaccaaagacagagtccttgaaggtctgcagctggcagaaagaccttggaagtaagacagacaagagttcaaagcccatactcgccatttcctagcaattaaggtctgaataattccttcacctctctgagcctcgattccttcatctgtttagcggcaataataatcaaacctatcttacagggttattttgagaacaatatcacaaaatatgtgtaaagaaagtagcatagttcctaaaacaacaaatattcaattaaataaaaaaaaaacaaaaacaggcattggctgggcatggtggctcacatctataatcctagcactttgggaagctgaggcaagaggacagcttgaggccaggagtttgagaccaacctgaccaacagagtaagccttttttttttttaagggttaaaaaaatacaaaacaggtattatcaccatcttcttatacagaacttcatttcagaaaacataagattataatgtttctagccaacgcagtggctcatgcctggaaccccagcactttgggaggccgaaatgggaggatcacttgagcctaggagttcaaaccagcttgggcaacacggtaaaaccccgtctctacaaaaaatacaaaaattaactgggcatgcctgtagtcccagctatttgggaggctgaggtgggaggacagattgagcctgggaggtcgtggctgcagtgagccacgattgtgccactgcactccagcctgggggacaaaacacccaaaaggcaggagagtgggtagccacagaacaaggggcctgataatcaagtcagtcaaaaagttttttttttcctttctgtctcaaaggaaaaaaaaaaacacactcattataatatggaattaaacatatacacgcacactctcacttatgtaagttaacattccctaaaggcatgagagtgggtagccccggaacatggggcctgaaaatcaaatcagtcaaggccgctcctttttggttcttttgggtaagccaaaatgatctttactagtggaaacattattcctccatcaacagacaagtttcctgagagctggtgaacatcttgccaacaagacatatttcgcaagctcaaaacctttctttccatccccaatcaaacgctgagtgttatgtctcaagaagaaagctggctgaggaaggagcttaacatccttccatgagcaaaaagaattaaagaaagggaagcaacaagttccagttccaaaatagctttttgataactaggaactaagcccagccctggacagtattactgactctcaccaccacctaaagcaggctctgccaaacacagcacaacaaccaactgctactaacaactttcactaagcaggtagtgcacggcaggcgctgacttagggcttaaaacacagctataatagtaatagctaaaacttattaagccattcttctaagtgctttatatgccaatatctcatgtaatcttaaaaatgaaccaaggagttaagtgccagtatcagtctcagatgcagaaactgaggtacggagagagtggtgagcttacacatttaaatggatggcagagctggggttcaaaggcaggtgcatctgaccccagaacctgtgtgcctactcaatactccacagagcccagcagctgggccacctgtgctaagaaccactgccatctctttgttttaaagtctccaaaagaagaggagcgggttatttagcacctacttttgcacagttgagtcacaagtgaggaaggcagcaccgctctctagttaaggatacaggttggaaagcaagattgtctgcattcaaatcctgactccaccgggtcccagctgtgtgaccttggacaagtcactaaactcttctgagcctcgagttcccccatctataaatgagggtagtaacacagtagtcaccccttatctgcagttttgttttttggcagtttcagttacctgtggtcaaccatggtctgaaaatactaagtggaaaattccacaaacaatttggaagttttaaatttcacgccgttctgcgtgatgaaatctcatgccttcccactccatcctgcctgggacatgaatcatctttttgtcccgcgtatccacactgtacaagctatgtacccgttagtcactcaggagccagctcggttctcagatccactgtcatggtgtcacagtgcttgcgttcaagttacccttattttgcttcataatggccctaaaacacaagagtagtgatgccagcaattcagatatgccgaagtgaagacaaaagggcttctttaagtgcaatttctcaatttaataaaggaagggaaaaactatatgcggagactaagatctatggtaagaatgagtcttctatctaaaattttgaaggaaaagaaatttgtgctagttttgctgtcacacctcaatgcaaagcatatagggttcgatattatctgtggtttcaggcatccaatgggggtcttggagtatatcccccatagctaaggagggacaactgctatacatacattatactgttattttaaggattatgtgggggtaatcctcattcagcatctggcacatacctgggacatagtcactgctccataaattctacatgttaagtcaacagaaaagaggaagaaacaagaaagtaaaagcatataatctaacaatttcacaacaaaggcctcgctggccttctgccaacctccagaaaacagtgctggactctgtgtacccgcagtgtggctgggactgcagacaccaggaagaccttgggacctgtggagcctggatggttcagttgtctgagccaaggagggctggattaggctcagtgatcgaagctgagcaagtttcagcacatacctctacaaagtggacgcccagggatggctgatatgatgattctttaggaagccaaatgctcagtttctcagaaaggtgttttcctgtttcatgacagataaaaaggtttctcatccagacaaataaatctgctgactgagagctttcattaaaagcaaacagtcttgcaataaggaaccgtaagctaggaaggccttccatgaatatatgaaatgtcacaagtcctcagcctgtgtctgagagtgagagagggagaaatttgagaaggtgctgaccagctcaaagactgggatatcataaccctaacaacatccagtcagtacattcctcacctacaaacgaaaatcacaggcaaggccacgcaccgctgagtcccaggagacacaccttcccaaataagtgtttgggtgggttgctgttaacttccaataaagcagataaatgtcatcaattgcttcctgtcttcaggtcttgtcaatacagaatgctaagtccgctagcctcgaaagcctgtgtaccttccacagtcttaaagacttgatgggaaactggaaaagcaatcaggaacagaacaccatgggcacgagactcattccaggtactgtcacagcaagatacccttctagtattccaaagctaggaacacacctccccttgctcccgccagcccagggaaaccgaataagctgtttaccagggaccccagcaaagcgagcctcaaaactcaccagtgggagaacttcatgacacaaagagaaaacattgttgctttcatttgccaatttttaaatacttagctcataagttctgtgaccaaaactaatagaaggctcgggaggagagctcggaaaagcagagggggttgttttcctaggctccttcctctaacacgaaggtggaaatcaattcgctttccccttctaacccttgaatccctggagaacgatcgtatttggatggcctacgaatgctcagctttccagtagtgccccagacgaggaatccatccatccaagtattgttcttacctcccactacctcctacgtcaggggaggggaccgggcacatggttccgaggtcatgctcctcacttagaggatcgtgggaatgcttacggaaacacttgtcacggcgctgccagctggaatcgctgcttaagaagaggctggaaaactagggagtgcgcgatcagagacgggaggctggggagagcagggaggcagatgttgtgtgttatcactgaaacaaacacaagccatccagttgtgcacttcagctacgtgcggcttagcgtacttcgataatgcctccagaaagtcagggaaaggaaatacagaggaagctgggcctctcttctaccacctcgaaactgtcctgctgccaaacagatctgggaaagcaggttttaatgagaaaattcaattaagaaataaacttaagtaaccccatagcatgctgagtgaagagaggagcctttctcaagtgtcttagtgccgaggagtggaccaaggggctctgaaaaatgaccaatgaggcttcccgccactcagaggaagccaagctcagaaaggccacgaagaccatcctcgcttaagcgcggggccagattccaaggccaggtctgctccgcctcatccatttcttgtgctgcttcccagtgagactcagcagaggacacacgaggccacatgaggtactcacatcaggatctcagctctctaacacagggaggggtgcaacgaaggcaaggacacaggtgctgtgcgtgactccccaccggggccggcgggcactgggtggctcagagatcattaggaacggtcgctccctccctttctcctggtttcccttctgtcctctgatagaggaaagtggcttagatcattctcacaggaagattaaatccagagcaagggaaagggataggaatccgtttccaatcaatgatggaaaccagattccctcatcagttgggattcattcttacatgttgtaaacatcacagagctccacccatggctacaagcgttcaggaggtatgaagcatggtggcacatcctgggtgagagctgcctgtggccaagaagcctcccggcttgggctggcccatctgagggacaggaagcaacacgtctcttggaagttatccccaaaactcccatctcagaaaggtgagataaagcacaagactgtcccactcttgtaaatgttctatatttacaggaataaagttttaaaaccatcttagacaactataacctccttcctgtagaacatacccatgtacatttgtactcatatgggaaaatatggtatcaattattaatagtaaagtatttgaattaaaggtcttttgttcttgaagaaccacgggatctcagtttcagtggccttggagtcccacttcccccgtatgaaatccctaaagcactaggtgttttgacccctgcttgatcttgactatggggaaaatgcaccatgtccccagtcagcctgtgtcacgcggtgctggctgtttggcagctctgccttacactgcagcctccagcacagagagtcctctgtccagaaccacctcaaggatgtgcaagttctctgccacatggcatccctcagacacctgaagtgagccatctcagcctccctccaagcagcttccctcccggctgacactcccagctctgctgtgtcctgcacatggcacgcttccgagaccactcgccctcggctgtcccctggggttcatgccactggatcactgggtgcttaataggcgccaaccatttcagaaaccacctcttattcccgtgagagcaacccctgcaagtattctgttttggttttgtttgtgctttttctttttgcaggaatcaaggccctaacatccagaacctcagcagtctctctggctgccatccacatcatctgcccagacacaaagagagcgggacaggaccacagcgtggccaggtgggggtgctaccggttttccctacagctgacgtaaaatacatatattactgcaaatctaataacctgcttagaaagcacttcaaggcagaaccattcaggaaataccttaatacaaaatacctttgtttttcttttctttttgtttttctgaagcagggtcttgcttgcataccaccatgtctggttaatttttgtactttttggagagacggggtttcaccatgttacccgggctggtcttaaactcctgggctcaagcgatccacctgtctcagccttccaaagtgctgggattacaggtgtgagccatgcacccggcccataaaatacacctttgtaatgaatatgtgagaaatagatactggaagagatgatgtaaaaacaattttttatttttatttaatctctcttatgcagattaagcatttcccctgaaatccaaccctcacagctcagtccaaacttttcctcaccgtgaaaaggtgaactccagaccagcctaaggccaaccgttctgaatggcaaccactagattcaaagcaaggtgctgtgatgttgctaggtgtttggtttgtgctcctatgaccagtgtggggggaagggacttgggcagacatccaagctgaggtcccctgggcagagtgactcagaattagtgtctggataggcatccgtgcacccaacgctactgacttactccagttcatcctgaagacagactattacagtaaaagccatgttttaaaaaagttatagctgctaggccgggcgcggtggctcacgcctgtaatcccagcactttgggaggccgaggagggcagatcacaaagtcaggagatcgagaccaccttggctaacatggtgaaaccccgtctctactaaaaatacaaacaattagccaggtgtggtggcgggtgcctgtggtcccagctactcgggagactgaggcaggagaatggcgtgaacccgggaggcggagcttgcagtgagctgagatcgtgccactgcactccagcctgggcgacagagtgagactccatctcaaaacaaaaaacaaaaaacaaaaaacaaaacagttatagctgctaaaaccttatgcagaaagtccacgaaatttgaaaatatacatcatataaacgtaagcaaggctgaaaacacgtgaatcccagttagctcaccctgcattcctgcccatgcagctcgtgacccagctacagccttgggtctgtactctccctgcagtcagaggatggggacaggtggcacactgctggcctgagcacaacaggagtccgtttgcttggggacatttcttggaaataaagtaagtataagggtgtactcaggaacactgcattttatctgggactcggctttgttgcccagcccagcacagggaaagaggagttttaaagtgtttcagaggaagaaagagaaaaccttgttggcctcaggggagtgaggtatagcacactcattcagcttcatttactgagtacctacctagtatacacagcagggcatgttcacccctttttttgcataacaacatacacccagggtggctccagtatactcagaactacggaactgaagaagcatcacatcacatctttcccaagtgatgctgggtggggtccccagtgtagaaggcagacagagaaaaaaaaaaaaaacagcagcaccaagcggctcaaaagctcaggagaggccgggcacagtggctcatgcctataatcccagcactttgggaggccgaggcgggcagatcacctaaggtcaggagttcgagaccagcctggcaaacatggcaaaaccccatctctaccaaaagtacaaaaattagctgggcgtggtggtggatgccttgtaatcccagctacttgggaggctgaagcaggagaattgcttgaaccggggaggcggaggttgcagtgcgctgagattgtgccactgcactccagcctgggcgacagagcaagactctgtctccaaaaaaaaaaaaaaaaaaagcacaggagaggtatccacagcccttaaaaagcatcagtgatagctccaaatgctgaaagatgaagggctctgtcatctttaaaccctgtttgtgatttccagtttcaatgagcctgttacattattactgtaatcctaaaaaaaaggctcacaaattttttaactgacaattttcaaaaaacaaaagtcagtgcttagtcctgttgtttacatcgggtacactattagaatctggctttcagaatggagagacccagactgctcatgacaattacaccagaggatctgattcaaactgattcgagctggggagtgggggggcgtggagtgagcaggagcagctgaaacaacgctgggcacggaggataactgctgaagttgagtgacagataattgggggctcattatatcacgtgcttgaaattctctgtaacaaaaagttctctgaatttaaatcaggcaacactaacttaaagttcccttacggtaaggcctggttgccacctactcctaggctcttgcaagctttaaggccagtatgagtcgaatgtttactggacattaggcagttttctcacactcacactcgcactcggtccaggaaagccctcccggggcagggggccaaacgaaaccctaaatgcagctttgtagcagcccagctgctctgaaggactgaaaaacacagggtcctcaaaaatcaccaaaaaaccctttggcttggacagcttttccttccctggcttcctgtaaagatgccgcaggctccctagaatctccaactccggtttgtttttaggaaagttccgttgctcctgccttcagcttggctgcctactccacgttacacaaatacacctcctctgtgcggcgcaaacaacctctacgccagtggtgctgaaggaggccttcgctacttgcatccatcctatcagcgtccagaggagtgaacacgtagatgtctatcactgacttcatacccttcccccaacaaaaaaaccttaaaatcataattacatccttctctacaatgacctttcttacttttataacaggattttaaaaatccattcctggccaggagtggtagttcacgcctgtaatcacagcactttgtgaggccaagctgggaggatggcttgagcccaggacttccgagaccagcctgggcaacatactgagatcccatctctacaaaaaaaaaaaatacaaaaaaattagccaggcatggtagcgcgtgcctgtagtcccagctactcgggaggctgaggcagaaggatcacctgagcctgggaggtcaaagcttcagtgagctatgatcacaccactgtactctagcctgggcaacagagaaagaccctatctcaaaaaaataaaaataaaagataaaaatccattcctttttttaaaataagacactgtataatattaatatagccacggcagcaccactggacttacggcctggctttagggagacctcagactgttgacgtcagtttctggtccacagctgccttggaaacctccctgagccaaaattaaaacaacagctttctctcagggtatgcttaagttattgttgttgttgttgttgttttaaaaagaaaaaaagacaacaggtttgatgtgacactcagtgtctccggtgtgccaggcactgtgtcaggtactttacaaacaaggaaagcaaggcacagagaggccaggtcacctgggcaaggccgcctggcagatgctgtgtgtggccgcagagtgaggcatgtcccagactcagccttcctcaccaagagggactcaaagccttctggggcactctgtgatgaaagctatgggctctctccccagggagtgcacacacacaaaagtctgaatgaaatatctggtgggttcatagtgcccctctgttccccaaacgtcccctctggttaaaaaaactctattcaggtgaaaccctgtctctactaaaaatacaaaaattagccgggcgtggcggagcacgcctgtaatcccagctactcagggggctgaggcaggagaattgcttgaacctgggaggcagaggttgcagggagcagagataatgccactgcactccagccggggcaacagagccagactccgtctcaaggaaaaaaaaaaattctattcagattttcatcaatgaagagcttcagcaggagtgtctcccatagaaagaggcaggtgtgtctctggcctcaatccctctctctcctgaggtgtacatggccccagggcttgcccctccatcagtctgcaacaccccccagccctgaggtctcagacacccagctgccacctccccaccctgtgacaacttgggcttgtatcttattaaaacactctagggtccaaccctcttaaaacaatgaaaacattttctcactcatataaacaaacaaacctttactgaaaactaatgacgaacacaaagggactatttacagaaaacagcgtgcctagccccatctagattataaacataactgcacactggctctaaggaccctgccatcttcccaggccctggcctggctgttctgccactccccacctcatgcctgaaactgacacaaaggaaccaatcctccagccaaagtaagcaattacaacgtgtagctgaaattcagagaggtgatctaaaaagcaattttgtaagatagctccaaattgggaagaaaacaaatttttgtattttatttttatttttgagatggaatctcactctgttgcccaggctggagtgaagtggcgcaatcctggctcactgcaacctccacctcccaggttcaagcgattctcttgcctcagcctcccaagcagctgggactacaggcgcctgccactacacccagctaatttttgtatttttagtagagacgggatctcaccacgttggccaggctggtattgaactcctaatctccagtgatctgcccgcctcggcctcccaaagtgctgggtttataggtgtaagccaccacgcctggcctttttaaaatttttttgacccacgagatctttgacacaaagatatccatttcagcattatttatgatagcaaaaagtgaaaacagccttcatgtccaacatgagtaaattaaggtacaactgtaagatgaagcactgtacgatcactaacaggaagtttgcaaaggtgttttaagcaagtgggaataagacttatgtgacccaataggaaaaagcaggatgcaaatttcagagccatattttaaaaatgtgctcagaagactcgaacaaaaacccaccaaaaaagcaaaagttgtttcatccatgagggggaattttgagtgacttttttttttttaattctctttatacattttggcattttccaagagtaaaacatgcactttccccgctttgccctttccttctgattataaatggaacataggctctctgtaggaaattcaaagcattacagaaagtgaaacatccccctgtgatctcaccacctagagactccccaaaggtaactgccaataataacttggttcccattcttccagatgttttccaacagggattacttttagaatcaaataatttctctaaaaaataatccgcatgattccatacatatgaaatggccagacagaaagtgaatggtgagctggggcaggagtgggcatgaagaataactgcaaatggatgcaggaggtgttctgggggtgatggaaatgttccaaaattggattgtggttatggatgcacaactctgtaaatttcctaaaaatgtacaaaaccgcactgtacacttaaagctggggaatcttatatgtaaatcagatctcaataaagcagctgaaaaaagaacaaaacaaccactagaggcagggagtgctgggctgtgcaggagggcagtccatggctttatgctctgccctcaagagcacatggtaagaccctgtagcaggaacagaggaagctggaggcctctcggcatcacctggacaaacagccctcggcagagaggctcaacagataacctgagagcggcagggtcagcgaggtcagttccagtctacacgggaggcaggaagagcgccagccctgaaaatgcattcctgaggctcaggctgcactgccaggctcgctttaaagccaggccaaaggaaaacagcactggccggggtgtccaaatactttaccaagttcaggatgcactgcgtgcaggaaaactgagaccatttttctctgtttcaacagaaacttgaaaaccacccctgacaacatgttagtccctggaagtactcaattacggtgaaaagccatcggcaaaagttaaagtgagtaatatgacagtgagccatgtaagaagtaaaggtgagtggaagattatgaactacataaaaggcacaatgatctgagtctagaaaggcaatctggaagcctgaaaaggtacaaatgggtgcaattctcttagaaagtaatgggcaagtaaatgtcaaaagcgtttaaaatattcataacctcctaggaatctaccctaatgaaaccactcaagctgatgaacaaagatgcccactgctctacccactgctccacggcaaaaaaaactggaaataatctcccccaacaacagggaagtgatcatctactgtgtaacccttacaattgcacagtgttaaaaacgtgggaaaatgttttatgtttaattagcgaaactgaatataaaaatttactatcaagtgagtaaaaaaatgcccaaatcctggaaatgatatataaaaacgttaacagtgtttttctttaggtggaaagattgattttttcccctcctttcatatgtatttagtgaactccaagttttttccatcacatgatttcagtctctaaaaatccgtgatccatcacgccaactggattttgtcaattttaccctctatggtttgtactgtgcaaaactaggcttcactttattttccaaacaaaaaatactattactgagtatgttttctcaaattaccaccccactgcccaaaaaatgacacctgccacactcaagattatggtggcccccaggaggtgtgcccatcccagccctcactgggtgcaagctctctctttcttctatcatccttctgcagagaaggattttgtaattgttgttgctttgttttaaagtgggaaagaaaaatattgacgaacttaaaactcgacatagacagagacattgggcagcaccagacctaatcttttttttttttttttttttttttgagatggagtctcactctattcaagcaattctcctgtctcagcctcctgagcagctgggattacaggcacgctccaccacatccagctaattttttttttttttttttttggatttttagtagagatggggtttcaccatgttggccaggctggtctcaaactcctgacctcgggtgatctgcccacctcggcctcctaaagtgctgggattataggcgagagccactgcacctggcccagacctaatctttgagggaactcagcatcatcatagaaggctgaaaccacaagatctattttttgtgccttcctaagagtgttgtgtgcatgcagcaatccagcgaaatggtgagttgcacagatacacctgggggatgccagcctaagatcagggccagggtggcacagcagcaccctgggagctggtggaggagggcacggctcactgacgccatccgacccagccccagcagctcgcaggccacactgctcctctccgcctcggtggccttgccagaatgctgggcctctctgatgcactggtactatctaagcaatcggcaactaacagtagtgaaagcgtagttcattttaggtttaagaattagaacaggctcaatgttgctctctaatcacaccctcactcccctgcactctaataagcttccgtcagtgtgaagaaaagagggcggagggagggcttactcgagggaactgtgaaacacactcccccaggagtgggtggagctcaggacacctctcaggcctggcacaggtgggcttttctttcggaggaaaattaagtagtagccagtcaacctatcagccaactgcgcatcaaggggccacagtctataggatgggaagccaaaatatctccaagcaagaagggtggtgcgccgctgcgcacatcccaaatacccgcttctctccaggcactgcccacccatgagggactttcccttttccaagtggcagagctccactcctggctgtcaaccactgtgaatgggacatctcctctcctcctcccttccaccctttcgggagagcatttgattaatatttttctacttttgttgccccaagttgaggagtgtttagagatggaaaataatacattacttccctctctgacaaccgccttaatccacaaagcccagaggtaaaaactcacaagctgtttcttctctgaaccgcagaaacaaacctggttgcagttggggcactgtggaccagagaaagatgcagtgtttcatcattacctacccatgataaatgctgtaggggttttttcttattcaactgcagatgattcacattagaagctgcctggtgaccagactaactttcctccctacttgggcaaaaagttgtcacctagccaacacatttcctgggggtagactgtgccttgtggattccatcagctttgctatttacttctcccttcaccctggcagttaacatttcaaccctgatggccacggccacctgttgctcctcctcccccctcagatctaaagtgcgtgtcacctttctaggttctgggtcacatcttctgggctggccaaggcctgggcgagagaaccctgtatcctggaactgcctgggcattggaggaggtgatgggttaataacaatcgttttgcaggcaggggaggcgagggggcaagaggaagtggaaacatgacgtgactagggacgctgccccaggctgctcgctgcccgctcctgacttctcccatctggtttccatctgacccaagcagctggccagatggttttcatttgcagatgaaaccccagcagttccattgccacaaaaactcctgaccgtagagtctctgtaaggctgataacgcacaaagtgcactgcggtgtctctgagcaggcctgaaaggtcatgcttcccaaagccggaaccaggacaacaggaacaaagtggggtcttgacacttgaaaattccgatgacagccagaagaggaaatgcactggcctggcgagatgcgagtcacggtcaggcatggagctgaggaacggggaagattttgccagtgaatcagaccttgtctctatgccatccactagcatccttaaggtgaggaaagaaccagcaggtctcagggtgaaccatggtatgtccactcagtggaacagtacgaaacagctaaacccaggttcgtaaagaaaatgtaggctggactggctgggggctgtggcccacacctgtaatctcggcactttgggaagctgagacgggcagatcacttgagatcaggagttcgagaccagcctggctgacacggcaaaactctgtctctactaaaaacacaaaaattagctgggcgtggtgcgtgcctacagtcccatctacttgagaggctgaggcatgagaaaccttgaacctaagaggcagaggttgcagtgagccaagatcatgccactgcactctagcctggttgacagagcaagagtctgtctcaaaaaaaaaaaaaaaaagagagagacagagagaaagaaagaaagagagcgagagaaagagaaagaaaaaaatataggctgggcacagtagctcacgcctgttatcccagcactttgaggggctgagtcaggagaatcgatttgagcccaggagtttgagatcagcctgggcaacataaggagactctgtctctacaaataattaaaaaattagccaggcatgatgttgcgcacccgtagtcccacttactcacaggaggctgaggtgggaggactgcttgagcccaggaggtgggggctgcagtgagcaggaattgtaccattgcactccaacctgggcaacagagcaagaccctgtctccaaaaaaaaaaaaaaaaaaaaaaaaagaaaagaaaagaaaagaagaaaaaatgtagtaatacaatacatggaaatagtgataatgcaggctgagtattagttttccttatctgaaatgctggggacctgaagtgttttggattttgaattttttccaattttgaaatacttgcattatacttactggttgagaatcccaaatcagaaaatccaaaatccatgtcccaaagaacatttcctttgagcctcatgtcagtgctcacaaagttttgggttttggagcattctgggttttaaattttcacattagggatactcagcctgtaagagtgtgtcaggcactgttttaggcatgtaaaatgtgtcaactcaatcttcatagcatgcctgtaagacagcttatgttattaatcctacttcatagatgaggggactgaggtagggagaggttaaggagcttaccaaatatcacacaggtaataagtggcagagctggaagcctggttccagagacccaggtgaatcccaaaaaagagaagctgggcacaaggccccagggaagcaaaaacctgaaaaactatcctttcacacttgtgcagggtcagttgatgttaggcttgtattgcaaaatttatacttctgaagaaggataaagcagcaagagggaaaaagtatctaaaatgcagacacatataccacatttgttttggaaaagacaagtcaggagcccacaaaaggttatgaaaaaccccagtgacaccaccaccaatgtttgtctttggaataatggaaagagatgtgtattacttgtaagaatgatctctgctattacatgactcattcctgcatgcaaggactgctctcatctggtgccaaggaaagactgctgaattatggaattgcaaacattatcactgactgttactcacaacactgcagggcaaactgatatgcgccaaatcagccatgttaaggggttgttattgcacctctcctcaggaccagctgttgctatttcgcattaagactttaaccatatcttagtccaagaactcatcaacctcagcagttgagttgcttggaaatgcccagggtccacacaagttccccaggggaacccaccatgggtctggggactggagtcatgggacaaaaaggggaatggtagaggcagagaacagaaacagggaacggaaacaacagataaaaggaaatcactgacacagatggcatgcaaaaggcctttcagagtggaaatggacaatcccgaaattggcaacatatgatgtgctctttattcctgctccccaccggcatgtggtagaaggatgcagaggaaaggacggtaatgggtaagataatatgaataccaccctacaggcacgtgtcatctaggagcctaccgagtgtcccaccttagtgatctgaccctcagacaaaactgagagggagacgccaccatccccaccctgcagatgggagacagaggctctggggagtggtccccagaaacatgtggctactcagagacaaggctaggaccagggggtgatcactttccacatggacagtgtggaaatatcagccaataatgtgtcctctaatctatttattatggcctccacctctctgatgactttaaagtgcctcaccctcaacatagctgaaaccgaactaggtttgccccaccgaaacctagcagttatcatgcagataacagctaacatttactgagcatttattatgtgccaataataatgctatgaagcaattttactgtttattattgtaatttactgtttattattgtaattattattttattatttctctccacccaagtaccaaccctcccccactttgtccaagagaccacagtgattgccctacacctgccccaacccatcctctctgcacatctgggtcagggcaagctttccaagacttacctggccagtcctcactgcccaccccctgcagtcctcttacctgatcatccctccatccctctccatcccatgtcccagcctgctcctgcccccgactcagctccttcctgccaggcttctgcatgtactattccttctgcctggactgccaccccctcagctcaagcctgctcccccgcaacggctctagggcagcatctccctccagatgccatgaccccgtagttgttgatcattgcccccactgggacataggctccaggggagcaaaggaagaggctgttcttggtcgcctctgtactgcccgagtccggcacagtggtcggctcatagccaatgaataaacattcccggaacaattctatgactctcaaattagcctgagcaccaaaaagaggagcagggtctgagttgtgggctgagctatcctggtgccaaggcaggccttccactgccacgtacacaccctgaaggcagagtcagcacgcccaaatcctgtggggcctgatggtgaccactcaagctcggacaaaccccaagtgtgatctcactggaatccatgtcaacgcccaagtcctcaactccagcagaaactccccatctgttcctctgctctcctctccaccacactgccctcctgccactggaccctcaccactcccctccaagccccaccttcggcagtcagaataatttctttcttttttttttttttttttgtctttttttgagatggagtctcactctgtcgcccaggctagaatgcagtggagcgctcttggctcactgcaacctctgcctcctgagttcaagcgattcacctgcctcagtctcccaaatggctgggattataggcacctgtcaccatgcccaactaattttttttatttttagtagacatacagtttcaccatgctggccaggctggtctcgaactcctgacctcaggtgatccacctgcctcagcctcccaaagcactgggattagaggcgtgagccaccgtgcctggctggcagtcagaataatttattttaacataaataaagtcatcgcccagattgacaccttccagcttcttgtgactgttagacttacaacctggcatacaggcccggtgtcaccgggcccctgtgctactgataactaacagcacgtcttttattctatttttttgttttgtttttttgagttggggtctcactttgtcgcctaggctggagtgcagtggcacaatctcggctcactgcagcctccacctcccaggttcaagcagttctcccacctcagcctcctgagtacctgggattacaggggcgcaccaccacgccagctaatttttgtatttttagtagagacggcgtttcaccatgttggccaggctggactcgaactcctgacctcaggtgatctacctgcctcggcctcccaaagtgctgtgactacaggcgtgagccactgcccctggccaccagcgcctctttctatgtctcaacctgggaagccttgtacccgtggccccttccttgtcttctcctcccacctggaaggcctctctctccttctaggtcttccctgtcacctgacttcacaacacatctcacaactcaaaatgactgtgtttgtatcacaatcacaatctgtcccgcccagaatagcaggggctttgtcttgttcaccatccctgtgaatatttgctgaatccaccccttttactatgtgaatagtgaacaattactgagcccttgctgggggctaggcagtgaaatgcacattagatgcattaactcatcccctggtagacatccctactgccattttacagatgaaaatgaggaacaaagaagctaaggactggggccacttgggactcacgcccaggcagccagctgcagcgtctgcaatttcaaccctcccctaagtgcgctgcctcctggagttgtagaaggctacagactcatcccccagagtggccagggctcctggagggcaggcatcacatcttaggtttctccaggctcaggccctccaacaggaggtcctgaataaaagctcaggaataactgcagttcaaggaagccttggctagaaaaccctacaataaaaggcaggcaagactggccatgagtagcgccatccctgcagtgctgataattcacacctgcactcacaggtaggctaaggcagtccctcaggtgggctgaagaatgaaatgctggccacgtaagatgtaaaccccaaagagcaagtttgtcccatcaggtcccctatgttaccccataatatctgcatcctgatctttaaaactcttttccagagaaagtcaagcaaatgatatttggagggctttcctgctgcttttattttggaaagttatataagagtcctaagagtcactcctgagcgcttagagtagtggcacatttatgcacattcctcacttggtccttacaacaaccctctgagtcacacacgatcatcccaaatgacaattgtggaaaccgaggctcagtgacctgagggacttgcctagggccacagagctgccaagcaggaaatctaggctgcctgagtgcaagctcgcagtctgtactgtaatgccaaaggcttcactaactcatttcagaaagcaattgtcacgatcttctctaaactattaatacttacaaatactcattcaaggagtagagcttagaggctgtgaggcaaaggcagaaccatttctgggtgacacatcagaaaattactgttccgttcatctaaatgatgtttaaaatgcccactgcagcatgaaagtgcctctgctgagaaactgcagacatcagcaggagccataaaggaaagataaactcttggtaaagggaaggaagaggggctgagtgggtgagttacagctgaattcacaggacaccggtcccgcaaagaggaagccaaattgcagtccaagcagccaggatgcggagggcccggagggcttggaaccctgcaggcagcctggctgtggagacagagcaggacaagctctgagacacccccaggagtggcagacagagacaattcatgcctcccgtcccgggagcaggcaagggttcctgggttaaggggaaacaaaggggtccatctaaaaaatatgaaaggcctggctgtgctgagtgtgggtgaataaggtggagtatggttaacaaaacgattccacatcagcaaatgctaacacagggctcctgggatcccatagagagagagtctatttccatttttatttcttaactcaaaaaataaaattaaactttactttctagaagaggacgatgagagaagatcgctgggtggccacgtgatggataagacatgcaggcctcccttgctggtccccactggcctcattaaggctgggactattatttctcaacacacatggtctgtcctgtcacacgctagtggtttccaacaagcgggatgcccacagcaagtgccctccaatccgtcacagtccctgccgcatcttgggtctcttgacctggcctatttactcttatctaccagccactgtgggcctttggatttgcatcctgcttgataaaaatcactgaggagctacaaagagatgagattggccctgacgccaattgtcactcatctcaggtccttccaaaagagctggcagactcagaggtccatggacactgccacatccagtaccacaggctacaacacatacacttcctttctaagccatgaataggtcacaatctcaagcaagttatatacacaggaaaaacaagggccagtttcctacattttataagattcttatatgcaaggctcttgtttatttgtttttcagaccaagtctcactctgttgcccagggtggagtgcagtggcacgatctcagctctgcaacctctgcctcctgggttcaagcggttctcctgcctcagcctcccaagtagctgggactacaggcgcgcaccatcatgtctggctaatttttgcatttttggtagagatggagttttgccatgttggccaggctggccttgaactcctggcctcaagtgatgtgcctgccttggcctcccaaagtgctgaaattacaggtgtgaaccaccaggcccggtccacaaggctcataattttaagggcaaccaacaatctgctgctatagtaaacagaacacattgaagagagaagcaagagctttgagaagtaaacaaaagaaattttaaaataatctgaatactaatgacacctctaagaagagggtcaggtgcaaatccaagccaggatcaggtattccattggaaactagttttttaaaaaaataaatcccacaagataatctctggtttcacacagagactggtatacaacaggaccatctttccagcgttagcctcaatatcccagtcttgggttcccttcaacgtaggtgttcttggttcatcgactgcctcacatggaatgcagaactatccccctacccatgcacgattcccccgtacagaaaaaaattcagagcaagaatactccagcccacagacccagcctgtctttaaggatcagaccatcccacaacgtgacatcctcgaacagactatttcactggggctgcccatggagtctatttgggaaaggcaaacagagcggccgatggcaggggctgctcagatcacaggaatcccaaacctaacaaaaacccaataatgttataaagggagaagggaagatgatgcttaaatctcaaacacaacttcagcaaaaggtattgttgcatgggtcatctgtattcctccaggacagaagatggtaagagcactaataaaggtcattatactcatttgagcagggcactcttgaagattttcatccaggaaatggaccagcattccaaactattacttagagattagctctgtgtgtgttggagggtagcctaaagggttagggttaaccccagaaaggcaggaagttccagaaaaaaggcagtcattctacccaagtcttgttggaactaaagcacagcgggaaaagcgagcaaaccaaaggggaattagagacactcacaaagggaggggccttgggattaatggactctctaatttttgaatttcctgaggtttacggctgattaggccccttagccatactgtaatgtgatcaaatttcaactgggttcacagcacagttgaaggtagaagatgacacagacatcaccagtgggccccagagactacagacaaggtccgcagtgctcgcttccgggcttgatcgcactaattaggcacctttaattccccaaacaatggcgcacaggctggctcagagggcactgtgtgatccaccgcatgcttgaggagctcttacaatactatgtactgataattctctaatttggtacaagcatatttaagcacatggctcaaaggtggagagaaatgacattgcaacccgcaaacacatatgcacaaaaatattcaactttgccaagtgaagacatacaagtgaaaaatgagggacgatgtactgctgactaaattagaaattaagggagaaaagcgcccagtgttaacaaagaagcaataacctgatgctcacactgcggacggtgttatgaatcggcctgacactttggaaagcaacttggcagaatttgtcaagagctgtaaaagtgttcatactgtggcacggtaacgttactcctgggaatccaaacacagaaaccacttcagaaggaccagtcactgtgacatcgcttataaggaaaaaaaagaaaaacaacaacaactggaaaaaacctaaagggcaacatcagggaagttacccccctgccatctgatgtttaaggagtaaacagccagtaagcaatgatggttgtaaggacttcctgataatgtgggaaaagtcttaggtcataataatttttaaaaaggaagatgaataattatatgtagcctatgaccacaactaatcaaaaacctcatgtatataagaaataaaaggagttgccaaaaaaaaaaaaaaaaacactaaactggtgcaagtgacttttttccttctgtgatctgagctttccacaatgatgctttattaagttgaactacatgaaattgccaacacacagccatttctgacctacacaagtggcactttcacatgggtcaacataatattttttgaaagttttaatacttttatgaaagtatttttatgaaagctttaatacttttatgaaagtatttatccaagttttgttttgttttgtttgtttgcttaattttgagacggagtttcactcctgttgcccaggctggagtgcagtggtgcgatctcagctcactgcaaccctccacctcccgggttcaagtgattctcctgcctcagcctcccaagtagctgggattacaggtgcctgccaccaagcctggctaattttttgtacttttagtagagacggggtttcgccatgttgggcaggctggtctttaactcctgacctcaggtgatccgctcgcctcagcctcccaaagtgctgggattacaggcgtgagccaccatgcccagccttatgcaaggtttaataactttagatgttcacagtatctgcccctgctctgcgctaccacccctcttcaatgtctaaggacagatctgtaaacacatgtgacacacaaatagagtggtctaaaagcagtcctcagaattctgtaatccaaaaaggagagaaatccttctaaggtgtgaagcaacggacagaaacaaaatgaccaaagtcagtttcaccacatttaagcccaattctgaaaaatgcaggcaggcttctcctttttaactactaggtggagagggcacctccatgtggaacattcgaagggcagaaacagctcaccaggtcaggaaagccagcaggcaaagtctgttggcaggagaccgttggcaggaaggtgtggtagggaaagtgccaccccacgggcctgaccctcccgcctgcctgcccttccaaaggcctcctccaccttcaaccaggtcccatttttccaggccagagtcttaaaggatgtttgcttccctttgctggcctgaggacaaggctaattttactcaacaaagtaaaaaggatggaaagaacacactgaaaagaacaggctgaacaaccacctgtatgggtagagccatttaaaaatcattcaaacacaggcacagaaaacacctcaacaaatgtctatcaaagtcttagcagtatctcaggggtagaatgaaaagtcgttaaagttgttaaagttctgtgttatttaaataaaataagcattacttttgcaggcagaaagacaattcggagattaaaatatttttaaagagagaaaataggagacctgctttgattgatttttttaaaaccttctaccacgccttgctcagcctctcagcccccacacctggggtagaatttcttcatccaaaaaacgggataggggctgggagaaagaaatgccagtacccggacagccactgtgggccgggcactgtgctgggagctttagccacatcgtccacccttccacttggttgaagaagagtaaaacagtcccccttacctgcagtttcactttctgcagtttcaattacccacagtcaacagtggtctgaaaatattaagtgaaaaactctagaaatgaacaattcagaagttcaaaatttcccacggctctgagtagcatgatgacatcctgctgtaccgccccagacgtaaatcatccctttatccagtgaatccactgtctacaccgcccaccccatagtcacgtagttgccttcttagtgatcacacagttgcagtccttgtgttcaagtcacccttatctgacttaataatggccccaaagcgcaagagtagtgatgctgtcaattccattatcccaaagagaagttgccaaatgcttcctttaagtgaaaaggtgaaagttcttgatctaataaggaacgaaaaaaaactgtatgctgaggttactaagatctacagtaagaacaaaccttctatctgtaaaattgtgaaggaaaaataaatgctagttttactgtcacacctcaaactgcaaaagttacagccacagtgtgtagtaagtgcttagttaagatggaaaaggcattaaatttgtgagtggaagacatgaacagtattggttttttgtttgtttgtttttttatgagacggagtctcgctctgtcgcccaggctacagcactgtggcgcgatctcagctcactgcaagctctgcctcccgggttcacaccattctcctgcctcagcctcccgagtagctgggactacaggtgcccgccaccgcgcccggctaattttttgtatttttagtagagacaggtttcaccgtgttagccaggatggtctcgatctcttgacctcgtgatccacctgcctcggcctcccaaagtgctaggattacaggcgtgagccactgtgcccaggctttttttttttttttttttttttgtatttttggtggagatgttgccccggctggtctcaagctcctgagctcaagcgatccacccacctcagcatcacagagtgcagggattacaggcatgagccaccaagttctgatcaacggtactaaccgcagtttcaggcatccactcggggtcttggcacacattccccacggataggggaggatggctgtatcactccttaagagcaacaggcagccagggaccccagctcaacacccaccgacacatgatgtctactgtgttctgaacatgcataagcatataatttgaactgcattgttagccttcaggaaaggggcaccaggagctgtgctggccaggtacctagatcatttactgttcaaaaccaacccaggagctgagctactgagctcagcctccctctctcaaggctgggaaaggaaagttcatcttcactcagatgcaagcttcaagtaggcagagcagctgtctcttattcacccctgggcgggggcgggggggggaggggcgggttccagcacagcacgtggctcatgggctgagcctccagaagtattgttagtggatgggagaatggatcttcatatgggcttagagaggtgaagggacttgcacaaggtcacccagctagtaagcagggggtggagcccactttcaggtccaaactggcaagcctcagcataggtcactgttgctttgcaaactggcaaccctcagcataggtcacacagagggacaactgaacgttgtaggaccaggctctgcctccttctctctcccccgacccacctgccactccttggagctcctggctgaggcggagcttcacccagcctgagctgagcatgggcatccagaggcactccagtcggggtctgtttcacagaagcaggcccttcgtgaatatgcatgaggggcatgagctggcttccacgcatgcttcctgctcacctcatcctaaatcctaaacccgcagggccattgcccccttgacttgagcactagggtaaaatctatttttgtaaaaacctgatggaacttttacttaaaataagagttttaagtgtttatggaaacgaaatctatcttttagaagccactgcataaatacttaactgaagaagagtttggaatggggcaagcctgagtaggaatccgaatgctatggatcaccagaaacatcataacaggcgaattacctaccctcactgagcctcagttttcttgtctctaaaactaggataataacacctagctcactggggtgaatgaagattaagtcattacatttaagtgagatgatgcattgacttaatgtcttgaatactgtctctggcacacagcaatgaataaatatgtgctattactactgattctattaatgatacaatcataaaaatgactgcacaagaagggacctgcagtctcggctactcaggaggctgaggaaggaggatcacctgagcccagggctttgaggctgcagtgagctgtgatcacacctgtgaatgagccactgcactccagcctgggcaagataccccatctctttaaaaaaaaaaaattaaggccaggcgcggtggctcatgcctgtaatactagcactttgggaggccgaggcaggtggatcacgaggtcaggagattgagaccatcctggctaacacggtgaaaccccgtctctactaaaaatacaaaaaaaaaaaattagccaggcgtggtggcgggcgcctgtagtcccagctactcaggaggctgaggcaggagaatggcgtgaacctgggaggcggagcttgcagtgagctgagatcgtgccactgcactctagcctgggcgacagagtgagactccgtctcaaaaaaaaaaaaaattaaaattaaaaaaagtcatctggtccaaaccctcaatacaggtggggaaactgaggcccaaggagggtaagcatgttagataactcctgatagtccaacagcatttactgcagtgtttaaaaaatagtaggcacgaagtaagcgcattgaataaataataaccacatatgaaacaacatattcacctattcacctaatgtgcttcaaaacagttaaaaacaggtccagttgaatggcattccctctggctcctatccagaagaattctttaaagaaaagttctcaatgggagtcaacattcatcagcacccgcactgttcgctaaggcagccactagccttcgataatttcaatttatcaaattgaattcactgatactgaaatttcagtccactaaaatgaaataaaaccaaatattcagttcctcaatcacactagccacatttcaagtgctcaagagctgtatgtggatagtgattatggaacagcccagatatagaacatttccatcatcacagaaagttccagtggacagcacagctgcaaagagaagatatcattaatgtgtaatttctgttctcatccagcagatttagtttcctaaatcctattgcaaggcagcaggaagggaaagacctcgttagccttgctttattatgcaaatctgcatattcctgtcaagtccaatctccctcagaaagttcaaatagagtattattaggtggctgcgcgggtctacagggcaatgtctggggtctgagggcaggtgagagtacacaggattttatgaaaatgtgttctgtgcaaacacctcacttgtgccgctcttctccacaccagcaaactgagcattctttaacacagttcggcaaccgctggccaagcctcacttacataagagtgccataaaagactgggtcggctgcttctgcaaaacacctgtggttttgcaaaaggatgtgatttcttagaagtcagtaaacaggctcatttcctttacagttaaattttggcatcagaataccaaaatactctatgaccccacctaagctcacataaccttactccccaccttaaatggttgggagagcaaaaggccctgtgagctggaactgcccagggtgccagccttgctgctgggccagtggccaccatgcccacctccaccactttcctttgaggccccaggaggctggtacacactccaggagccaggaagaccacttggcacccttagctcctgggacactagaacacatggccaagttataaagacttcatatgcatcttctcatctggaggtgaggccctttcaaagcacacagggtggagaaacgtggataatatttcaccctctatgttaaaaagaggagaaatgaaatatatttgtatttgcttgttatgcctaaagaaatgaggacagcaggccaggcacggtggcttatgcctgtaatcccaacattttggaaggtcaaggtgggcagatcacttgagaccaggagtttgagccgggccaacatggtgaacccctatctctactaaaaatacaaaaaaaaaaaaaaaaattagctggatgtggtggtgcacacctgtaatctcagctactcaggaggctgaggcaggagaattgctttaacctgggagacagaggttgtagtgagccaagatcatgccactgcactccagcctgggcaacagagcaagactctgtcgaaaaagggaagaaagaaaagagaaaagaaagagaggagcaaaggaggaaaggaagaaagaaaaccgaaaaagaaaaagtccacataaaagcttatctctgaagattttttttttttttttttttgagatggagtctcgctctgtcgcccaggctggagtgcagtggtgcaatctcggctcactgcaagctccacctcccgggttcacgccattctcctgcctcagcctcccgagtagctgggactacaggtgcccgccaccatgcccggctaattttttgtatttctagtagagacggggtttcaccgttgttagccaggatggtctcgatctcttgacctcgtgatccacccgcctcggcctcccaaaatgctgggattacaggtgtaagccaccgcacccggccctatctgtgaagatttataacagatttactctcaacatccaaaaactggaggcaacccaaatgttcatcaactgctgaatggtacgtccataccatggaatactatggaatgctctacagcaagaaaaggaaatattaatacatgcaacatgaatgaatcaaataaatcatgttacacgaaagaggtcaaacacaaaagactccatactatctgcttccatttatttacaattatagaaaaggcaaaaccgcggtgacaaagcagatcagtggttgtctagggatggggaacaaggctgtctaggagggggaaaagggccaaaggggcatgaagggactttttagggtgaggaaactgttctataactcgattgtggtggtggcaacatgattagtaccaaaactcaaactgtacacttaaagctggttaattttattacttgcaaataataccctgattaaaaacaaaaaaaagaagaccctagaaatcttagctgtggttggcaggggagagtggaagacactgggcatgtgagaagagaaggcagtgttttatgtgtgttgtggtctgaatgctggtaccccctcaaaattcatatgctgaaacataatccccaatgccagagttaagaggtgaggcctttaagaggtgattagatcatgagggccccaccttcatgaatgacattaatgcccctataagaggcccaggggagctggccagccccttccaccatgtgaggcgctgtctatgatgcagagaacaagcctttgccaaacactgagtctgccaagaccttgcttacggacttcccagccttcagaactgtgagtaatcaatttctgttgtgtacaaattattcagtttaaggtatttgttccaggagcccaaacagactaagacaatgtatatatttttatttttgaaacctgtgactgaattgcctattccaaacttgagctctaattctttcaaagccaactgcagaggtgactctgtgcaatggctcaggtagaagtggtgtggtccattgctgggttcctgttggtcagggatataggcaccaaaagcttagagggtggggagaatgaaaacctctggatctaaccagagctgaatgtagaaaaccatctatctcctctcctcccagaagccagtgcctcctgtcctgggcctctgggctcatgtgataaagacaagagctaccatttattgggcacttactatgtcccaggtgctacgactcatttgacgtgcattaactcattaacagtgataagaccaacaacatgtacggagccctatatgtgctaggtatgacaggccttcttacctgcttgacctcatttaattagcctcaaatcgatcctatgacaaggaaccagtcccagagagttaagtgaagcccaaggctacacagctaaaagtgtaagggaacaaagatttaaacccaggcagtctggccccaggagcccagctaccatccatgaccaaggacaacccttttattgggacagaggcgacactaatcactgcacgcacttaggctgaggtgtggtgggtggaggatcagactcagaggtgaatctgtgctcctggcctactccaccagctccacagctccgccaggagggtctttcactcccacactggggaggcagagccagatgcatggagctattcaaggtcctgcctagctccaaagcccttactctttgcactagaccaggctgcttccttggctaataaacagtgagagctgaaacccaaacaaaaacaagcagcacacgtgaagacaaaatgttcctgagctgcaacgtttttcaatcttttgagctcatagatcacatgtctaggtcagagtcctgagcttcctcacggcgcaggtgatgtgagaggggctgagtaacctcgaggtaccactgaatggcatcctgcagtcactcaaaacgtgtgagcctggagggaccctggtgctcacatggtctgatatgcaaagaagaaaaagaggcatgggggatcgggaatagttcaacatcacccagcacatcagaggccaggatgcagtcccaagtcacgctccagactcctggtacagtgctcttttcacgcctgcagcatttcccatggcatgctgtgcaggccaatggggtttaagggaggttttagagagcatatggatgaatgcagtttaataattacctatatttaatattcataggaaaaatataactagcacatcaaacatgattttgtagatgtttctgcttacgaagaggctagatagcggtgttaggctcaggccaaagttttttgtttttgtttttgagagagggtgttgttctgtcacccaggctggaatgcaggagttattcataggaaaaatcctaacacacaagctccagggatcctcccgcctcagcctcccaagtagctgggactccagatgcaccatcacacccagcttttatttatttatttatttattttgtagagattgggtctcactatgttgcctaggctggtcccaagtgatcctcccaccttggcctcccgaagtgctgagatccaccatgcctggcaactacgggcactgtgcccagccctcaagccaattttaaggaaagcctcaaataaataataataaaagtagcatacaaatccagcaaacattgtgctggtagacagccacactgggctcattcctgcagtgcagcaggctaaagcaagaaggaataaaaggaaagataaagcaaacagaagggagaagggaggcaaagagaggaacagtcccctccagcggctcagctcttgcgctgaggagtgaggcccccacagcagaggacacggatgtgccacactcattctccctacaaacttatctagcctaagtcaccgctcttctcaccccaaacgtgctaaggtccaaaggtccaaacactgtgtatcagcccaatcacagggagcaaatggccctttaacacccgccctgagactactatcagaatggcctccctctatcccagtatgtgggacaggtatcagctcagatatttaatccattttcttgcctgagtgattcaggtgtccccattaaattctcttccatctgctgcatgcttcccagtgcagagaggccagagggcccccgaaagcctccccattcacaaaagcccaaatgaccagggctgttttggtttaaagcacaatttgggttcacataacacctcattatgcttccccgacatcgtttccacaccagcatcagatgctgggaactagagcttgaaaacactgcagggccgcagagctctcaagagctgtgcccattccacccctgcagggcctaagaatgcagccctcagccaggcgcagtggctcacgcctgtaatcccaacactttgagaggctgaggcaggaggatcccttgagctcaggagtccaaggctgctgtgagctatgattgagccactgcactccagcctgggtgacagagtgagaccccgcctcctaaaaaagggggctaggcactgacaatatgaactccaaactatgcatatagactaagacgctgaaacaatatattgaaaggttaacagtgctgctggcaagctaagattatgaattatttttgtttcttccctcttttctatattttcaaacttttccataataaacatactgcttttataacaaaacaaaaaaacacaataaacttttatttaatgatactatcaggttacaaagggctccctcctgatggggagaggggtcccttgccactggtgctcacactcaaccaagcgccatccactcccctccactagcctgtgggcctttcactagctcggggtccccaaggcctggaacataggaggcgctcagggaatgatgatacacaggggttgggggtggagtcgtgaaaaggaagtcaatgataaactctgaggtatcagctgtgcggcagggtggggcggagcagggcagggcagagcagggcagggcaggagagtgtactgaaatagaagagggtaaatcagagcctccttccacccaggacttccttctcagcatggccctgcctcccacccagctgctttgaaagctctcccacccctcactcttctggctcctctgagtttaaattagtcatttccccagcacccgccatgccctcctgggccactgagtcggcacacgccgtctctctgcctgccatgtctctgggcccacctctcctcctcctggcaaatgagccctctcacctccacttcaacaaaatcggtcccctgggacccgtgccttgaatctctcagcgagacgcctccttcaatgtacggctgcactcagacacagcccctgacagcaattatcttccattctacaagtctgtccgtctgtctgactggctcccaccaatggtctccatatagcgacggcaagtaccttttcatgcccacccccaagctgggcacacaatattaatcaatgtctctttgaatgaatggacagggagacgggtacgaaggccagcagtagtcaaaggaagcttggcggtgaagacgggatagggccaagccctgaaaggtaagacagaaagacacaggcaggagggaacaggcagggaagggggagccacaagctggtggtggccagaggattgtgggtgctctacagatgaacatcttttacggcagtagatgactatatgtttatttcagtgtgtactttctatatacagcaattgatattgttttccattcatggtaaggacaaagtttccttcctaaataatttaagttaaaaagtgaggaaacttaaagaaaaaattaataaataacagttctggcatagagattaatacagcaaaaaccatgagctaaccttagaacacatttttgcaggaagggagtcctctcaacttggccagaacagggagattgaggaagtgaagtgaagcctgctaggcagggaggatgagtcagctcagagggctctggggacaggcagtgaggcggcggccacggagagagcatttgtcagagcaaagtgaccggttcaagaaggtgcagagagaaaaaatactctacactctccctcctggggacttatctcaaggaaggaagatactcaaaaggaggaaaagaatacacacacacacacacacacacacacacacacacacacacacacgcccgcccactgcaagcaacagagagcacagtaaagggcttgcaaattgttcacttctgtaatgcccacaagcacccaggtcggggggtattccacagaaccacaagcccaggacagacggactactgtgcttcactcaacactagcacatcttccaaactacaacaccgtcttcacatgtcacatgttaatggctgcattccattccattgtggcttgagcacaagagtttgagaccagactgggcaacacggtgaaaccccgtctctacaaaaaatacaaaaattgctgggtgcggtagagcaaatctgcagtcccagctactcgggaggctgaggcaagaggactgcttgagcccgggaggtggaggctgcagtgtgctgtcaccacgccactgcactgtagcctgagcaaaagcatgagacgctgtcgccaaaaaataaaaaataaaaaatagtccattgcatagatgtgccaccatttttacctactgttggacaaccactttctccagtgtcttgttacgatgattcctgtccctatgtaccccataaacatgagctacagatcaaagggacctgggcttgaatctggacctttccttagatttcttcttgaactcaggccattggcattctgactgttcgacccaattgccacgaagctctctcacaatgtcctatttggaaaatgtggtctttccatgcatcactgaaaaaggatgttcaaagatgagctttgaaacaggcctaagtttatgtggcagaaaagactcacacaagagtgtagaatctagattctagagtgttagacataggacctgatcccagtgctccagtggtttactgtgggaccttggtcaagccccaaacccctgtgagcagtaaaattccatgacacagcagaggctgagggcaaaggcttttaaattcagagcagctgggttcaagacctgactctgccacttattggcaatttatataaagtctaaatctgtatcattctgaatttacataaaggcctaaattcataggatcccatgcttagaaggattctgggaaggaaacggaacggtgcatgcagaggaccaggtgaagtgcacaagaaccaatgccaccacctggcctgccttcctagctctgaggcctgctgaatgctaaggctgaggtgtgagctgcttgtacagtggcccccctttatcctcgggggataccttccaagacccccagtggatgcctgaaaccttggatagtaccaaaccctatatatactgttttttcctacacatgcatacctatgatgtttaattcataaaccaggcacagttattatcaataactgataacatcgaacaattctaacaacataccataataaaagctacgtgcatgtggtattctcttcaaaatactggactggggttgatggcgggtgactgaaattgcagaaatcgaaactatggaaaaaggggggatgattatacttgttccaaaacgaggcccatcacctaaggcttggaaatcactctttccccatttgtttccctttagattctgacatgtaatgaaattcaagtgggaattttatcagttaacccaatgcctcaaactgacactggagtaagtagtcaagcctcttgaagcactcggagcacagaccccaagggtgcagggctgaggatcccacactcacagtatttacatgtctatgttctgacaatcagtcacgtgatgggagggcccttcgttggaaccatggcaaccagttcttgtctgttacgtcgagaaatgcttcctcggctgggcgctgtggctcacacctgtaatcccagcactttgggaggtcaaggtgggcagatcacaaggtcaggagatcaagaccatcctggctaacacggtgaaaccccgtctctactaaaaataccaaaaaaaattagccaggcgtggtggcgggcgcctgtagtcccagctactcgggaggctgagacaggagaatggcgtgaaccaggaggcagagcttgcagtgagccgaaatcgctccactgcactccagcctgggagacaaagcgagactccgtctcaaaaaaaaaaaaaaaaaaaaaaaaaaaaaaaaaaaaaaaaaaagaaatgcttcctcaacaaccaatatgcatctcacagatagtatgtaaccaagataaaagtaggatccttgaggatattcccaggattctcctacgtgctctccatctggaatacagaaagctcagaaaccatgggccatcagcacacagggaaaaccagttctgtggcaggcaaaaggacaagggtattctagttagaaggttgataaacgcctccagataaagttattagaggaaggacagatgaaatcagtgtttaagaaaatgcgaggcctgtttcccaggaatattacctagtgcaaagtaggatgaaaaagtaagagaggttgtcatgaactgaggacatggagaccctactcatctcgaaggcagatgttgccatctacagcctagagctctaaaccctctgaggttagggatctctttcaacatctctgggtggctcaaacccttggggcatgaactaataacctgtcggttatgtaggcaggcagcagactgtggcctctgctcgtccctggccgcaggtgtaacacagccagggcaaggaaccagctggtcctgagtgtgaacaccagcttagccaatgacagctttatcctcatactatgctctattattccagagtctgcctggatgtgtgcagagaagaggaggagaaagggaagtgaggggcaggactatgcagtacccaaggactcaaaggtgattccagaccctgactaccgattagtagttactatgtagagaatgaggttccattttagatgaagagctgcaactactgcgctttcattcttcattttttttttttttttttttttttttgagctggagtcttgctctgtcacccaggctggagtgcagtggcacgatctcggctcactgcaagctccgcctcctgggttcacgccattctcctgcctcagcctcctgagtagctaggactacaggcgcccgccatcacacccggctaattttttgtacttttagtagagacgggatttcatcatgttagccaggatggtctggatctcctgacctcatgatccgcccgcctcggcctcccaaagtgctgggattacaggtgtgagccacagtgcccggcccattcttcctgcattttaagatgggttccaagtcattaaagcaaaactgagggagtcacctaagaaatactccactttcagctgcagaagtttaaaaaactctaaagaacatctgttgcaatcactaacataaagcactttcccctgtacatgaaaatgacatccttggatcagactccagggtgcctgcgagggacaagttttagaatctgaaaggaatggcttgaaaggccatctctgccccttcctagctgtgtgatgttttacaagtattttttaacttttcaaggcctccatatccacatctgcaaaatgggggcatgccaaggctatggtagtaattgcataaaataataactacaaggttaagcacagaggccagcctaatccaagtccccttgcatgataaaccccataagcagaagtgcaaaggcctgatcagcttaaaggagtggcccaagagcaagcaccctagagcctgaaagtcaggatctgtccttagtgtgatcactattgcttgcattttagatgtacagtatccttcagcacagtgatttttagatctggctgggcatggtggctcacacctgtaatcccagcactttgggaggccgaggcaggtggatcacctgaggtcaggagttcgagaccagcctgcccaacatggcaaaaccccatctctactaaaaatacaaaaatcagccgggcatagtggcacgtgcctgtaatcccagctacttgggaggctgaggcaggagaatcacttgaacccagaaggcggaagttgcagtgagctgagaccacgccattgcactccagcctaggcaaagagaatgaaattctgtcttaaaaaaaagagagagatttttagacccaatccaatggtgttaatagcatgacaaatgatggaattcctatggacaatcacaagcctgtattaaatgtccacatgggagaactaagctatagcattttatgtacattcttttttttttttgagacagggtctcactccatcacccagactggaaggcagtgatgtgatctcggctcactgcaacttctacctcccaggctcaaatgatcctcccacctcagcctcccaagcagctaggactacacgtgtgtgccaccacatttggctaatttttgtattttttgtagagacaggatttcaccctgttggccaggctggtctcgaactcctggctcaagcaatccacctgcctcagcctcccaaagtgctgggattacaggtgtgaactacctcaccgggccctatttacagtattcttacttaatcctctggactaccctggaagaggacaatagtatttccattttgctgctcaggaagttgaggctgagacatgaagtgactaggttcaagcccgcacagttcataagcagccacagtggggtgtggatctgggaggctcctttcgctatactaccccaggctgccttccaacaagccctatttttcttcctgcattcctttatcttgcccccttcttaaacctaaaccctgacacttcacatgccttagaatcaaacacctgcccttaaaatgaaatatcaaaccctgaagcagggcagcttgtaagtacggggcagtttaccaatgcaaacgggttagtagaagctgagagtgcctaggaagacctgccaccttcacaagaggagaaaatggaccagaaaataaacacagtacctgttgagggggtcgtgcgggtgacgaggagcatctaaaggcaccatactttggctgcctcaaaggctctgggtaccaaatgtaactggcatgcctgggtgggccacttacacccagagaaacaaaaaaattaagtcttccagaagagtgacttgtattatcacctgaaacaaaagcaccatttcaaacaacttgttcatggagaggcaggtgcatggtctgcgaggcccagaactgacaaggacctgcagggagctatggaggaggcgggagatcaggtgtccacactaagtccaagctcccaacacaaagcaaagggagtgtccacatgcgaagacccttccggctctaataacacactacgagtccatgtcactgataataacatcgtgttgtggttaatgttaataattatggttaacacttgcctggctttacacatattaactcatttaatcctcataaaatccatcagaaatatctacttttatgctcaccatttcttagacaaggagatggaggcacagagtgaagggaactgccctggtctatacatcttggacctgaagccaggctctctggctccagagtctgcccttcactgcccctggactaggaatcatgactgcctgggatcacatagaaactccaagaaagccaccagtgtgacttcaggccaagcgctcagcgcccaccatgtgcacagcgttcagtaaatgtcagctgctgttaggatcacggctcccaccacggccaaaccctgacaaggccagcaccactggggcagtcctgagcagcagaaccgctcaagagagcactgccccatctcgggggcagaccccgctcggctcctctgttctcgactgagagcctgacactgacaactgggtaggccctaggagaagccaggcttggccgagagctcaggcccagagatctggacatggctagtctcacagtggaattgcctggccccagtgtttagtctgtattaggttgaaccacatgaaaggctggttaattcaacccttttttacctaggaaaatggcaacttcatatggttcaacctaatggagggagggattcttacatttattaaggacctactggacattcagtcattcatctaacacctgtagagcaatggctgtgtcagggccagtgtgtaacactgcttcagcaccccaagactgagagccaggatttttcatcttccctcctaaggataagaaacaaacttaccaggcagaacaagggtaaccaactcgatctgcctgagctcaggtaactactaaaacaggccaattttggccaggcatggtggcttcacgcccataatctcagcattttagaaggtcaaggcgggaggatcccttgagcccacaagttcgagaccagcctgggcaacaaagtaagactctgtctctaaaaaataagtagatagatagatagatagatagatagatagatagatagatagatagatagatagataggcaggcaggcaggcactgtggcacatgcctgttatcccagctggcaggcactgtggcacatgcctgttatcccagctgcatgagaggctgaagggggaggactgcttgagccgaggaggctgaggctacagtgagccaagatggaaccatgcactccagcctgggcaacagaatgagaccctgtctcaatcaatcaatcaaacaggccaattttgtctttcctctcagaatccctgcatcttacactgtatatggtgaccagggctgggatggggcttcataggaaaaagccaaaggatcctgcaaggctttgtcacccaatagtccccatggagggctgtcgcaatgattaagatgtgctgctgccactcacgtcacaggcaggaagagccagggacactgacactactgcacaaagaaccgtcctgtccagtaggccaagccacacagtggccgacgctaggctaagactatctcgccctttcagctgagtggctatcttttggaaaacagattgcagttcacaaagttccatctccttgcatttcaacaagtggaaccaaaaaaacctcctaaacaaaacccagacctcttcagccactgtggctagacgtacaggggaacctctcggccccagtttcctcatctataaaataaacatccccatgggctggtgccagagaggcaggagaggggaattccatcagcatgcgctgagtgcggtggacctggacctccatggcaactgccattaactagctgggggcccttcagcaagttactacacctctctgagctccggtttccttatctgcaaaatgaggaaacagacctcacagggttggtgttgagagaattacagacaatgactgtgggcatccggtaaatactggcagaaggaaggggccactctgtgagtgaacactcaataccagcctacagactgaaggtatccttcatttcatggcatcccctgatgcctgtgccatgagtgcactcctcaagaccaagaatggactctgcttaaccacaccccagcccatcctctctgcctgaacaaggtctcaaatctcaggacaaccaggggtccacaccaccctgtgcccaaaagagatttcaggatagaaggtgtctggagggtatacactgaggacatgacaacagctcacattggaaattctcagcagaggaactaacagccaagcctggccgctgctcttttggagtctgagttcctcagtgtctcaagacttttcacaccagaaggatgtggtggattaaggctcctccttccagtttctgagcacaaaactgcaacgcagggagcccactcatgtgaaaccaacgacagcccatcagggtcaaagcctcacgacggagaagccttcagcagcaacactctacctgccaatcactgctgcaactgagaagggaaaagggcaccggtaccaccggaaaatgccactggctcaattctaattggaagctccagcagatagggtgcaatgcaaaagcatcttttcataactttttttgaaagaaagatggggtcttactatgttgcccaggttggccttgaactcctgggcccaagcgatcctcccacctcagcctcctgagtagctgggaccactgacacacaccacagcacctggtttaactttctattttaagttaaagtacttcacttggtaaatacgatgcctgaatccacttactagggctctgagacagcaagcccaaacactgttaaataagataccgagcctaactcaggagcatcatgctgagttcagcactagaagaggaagctgcacagagcaattgaagcagagggtggagaagtgcggggtctgagccagtggtaacaactgcttccaagctgcaatgtggtaagagctcttgagaccagaaaccctgggctgctgttttcagcagtctggtgtttaaacagaatgagccccttaagaccactctccttgggcaagggactctacatcttggagtctcagaagaaggaactagcacctgccttccaggctggttgggaagttaaatgaaacaccacctatcatccatccatgttaacagaataaccacaataataagagataacactcctactgcacttacaacgtgccaggcatcgtctacactttccacacataaactcagtcctcacaatcatcactacgtgccaggtgaatggcaaccaccagggttgttgccttacaagacacgtgacgacacaactgaaaacctaacactagaaagttgtaggcaaaggctcctgttcacaagcatccagagatgtcagaaacatgtggggtgaccataggaggaagcacggaaaaacgcaggcaagcagcctccctgcctgtctgacgctgtggacttccccaggctggttctgcactcactcctgagtctttcagaactttggacatacttgcttccacccgcttcctccatttaaccttaagactcagatggcatattctattaggtctacctgactgctcagtagacatccacggaatgaatgacccgatggaaaaaaatcactaaagggagcatagcgcagtgccaggactgccaggtgggcctcggtttcctcacctgcataatgagggtgacatgagaatctgcctcgtagggctggctggaatattaaaaagtcatcagtcaaaactagctcctggccaagtacagtggctcatgcctgtaatccccagcactttgggaggctgaggcaggcagatcatgaggccaggcgttcaagaccagcctggccaacatggtgaaaccctgtctctactaaaaatacaaaaaattagctaggcatggtggtacgcacctgtagtcccagctacttgggaggctgaggcaagagaattccctgagtctaggagacggaggttgcagggagtcgagatcgtgccactgtactccagcctaggtggcagagcgagactctgtctcaaacaaacaaacaaaaaaaaactagcttctgttattcctacagctgccatgcagagcccgccaccccaccatctccctcagcagactggtgtcttaggcaccagaacctaatgctgtgtgcatcaggctgaacttggtgccacctgcagtcacagagtcactggctggatggatcactgggctacccagactgaaatccccattcagttgttaacaggctctcaaggctttgcagacaccactatctaggatttagactgacctgaaatagctgtgtgtcaatgataaactgtccaatcagaacacctacatgggacagctctggggcagaccccctcagctccagaggtggtaaatcattccgtgtcactctgcctttatctccttccaccatcccttcctttccacacccacagctgcacagtggccaggaccctcataagctcacaagctgatgcttgtggaggcctctctcccatctctttcacctcccaggcctcctgcatgcacagccagagggctcttcctaaaataccaccgctctgccagcctcctcgaatttctacctgccctgtcaaaaatttcactggctccacactgtcccagatctaatgcaaactccttagcttagcaactcaggcactccacaactcactcctgagactgaggcaccccatgggctcgcatctactgcttgtgtgaccacaccccctgacctctgcttttgtgccagtccccttgaccataccccaccctgtcctctctgcctgagcacactcttcccaggcttcatgcccagcccccaagccgactgcaggctggagtggtctgcagggctgcgtggaggagggggaaatgcaagccaggcctgcagggatgggcagaccacagcacccatgggtccctggctaagtcttttctagtactacttcattcctgctgcacttggctttttggacgcatcttgcctccccctcccagattagaggacagggatgatggcttctatttgtgtcccttattctgtggtatgcagaataagacatgcaacaaccacagctactgtgtgccaagcactggagtaagtacattacaaatttcacccctactccccatctctataaaatgttatcctcatgcgacggaacaggaaaactgagaccaagggaattagccgcctcactgacagtcacatgctgagtggcagacaggactcaaatccagatgtgcccaactgcagagaccatgttctgtggagcaggcagccgcctctcagctctcactcagtgtttatgtagctggcgctaagtgccaggcggccagtgcaaggtgtggggtactcagagggaaccaaacagacaaggtccctgctctcacagagctcatatgctctgtccccagccctgtctctcttcttccaagcctggaagagggcaggaaccctccagtcacagggggttccactggcacaaacaaggaattcgggcctgacatatagcatgaggctctggcaacacatggtgcccagctcacagtgagcttgtctttaatggagaaaagagccccaggctctattaggtaagttgtgcgttcaaggcacaacccagagccagacaaactccaaagcagccatcggcaggcagtacggagtggagaaaaacggtttgctctggagtcagaaaacccaattcctccacttagtagctagacagggactaaccatacacccctttgcacacttttggaaaatggtgataataacaatagttaatgtttacatcactatgtgccagatgctactggatgcacttgacagatattacttaaccctcattacgaccttatgcagaggtactgttatcctaaagcagtctggctcctaactctattttcttgtactatgctgcctccagcctaaagttgaacctaccttgtcaggctgtggtgaggaccgttctaacagagtgcatagcatgtggctggtgctccataaccattaaacctccctttccttccactgaaacatgaatctgtgaaagcctaggtctggaaatagcatatggctctagctggtcccaatatgggtgatcttgcagttgcatcccctggaattccacaccgcaccctcactggtggatctgctgcaaggggaaatgggacaagatcctgtatttacggggccctctgctcactgtgttctggaaaacacagtgagtggggtccagcacatgacttgggctgacagggatccgaatcccaggcctgctgttcacaccggtcactcaagctctcaagcttcaggttccttgtgagtaaaatgggggctgggctataacctaagtcatgtttctgggtcacagcagatcctcgggtacccgggttggacaggctggacaaagctacccaggctggacttccaaggtactgtaaggtttcatttcggggccccagaaagccttggctgtgcagaggagcggactgcgtgcacgtgcaatccaattccacccaatggcagacacaagagaagacacaccccaaaaggcctgggagtggagcctggcacaagcccccagctttctcttcagtttcctgccatagctcatgcagatgtgcctgcaggtacactgaacaaggctctttcccccttaagctttaggtaacgatgacatccccacccctcaacaatgtgagccatgagggcagagatccttgtcttgcatcctcagcacataagcaccacagagtaggcacttaatacacaaaaagctgaattaacattatcctgtagctgcaggtaccccacaacatgcctcagtatttgcctaacaataagcatttcccagcctggagggagggcaggcttctaacgggcgaggcacctgccctgccaccatttccctgtggtcagtcatgtcctgttccccacctcatggaatgtaaaagtataggatgtctgagttataaataggagcatctgctttcaaagacacggcttatcatttccttaatctcaagccactgatcactgcctactttttataagcatgccaccaaaaagaggccaggtgggcttaaatgaacagggctgtatagacagacaagagggatgtgagttgaacaatgtgtcttatccacatcaagagacattaatgtcaactatgttgtttcaccttgtaacaataccaagttcccatcagctcctgccaggcaaaaccatctgtgagctggagcagcaattcctgagggggcctccctagtccccgttcctgctaaagcctcaccatcatcataactaagaataattcccaagtcagaaactgaagctgtgtaaggaacggtgctctgaaattgtacagcactcagacagtggtaagattattacctgctaagggaatgcaaataaattccatttgcctatgcattttaactgggaaggagaaactcatgccaacaaaaatcatggaattcattccaaagtcaaatgcattttagattctcaagtcactatttccctcaatggataacagagatctagctgtattctctaccatcaaatctactgaaaatgaaaaacatggtgatctgaattcatttacctacaatgcaacctcacaccaccacttctgtcctacgccaaccatctacaccggcttaatggtcagagtattcaaataggggataaacgtaacaataagcagtcagaaattacaaggctaagggatactaagaacaagtgactgagagaatgaatatgaaatccaagcaggtaagttcatggacacagacacatgccaaagagaacattccaagtggtttcttccaacgccaggtgctgttctaggccccacggatacagctgcggaaaacacaagacacaaatctctgccctccaagagctcattctggcccatgctaaatatgcctgtatcaccatacagctatttcactataaacatgatttcctatacaaaggatctaaaatacaatacatgggcaataaatactgctcctccccccttgccatgtttgaatatcccattttatgtttttcaaacggtatcattaaaccttctgacatacaagcagcttggtacaatgggaagaacagtttagagcctgccagatgggcttccactgaccaacagtggttcctccactggctgagcaacaccctgaataagtcactccacctcctgagcctcagctgcctcatctataaaatggggacagccccagaagggcttcctgtggatgaaaacagcttgtacaggtgaagcacaccacagtgactggcagacagttcctccaccctttccagccttttcagatgagagctgagtacaagactcctgagaagcttcaggtgtcatgtgctcctcctgggggactgaggcactttcccatcacctggcgagaatcgctgcttcctgccttatactttgtcctgagtgcacactcaggaaacttcagcccactttcaaagtcctcacccaccactgccctggagaagtcgttctccatcaaggcctggggccaggcccacctccccaaacaaggagttttcagccaaagttactggacaaatccgaaggccttaaaagtggcattgcccatgtttttaatcagcatacaggaaggcatcaaaagaaagcttaacccatctcaactactcaccctcgttcagcagcaacatcccttgactaaacaaggaaccatggtcctcaaaacactttgaggcccaaagtccacatacaaacatgctccaaaaatcccttgatcctgtcaggaagaagttctctggcccttccaacctaagtgctgggcctgtcctgcagaagggtcaagtggcaggagggcaggtctatctgtgggggcctatgtgaaaccccaggttcctcaaaagtctggatagcatctgccttctttaccaaaacaaacaccacgagcggagccagcactctccctaggcgttctgctcacctgatccgagggacttccataatcagcagttccaacccttgcaagctgacagttcagagggaaggggaggctgcgcctgcttgggtgcatcgtgtccaggccatatgctggatccagggcctggtggccccccaaggccacggcctcacaagggcgattgtgcgttcatccttgtcctgtgggccacccatcctcgcccctcggctcccactcaggcccgggcgccgtggaccccggcctgccctgcagaatgcttcgcacgcacagcacccacggcggcagcctcgagaagggcccgcagagcagcgcgctgccttctgggcacaccgatgcccgcccttccctcgctggctcctaggcggcctccctagaagcggcaactgagaaggcacagcaccgggaccaccccatccctgatggagagctcccctcgctccccaaaggctgcaaagaaggcgcgccccaggtacagggaaggggaccctgggtcgtgcaccaggcagggggcaggaccctgatgagaggctcagggcggggaccgagcggggctgacgcaggttacgctaggagtggcgaaaagtccagggaaggggatcatggtggggagggggcagtgaggtccagacgggggccatgggcggagaagaggaggtccagatttaagttcacagagagaagaggagattcaggctgaggccacggagaagaggggaagcaaacctaggccgctgcagaaggggctgaccggggtccagcctgaggccatggagaaggcaaagggggagggacagagggaggcagcggcctagcctgggccatggcagggagaaacgacggcctagcctgggccggagagacgggggaaagcagacctagccctagaccgggggaggaagggggcccacgccagggtcaccgagggggtgcctggctggggacacggttcgggagggagggtctagcctgggctatgggagagaccagcctgaacacagaggtagtgagtgggactccagcttgcgccaagggcgggggctgggagcgggggcagggtcactgccacccaagtcgtccgcgccggcggcaccctcctgggcggggagggaccgggtccacccagggtccgggaccccgcccctcccccaccccgggaagccacccgtcccaggccagggatgggcagggggagggggacgcgagctccggaggggcccccgggccggggagggggccgtgcggcctttaccatggtggcggcggcggcggcggtcccggtcccggcgtcagtggctctcccccccgcagcagggcccggcgcttccacttccccgggtgcccaggagtgaacatccgggtcagcacccccctccccccgcgccgggc

SEQ ID NO: 184 - DNA, 146800 bp, Homo sapiens; identical to SEQ ID NO: 183
  source 1..146800: mol_type = genomic DNA

SEQ ID NO: 185 - DNA, 33119 bp, Homo sapiens
  source 1..33119: mol_type = genomic DNA
tcaattgtaccttttttctttaaaaatagagctctttatttaaacagtttagggtaataccaacaagcagtaggatatcgtttaaatatgacataaacatagaaaaaatagaaataaatacaaatacataagaacaacatataccgttagtagtctaaagggatacatgttgctttcacctaaggcactaacacttttcacgggatatgcttccagcgcaggcccagcccacaccgcgcagttcccacctgctgtgcacgtgaaagggctttgtaaacagttaagtgctgaccacacaaggcaaattattatactgattatcatgccctttccaaatgcttctcctggctttttgtgaatgacttaatgacgataaaggagatggagtttagagttactggaaaacttaagctatgtcagaaattaaactctggaaaaaattctttaaaaaaatagtaaggtttggctgggcgcggtggctcacgcctgtaatcccagcactttgggaggccgaggcgggcggatcacctgaggtcaggagttcgagaccagcctggccaacatggtgaaaccccgtctctactaaaaatacaaaaaaattagccaggtgtggtggcgggtgcctgtaatcccagctacttgggaggctgaggcaggagaatcacttgaacccgggaggtggaggttgcagtgagccgagattgtaccactgcactccagcctaggcaaaaagaacaaaactccgactcaaaaaaacaaaacaaaacaaaaatggtaaggtttaagaatagaaacggagtggttatttcatacaagtctaagatgatgctgatgatagcttttacttttttgaagttacctccacgaagcagctcggctggtgccagagagaacatcggtacaggtctgggaatttccctgggagctggccccaagccacagccctccccagctccgtagtttgtttgttcttcctctcctgggctcaatcatctggacaagcctcactgcagggaaaacccctggggagacacaggtgtgtgtcgtatgtgtgtatgcatgtgtgtgtgtgtgccccagcagcggtgaaggcctcctgacccttagaaatcctggctgtgaccttcatattttactgacatggacaaggggtcagaggttggcccggctgtgcagagatcgaagctcttacccttggggatgtgcacaagtcatcagagcagcactgctgggcgaccttggacaagtgcctttgccacccttgacctcagctcctttgcaacaaaaggagtggtttgctaactttttcttgagtagtggatccctctaaacaaaacctcacgtggaaagccacagtgtgtgaatcagggcacagtgaggctgctctggtgaaagtgggaggctcctatagccccatggcgccccctgcaactgcagcccaaggcctctgggggacatggtttgagaatccctggatgagatgccctaagaagcttttccagttctgccatttaatgctgtacccttgtggtggctttaaagcaacacagctctgtgggttcaatggctttgaagatcccttcttcacaaatccagaaatgttagtcctggcaggttgaatggccacagagccaaggttgttcagatactccaccacaaaacacttcggtcctacgggtgaaaactcagctacgctcatctatattcaggtgggtgtaggttaactgaggatgcatcagcacccccaggtaaggatagtcacctgaatctagaaggcattggtttctcataactggaagggagaatgggacttctaaggaccacaacggtcaaccaagagtctaacgtgccatccaaactgggattacaggcccagaagtccgattcctgccatgttactgtcctactccaacaaactgggtccctagaaggtggagcagttggttcctcccctgggaagcagggttcccattgctaggtgaaggcggagagaccagggtccccttgggtggggctctggcttctgagagctcactctcctgactgggaggcagtgagggtagaaggaaggaggtagactggggatgagacaagctgaatgttaagtgctctcagtcactctgggtttaggggccacaggtgggagatgcccaggggtctcctggagcctggatagatggagaattctaccggccaccacgtagagagcacccaggacacagcaggctccgtgctacacacatctgagatcccctagaaccctcaccacacccaggcgtagctgcagatgaggaagccgaggcagagaaggaagatgtcttccccaagatcatacaaccagtgaacagcagagctgggatttgaaccccggtctgtctgacactaaaaccgtacagtgccatgactccaaagaccaggatttgaggacagccacccttcccttcccatccaaaaccctcagccaactggatttttatctgggcctaactaggggacccatgaatcaggaggctgagccctgggatgggggagttcagtggctgctgggaaaggcatgaggtatagcaggtgtgcctccagtggtctcaagttccagagggccccttggtggtgtccgcccttgatgtccgcagtgacctgacctcacctgtttcatgttgtccggggataatttttccccctggcctgtcaccctagggacaatgggggtgatgacaccccaccaacctctgacctcagcccaccctgtgtccacccctcttatagctcagcctaaagagggcgggtcacaggagggaggggcatcttgttgctcagcccgacaggcaaacagccgctaggtggacttcccggaagtgcaatgcccctccgccgcccaggggaggtacggaggctcttgagtttcttgggaagcccagtagtccttgcaaaggcagcagcagcatcagattcggtgggatgtcgggggacagctcacctggccatgtaatgccccaatgtccggcccctgtcctcggtcctctgggtgctctcagccccccagctgcccgcatcgctgtcctcaatttctgattccctcgcctcctcttcctcctcagggctgctttcccagcagaaggtcagtgtctgaagagaaactgggggtcccccagggaccagattcggctccggtggtaaggtgccccaggtggcccaggaggagaggttatcttctgggagctcttccaggaaacccgagtccttggagaattcaggtggtgggagagattcttggtgcccatccccacccggcccttggcctggccccttctcagccaaatagccagaggacccagccctgtcccaggaggagtccacagtgctggcccagcttctgtctgaagaatcccaagcagaggagccttcgcttgggaccagaggagccctgggcctccctgagtccaccccaccagcctccgagtgccctggagcctggtgctcttgccccaggaaagaaggtggttcaatgtagggctggaagctgacgccatcttctgtgtcctcctcatcctcctcctcttcgtcctctgcaaggtccttcttccatcttgtctgttgggtggctggggccctgactcgaggcgtcggcctgacccctctggtcagttccttttggggacagaggaacaagtcattcacggactctggtctgctgggctgaaaggttgccacagggtgtgtgtgtccagaaaagtcctgatttgggtaggggagagaaaagcagaaaatttaggctttcctgaagcataattatcatcatctgaattcccctagaaacagacctcagacaaggcttcaagtgtaagcagtttctttgggagatgatcccagaacacaccagatgggactgggggagcagccaggaagcagggtgttatcaagcagctgaccactagggctactggcacttaatcctgctggcaactcagggagccactgggcacacgcacctcagaaccatcccaggagggggacgctcctgggctatttacccacagtcattgttgaggaatggaagagctggtggctgtgacacttgcagcctgccacatgcaggggcaatgtgggctccagaggccagagaaagcccattgggtgcaggcgctgggagttgcaaatccagctggtgtgctcttaacaggaaggctgagggcacggggcagggcacagacatgtctacccgaggttgtcaccctgacagttagtgggattctcccacagatcctggagccaggaaatttggaaatgctccctttgccaccctgccacgatgcagggacactcagaatccatcctcaaagcccccatgcccatcggagcctcgcatatgcccaagctgcccctgccagccctcatctgaacagggccgacctatatcacctcctgggcttcccctgccccagctcgcccctaggttctaagggagagacccagcagaccagggaagaaactccaaggtcagccaggacacagcttatcctgggttaaagtgtgaactaaaaattggaactcttttaagatgtcccctttggtgcctcctctcctccccttttgagtgtctctcctgaggtccaaggccaggggctctgctctcagcagctgacacatccttagcagaggtgaagttatttatctcaaaggaacttaaggcactgctccctccagggcctgtttgccattttattcaggactaaatgaatgcattactaatggtggaaattcagacacaaagatagatgttttggtccaagagtctggaccatcttgatattctatctgaacaactcatagctccagccccactcccttactctcaacccctccccacctgctgcacacccccagatttgctataccagggcccgtggcatctttgcccgctgaaaccaggggttccccatgagggtcttccagatcacaccccctgcggcaattactaacagcagtatcagaagcgatggcagcaccaggaaagcccagttggcttctaaggaaggaaaaataacaatgagagaaacaacaatggctcttgtctacaactgcacctgtgccgagtgcttcacatacatgaccctatttaatcctcacaagaataaacccatcctgcagactgtgcaaaccaaggtttggggcattatgtaagctgcccaaagacacacaatgagtgtggttttaatccaggcgagtctatctctaggctcatgttcttaaccactgtgtcacgaagctcccaaggcccagagggaaagtttctctttctgcaccacttgatacccacctgggacctccagcaagaagcaggtgggcttagagaacttgctgtatttcgggacactgaacgtgtagatggttctggcactgaggcagtggtgttcgctggcagctggctggagagtgatctggactggctggccatggggagtgactggaaatagggtctgtttggaaaagaagcagagagtggcagagctgctgtggggactggtttcacacagccaggacagagtggggttggcagacatggtagggtgttttttttttgttttttttttttgtttttttgtaggggatagggtttggttctgtcacccaggccaaagtgcagtggtgtgatcacagctcactgcagcctcaaactcctgggctcaagcgatcctcctacctcagctctccaagtaactagggactacagatccacaccaccatacctgggtaattttttaaaattattttttgtataggcaaggtcttgctgttgcccaggctggtctcgaactcccagcctcaagtgatcctccctccttgcctgaactttctattcttttcctgcattaaagtttaagcattgaggaagcacttcccaagactacctgagttcttttcagctgagtctagaggtagggatagccatggttcaaaagcagcctaccacttggggtcgccctggcgtgcaccccattaaggtccctacttcgaggagcagattcttcaggctttccatcttggggtctcctagtctatcagcagtggaggaaacctctacagatgctgcactgtgtggtatggaaggcactggccacgcgtgactactgagtatgtgaaatgcatctggtccacactgagaagtgttccaagtacaaaacacacatcagattttaaagacgtagtgaaaaagaatgtaaaagatctcaatcactatcagaattgctcattgaaatgataccattcaattggatgaagtaaaatctgttattaaaattcgatttacctgtctctttttacttaatttaacatggaacacttaaaactgcacatgtggcttgcattatatttctttctattgggcagtgctggtctagaatatttgtgaggttcttgaaggcaggaaccacgctggattcggatctatattccccagaacccagagtatgcaaaaatcgggagtgtgaatgttactttagtggaagcaagaacattcaagagcagaggcccagggaccaagtctggttggccacttgtttatgtaaaaagttttattttttgttttttttgagacaaggtctcactctgttgcccagactaaagtgcagtggtgcgatcatggctcactgtggccttgcttcctgggctcgagcgatcctcctgcctcagcatcccaagcagctgggaccacaagcatgcatcaccacacccagctttttttttttttgtagggataatgtttcaccatgttccccaggctggtcttgaactcctgggctaaggtaatcctcccaccacctcggcctcccaaagtactgagattacaggcatgagccaccgcacctggcctgtaaacagttttactggaacccagcgatgcccattcatttacgtataggctacggctccttttgtgctataactgcagcgttgagtagtcctgagcgaacatacggcccatgaagccaaacatatcgactatctggccttcttcgggaaagtctgccagcccttgccataaataaatgcagctatacacacatgcatacacagaaaacaaatctgaaattggatatacaccagagtgatgtgtggtcatctctgggtacttttggtctgcttcttagagcttatctgtatttttcagtttttctgtactgaatctgttgacttggcaagcaggcctcctgtaggtcatcatactttgatcagattttattagggctgactgccagaagtcaggagtgtacagggaagacttcctggaggaggggtgcaggagcaggctgggagggtgagaagaacctgagtaagaaggggtggaggagcgggcctagcctgggggcaggaaaggagcttcccaccttgtttccggccccctccttccagaatgccacctcatacttcagatccagtgggggcatgcaggggggcagctggtacgtggcattggcactcaggatctcctccgtctgggtgagcaccaggacaggtggggccggctccactgcagaaacagagcaggacctgtcagtaatcccgaggggccgcactgcctccatcccccaagaccagagagctctcttggaaatggaaaagcaactagcatgtttcaaacacttcttgtgcacctagcaccttataatctgttatttcagccttgcactgaccctgggagggagatatcactactctcatttcatagagaggaaaactgaggcttagagaggagaggtgacctgggcaagctcattgctgacctgccttctctcatgccatcccatccgcctgggtgccctccacatgtcactggcctggcagatcctgcccatctggattcattttctattgctgtcataacaaattaccacacacacagtgccttaaaaatgatacaaacttattatctcacagttctctaggtcagaagtccaggtgggctcagctggttcctccgctctgggtctcacatctggaaccgatgggggagaagacacttccaagcccccttgggttgtcagcaaaacttagttctttgtggctgtagggctgtggtccctgtttcctggccgattgttagtgggagcctctcagctccggaaggcacccacatttttcatcacgttaccactccatcgtcaaaccagaaacggcaccatggagtcctgtttatgcttcaaatctctctgacttccccttctgccacttctcttctgcctccatctggagaaagttttaaaggctcatgggattagattgggcccatctggattatccaggataacctcactatttgaagatctatgtctcagtctattttgtgttgttattacagaatatcacaggctgggtaatttataatgaacagaagtgtatttggctcatgtttctggagacttggaagtccaagagcatggcactggcatctggtgagggcctttgtgctgtgtcatcccatggtggcaggtggaagggcaagagagggtgagagtaagccagcaagagagggcagaactcacttttcttttcttttctttctttctttcttttctttctttctttctttctttctttctttctttctttctttctttctttctttttctttctttttctttctttcttttttctttctttttttcttctttctttcttttctttctttctttctttctttctttctttctttctttctttctttccttccttccttccttccttccttccttccttccttccttttctttcttttctttctttctctttctttcttctttctttcctcttttttttttttttttgagacagagtcttgctctatcacccaggctggagtgcaacggggcgatctcagctcactgcaacctctgcctcccggattcatgcgatcctcctgcttcggcctcctgagcagctgggattacaggcgcccgccaccactcccggacactttttgtattttttagtagagacagactttcaccatgttggccaggctggtctcaaacaactgacttcaagtcttggccccgcaaagtgctgagtggcataagccactgcccctggccagaactcactttttaacaatccattcttgataaacacactcccgcaagactgaccttaatctattcatgggggcagcgttcttaaggactaaatcaccttttaacagggccacttcttaatgcaatcacaatgatgattaaatgtcaacaggagttttagaggggacattcaaaccataacagtctataacgttaattaagattcctactgccacgcaatactgacatctaacatattcttagcttctggggattagggcagagcacctttagaggatcattctgcctaccatggtcttccctctgtcccccacccaaaatccacatctctttcttttttctttttttttttagatggagtttcactcttgttgcccaggctggagtgcaatggcgtgatctcggctcaccgcaacctctgcctcccgggttcaagcgattctactgcctcagcctcccgagtagctgggattataggcatgtgctaccatgcttggctaattttgtatttttagtagagatggggtttctccatggtggtcaggctggtctcgaactgccgacctcaggtgatctgcctgcctcggcctcccaaagtgctgggattacaggtgtgggctgggattacccaacccacatctctttcaaatgcaaaatccattcactccatcccaatgtcccccaaagtctcatctcattacagcatcaactcaaattcccaaatcaacagtatctaagtcagagtcaaatagactctgggcatagtccagtcagtacaactctcggggtacagtttctctctatctgtgggccagcaaaactaaagttttctgctcccaacataaaatgtgggacaggcacaggataacagttgcagacaatctggctcaagcatggggacatgaaagggacaatcaggtcatggtccaatgcagtttgaaaatccagccaagaaaactccattaggtttcaaggcctgggaagaattctctttcgctcttagcactgccctttgagcttctggtttcaccgtctgagatatccttccttttcactaaaggtagcaggtgtttgcagctaagtagttttaccagtctgcatctcaacagtagaaactggagagtccaacagccttctttgatttcatactctctgtgttccatttaatccaagctaacagtgtttctgtggatgtaaacgtctcaggaactttacgggtctcctatggatgtcatgggggaatccactgcattattagataaaagccaggtccacagatccttttttcagataagcccttctctacttttggctccagctgagatggctgagggacaatgctgttcagcttcctagaagtcccctggtttgattgaaggggactgtgagttataatcttaatctcttcaaagagccttttgagcgactgagtactttgatcttttatcttcctgaagtttggtataatcacatacttggctgtttctctatgtcacacttttgggagcaatctctttttttttttttttttgagatggagtcttgctctgtcacccacccaggctggagtgcagtggcatgatcttggctcactgcaacctccgcctcttgggttcaagtgatcctcccacctcagcctcctgagtagctgggattacaggtgcccgccaccacacccagctaatttttgtatttttagtagagacggagtttccccacattggccaggctggtctcaaactcctgacctcaggtgatctgctcgcctcggactctcaaagtgctgggattacaggcatgagccactgtgcccagctacaatctcttaattttattgttttttgcataggttgagaacctcccaaatcatcaagtcctggttcctttctgtttaagttcttccctcattttctctctctcctcttgcattttactataagaggcaggaagaaaccaggccgtgccttccacattttatttggaaaccttctcggataagcattcaaattcatcatttacaagctctgtgtcccatatgactgcaggacacaattctgctaagctttctgccagtacagaacaagtttcttcctttctcaagttttcaattacacgttccttaccttgtgaagcagtgccttgagtgttagtgcgtctactaacaggcttttcacgatgattgaggtattcttggaggggatttagcttttctctaaaatgctacttgtttctttctgcactctgagtcttcaacttccacattcctaccgatagtctgttgagggccttctagccttgcccagtggcttgaagatggagagggcaatgtgacaaggaatatggcagccagagaaaactaaatacaccacctttcaagttctaactaaaatgccacttcttccatgcagccttccctgattcccagccagcagggatctctgaccacactagtcacctttgccctgtgtttgtggtcaaggtaaacatgtggcttcttcatgatgtcattacttacatgtttaggaaacatccactgggtactgactaggtatcaagcttcaggaagggagctgaggggaatgcggagatgaggcctccttgtatcctgaccttcaggagctgaaagtttggggtaaatgaaatatgcaaactaccaaaagaaagtgaccacggccacatatgagagcagaaaaagtgtggagggagtgtaaaggcaggaaggatcaccctggcttgggatgtggggctgaagaatcaggagaaattcagggaggaggcaaaaaattaatgaaaacattttaaatatctttgtgtctttccctttattcttctaatgtcttattcctacccattcagcaattattgtggtttgtctgccattcttctagccagagagccttcctgtctgccttcttatccttcctttccttcccatccatccatccatccatccatccatccttccttccttccttcccaaccaccctttcttctcaatcatcctttctaaccaatatttttttcttcctatgcctcctttcttattattcatttatacttctcaccttttatctagccagtgagccttctaacctactcatccattcttcccatacatccattcttcttttctctttcacctttctacacatccttccttcttgtctctccttccttccttccttgcttctccttcgctccagcccttccttccctgcctggatgtcctgcttttcttctatactatctacccacccatctcatccacccatctgccttttcttctgccttctgtgatggttaaattttttctttctttaagacagggtgttgctctgtcaccgaggctggaattcaatggaacaatcatggctcactgcagccttgacctcctgggctcaagtcatcctcctaccttggcctcccagatagctgggaccacaggtgcccaccaccgtacccagcgaatttaatttttttttttttttgtagagacgaggtctccctatgttgcctaggctggtcttgaactcctaggctcaagtgatctgcctacctcatcctcaaaggatcttcccaccttggcctcccaaagtgatgggattacaggtgtgagccacagtgcctggcctgtgatggttaagtttatgtgtcaatttagctgcactaagggatacccaggtagacagtaaaacattatttctgggcccatctgtgaggatttttccagaagagattaacattttaatcggcagatttggtgatgatctgtcctcaccagtgtgggcaggcatcatccaatccactgacggcccaaagagaacaaaaaatggaggaggaatggcacattcacattctctcttcctgagctggcacatcaacttctcctgtccttggacgttggagcttcctgttctccggcatttggactctgggacttatatcagtggcccctctgattgttgggcctgtggcctccgactgggggttacaccactgctcccctggccttgggccttcagactcagacagaatcacaccacaagctttcctggttgtccagcccatgactgcatgctgggggacatttttgtgtctgtgattgcatgagccaattcccataataaatctcctcttattataaattttttttttttgagacaaagtcttgctctgtcacccaggctggagtgcagtgtcgtgatctcagctcactgcaacctctgcttcccaagttcaagcaattctcctgcctcagcctcctgagtagctgggactacaggtgtgtgccaccacacacgggtaacttttgtatttttagtagagacagggtttcaccatgttggccaggctggtcttgaactcctgatctcaaatgatccatccgcctcggcctcccaaagtgctcagattacaggtgtgagccaccatggctggcctctttttatttatttatttatttattttgagacggagtcttgctctgtcacccaggctgaagtgcagtggcacgatctcagctcactgcaagctctgcctcctgggttcacgccatcctcctgccttagcctccccagcagctgggactacaggcgcacatcatcacgcccaactaatttttttttgtatttttagtagagtcggggtttcactgtgttagccaggatggtcttgatctcctgacctcgtgatccgcccgcctcggcctcctaaagtgctgggattacaagcttgagccaccgcgcccggctggcctcctcttagtgtatctgtatatatcctattggttcagtttctctggagaaccttgactaacatacttcctatcctccatctctctatccacacatatttccttcctaataggcatctatccttccatccaacctccttccttcccatttttccattgcttcctcctccatcccctccatcctccctttcttcttacccatctgtccttcccttcttttatccatccaccgagccagcttctttccacacgaatcatctcttcttccttctctaccatctcttcctgctgccctgcaatcagtctgtccctcttctctcttaaagccttattttgtccttgaacactgtgagaagcccgggcagcaagttacagctctcagctctctgaggacactgtctgggcatttatcctccctttgttacccggccctgcccgaggtcagaaagatccagttcacatctatgtccaccggttactagcggtatcaagtccactggttactagcggtatcaagtttcttagcttctgtgagtctcaggttgatggaaatgaacctcacaagtttgctgtgaagattaaaaatagactgaaaaaaaaaaagtgccctcctcacccaatgtcaatacatgatttctgccagtaagcatgggacatttttttttctatcatctttacccccccaccccccacaaatttctacagtgtatagaaaatacttttgcaaacagaatttgtttttttttctttgtttattaatttttttcttttgagacgctctgtcgcccaggctggagtgcaggggcgtgatcttggctcactgcaacctccgcctcctgggttcaagcgattctcctgcctcagcctcccgagtagctgggattacaggtgcctgccaccaagcctggctaatttttgtatttttagtaaagacggggttttgccatgttggccagggtggtctcaaactcctgacctcaggtgatccacctgccttggcctcccaaagtgctgggattacaggcgtgagccaccacgcctggcccagaattggttttaaacattgtttttaaggagagaagctgaacataaaaaataggaataagcatataaagtgccttgtgtagtccatgaccaaaatggtgctcaactgaaaataatgaacattgttagcagagggtgcacgtgagattgctggtgctggctggagctcccctaactccctgacaggctgccagacatggtccctcgctgttgctggtcccacaccccatctcaaagggcctggcccagggagctgccctctgctttggggaagtgggagacagatggtcaggagaacagaaccactgagcactgagcacagctccccgatgggatggacagccttccactcagtcccttacccacagacctaccttcaaaaaggtaatccaggtattcggactccacccagggggacttggagctgggagaaaccgtccgcacgcgtcccttgaacttgttgtacaggtcctgtttcttcaggcacatcatagaacatagcagctccttggttcccgcacactcttccacttcgcgccaccgtctacgggtgggagagctgggggaggagagaggagagcttgggccatggactcagcctctccgggtcagggaacttagagaacagttgatcatgcttccctctgtttggctggactgactttaggtccatccgtccagacaggcagccactggctgagacaggataagaacagcctggtcaggagctcaggttctggagccagatggatgggagtgggaatcccagccctgtccctccctagctttgggaccatgggcaggtccttgcccctaaacctcagtttcctcatctgtaatgcctccctcacaggactgttgcggtggctgctattcctagtactagcgaccattactatatgtttgttcattcaggcgtttatgggccacctgctgcatgccaaggaccatgataggtactctgtggatgtcagaggggaacatgcaggtccatgactccaacctggatacttcagagagctgcctggcccttctatctcttctgccacgtgaggacacagtgtttgcccttccgctatgcgaagacgcagcgagaaggcaccatcttggaagcagagagccgcccttaccagaacggagtcaggtgccaccttgaccctgaacttcccagcctctagaactgtgagaaggaaattgctattatttattaattgctattatttattaatagcaattattagaattacaccattctaaggtattttgttaaagcagtacaaatggactaagccagagacccagggagcctaacattttattttaatttttattttttgagatggagtcttgttctgttgcccaggctggggtgcagtggcatgatcttggctcactgcaacctccgcctcctgggttcaagtgattctcctgcctcagcctcccgagtagatgggattacaggccagcgtaaccacacctggctaattttgtatttttagtagagacagggtttcaccatgtcggccaggctggtctccaactcctgacctcaggtgacccacccgcttggcctcccaaagtgttgggattacaggcaggagccaccgtgcctggcctaacatgtttttacaagatcactctggtcaaccagcaaggaggccatggtagggatgtgagacaggatgatggtggagacagtgagaaagggctggattcaatatctattttggaggtaataatagaactaatagaacttgctaacggattggatgtagaatgtggggaaaaggagaatcaaggattgctcctgggtttggggagtgaccaaggatgaatggagaaggctgagatgggggctgacacaaagatcagattttgagaaagaaccaattcctctgttttgtttcttcatggaaaatgttatactatgcaaatattcacaccaaaggaaccagtgtagttatattaacaggagacaaaatacagacttccaagtccaaagcaatactaaagatgaaaagaacattagataatgataaatgattccattcaccaggaagacagaaaaattctaacttatgtgtgcctactaaacaacttcaccctctataaagcaaacagacaaactacaggtagaaagtgaacagccacacttacaacaagaaattttaatacatctcacccagcaattgatgaatagacaaagaaaaataaatacataaataaataaagaacaacacagttatcaagttggtctaatgaacatatacagaactaactaaacaaattggttgaaccacatgtgaactattaacaaaatattaacacaaagcaattcttaagaaattttaaagaataggtatctcataaagtatttcttctgattgcaaaacattcagttaaaagttaataacaaaaagagaactaaaggaagtttgaaaatttaaaaaaatatatattttttgagacagcgtcttgctctgttgcacaggctggagtgcagtggcacaaacatagctcactgcagcctctactcctgggctcaggtgatcctcctgcctcagtctctgagtcactgggaccacaggtacctgccactacacccagctaattttcttttctttttttttttgagacagagtctcgctctgtcatccaggctggagtgcagtggtgcaatctcggctcactgcaaactcctcctcctgggttcaaagaattctcctgcctcagcctcccaagtagctgggattacaggcacctatcaccacacctggctaatttttatattttagtagagatggggttttaccatgttgcccaggctggtctcaaactcctgacctcaggtgatccatctgccttggcctcccaaagtgctggtattacaggtgctgggatgagccaccactcctggcccagctaattttaaaaaaatattctgtagagagggggtctcactttgttgcctaggccggtctcaaacttctggcctcaagcaatcctcccacctcagcctccctaagtgctgtgattacagatgtgagtcaccacacctggccttaaaaatattttttaaaacaacccatagatgaaagaattataatggaaattaataaatagctgaaagtgaatgatcaccaaataacacaaatgaaaacgtataagacagctaagtaatacttagaggaaaacatatagctttaaatacttataatagaaaataagaaagaatagaaattaataagctaagcaataaatgataagaagccagaagaaacatgtcacaaaaacatatccatgaacagatcaaaactggaacctgatacttcaaaatgggcaaaagacagtaaaaagtgatgcaggacaagaaaaaaccacataaaacctaattagaaaaactcagacacagaaaagaattatatatatttttaaaaagcaaaattcatttcagaagtgaagaataaatcagaaggaatacaagaacaaattaacacaatagatgatgccttaaaagaaacagaaggcaagaagaaggaaagttaaaaaaatatgtaaaagctaaaattatagaacttccagaagaaagcatagaagaaaaatcttcatgaccctgggtcaggcgaatattgcttaggacaccaaaagcgttaactgttgaaggaaaaaaatctgatatattagtctgtgagggctgccatggtaagacaccacaggcagggtggcttcagcaacagaaatctggaggctggaagtccaagatcaaggcatcagcaggtttggtttctactgaggcctctctccttggcttgcagatggccgtcatcttgctgtgtcctcacaaggccgttcttctgtgtgcatgcgctcttggtgtcttcctcttcttataaagacaccagtcctattagattagggcccacccttatgatctcattttactttaattacctccttaaaggctcatctccaaatagtcacttagaggttagggcttcaacatatgaatttgtggggtagagtataattcagtctataacacctgatatactggattttatcaaattaaaatatttttctcttccaaaaaaaaaaaaaaaacccaccaaaaaagcctaacgaaaatgaaaaggccagccactggggaaaaaaatcacaatacatacactgataaaggatttgtattcatagataactcaataataagaaaataaatgacctaataaaaagtggaaaaatatttgaatagtcacttcacaaaagatatatgaatggccaataagcacatgaaaagatgttcaacatcattcatcattagggagttgtaaattaaagccataataaaatactactacatactcactagaatggttaaaatgaaaaagactgataatactaagtgtaacaagcacatggagtaactagaactctcatgtattgttggtggcaatgaacaatggtacagtcactttggaaacagctcgacagttccctgtaatagtacacattcattacctaatctcctaaatcttaaccctagatccatttttcttctccctccctccctccctccttccctccctctctttcttctttccttcctcccctctctctcttttttttagagacagagtctcactctgtcacccaggctggggtgcagtggtgcaatcatagttcactgcagtctaaaacccctgggctcaagggatcctcccacctcagcctcctgagatggcagggctacaggtgtacgccaccatgcctggctaattttgaaaattttttgtaaagatggggtctcactatgttgcccaggctgatactcctagatctttatctaagagaaatgaaaacatatccacacaaagacttgtacatgaatgttcacagcagcttaattcataatagccctattatggacgaattgagttcccccaaaattcatatgttgaagacctcatccccagtggtattgtgttttgagataagagctttaaagaggtaattatggttaaatgaagtaataaggctggggccctaatccagtaggactggtgtacttgtaagaagaggaagagataccagagtgaacacacacagagaaaaagccacgtgaggacacagcaagaaggcagccatctgctagccaaggagagaggcttcaggagaaactaaacctagcaacgccttgaccttggacttccaacctccagaattttgagaaaataaaattctgttgtttacccagactgtcgtactttgttatggcagccctagcaaaccagtgcagatttgggcaccagaaatgaggtgctgaggtaatcaatacctaaaaatgtggaagtggctttggaattgcataatgggtagaatcttgaagtttgaagtgcatgttagagaaagcctatattgccttaaaaagactattggtaggaatatagacattaaaggtgattctggtgaggtctcaggtggaaaagaggaatgtgttattggaaactggaggaaaggtgatccttgttataaagtggcaaagaactggttgaattgtcttctagtgttttgcagaaattagaagttaaaagttcattggctagccatctcaaaaatgataatataaaataaataacaaaaagataatttaaaagacataaacttggatgcttagcagaagagatttctaagcaaagtgctgaaggtacaacctggtttcttcttactgcttatagtaaaatgtgagagaagagatatatgaaaagaattggtaagccaaaaggaactagaacttgaagctttggaaaattttcagcctatccacattgcaaaaaaaaaaatgagaaagcatgttctggggaggacactaaggttgtggctagaacaaccttttgataaagagatcagaggtgcaactcatagacttaatcagccatttaagcagaaattagacatactgatgggattataccagcagaggcacttccagctttgactaaaggggacagagatgggacagaatgaaggaaggctgttggacttctgggattctaaagaaagggacaagagctggagctatttggctgtgaacacgcaatatccttcaagtatagggaaaaatttcctggaagatgattcagagatcagcagggttgtcactgccaccaaagacctggaggcaacactgtcccctccttagtttcagcaggctaggctgctgctaaccagtgactcgagggtagggtcaccacccagggcaaaggggatagggctgccgccccagtgggcccaaagggcagagcactgagccaaagagggctattcttgaaacttaaaatctaatggaatttgccctgcgaggttttagacttgcttgggacctgtcactctttccttctttcctatttttctcttttggaatgggaaagtctatcccatgcatgtcccatcactttattttcaaagcacataacctgtctggtttcacaggttcataagtggagaggaatttggcctcaggatgagtaacacctccagtcacacccatacctgatttagatgagactttggacttagagtagatgctgaaatgggttaagagttttggggctagccaggtgcagtagctcatgcctgtaatcccagccctttgggaggccaaggcaggcggatcacctgaggtcaggagttcaagaccagcctggctaacacggtgaaaccccatttctactaaaaatataaaaaattagccaggcgtggtggcgcatgcctgtaatcccagctactcaggaggctgaggcaggagaatctcttgaacccgggaggcagaggttgcagtgagccgagatcacaccattgcactccagcttgggcaacaagagcaaaactctgtttcaaaaaaaaaaaaaaaagagagttttggggctgttgggagggggtgaatgtattttgcatatgaaaaggacacaaattttgggaggccagagggcaagcatatggcagccctagcaaatgaatacctgcccagaactggaagcaacccaaatatccactgacgggaaaatggattaacaaatgtcatacatagtcatacaatggcattactactcagcaataaaaaggaattaactactgatacatgtaacaatgtgggtgaatttcagaaacattatgctgagggaaaggagccagacacgaaagggtacatactatacacatccatttatatgaaattctggaacaggcaaagtttaatccacagtgtcagaaagcagatctgtggttgcctagatctggaggcctgaatgcaaagtggatgagggaactttctggggtgatagagaacgtcttacatcttgattgtggtggtgggtacgtgggtgcccacttttgtcaaaactcatcaaattgtatactttaaaatgggaacagtttattctatatacattttaactcaataatgttggttttaaaagaaaattggaattaattcagcacggcaagctatgataagaaatgtgcgctcttagctacaaacatgtcagctaaaagcagactagagtttcaggaaaaataaatgtaaccaagagaaagattacaaataagatgttgaataatctcacacatggaagcatacagttttttaaaaactcaagagtgaaacctatttcatttagagagcagaatagtagatagatagacagataaaaggcatttgaaagaaaaagacaagtattctctcctttttctttaatttgagacagggcctcaccatgttgcccaggctggtctcaaactcttgggctcaagcgatcctcctacctatgcctcacaaagtcttggaattataggtgtgagtctctgtgcccaaaagacaaatactgaacacagaaaaagaagatccaacatacaagtgatatgagtccctaaagaagaaaatcaaaacaagagaatagaacaaatactaaaactataatttaagaaaaccttcctaaaataaaaatgccttggaaccatgtattaagtgagaatattgagtgcctaaaaatatcaactcagaatgaatgagcaataccaacacacagtcaaataaaattactagattttaaagaaaaagcaacaaccctttattagtcagggttctccagaggaacagaactaataggttatacgtatatatgaaagggagtttattaaggagaattggctcacacgatcacaaggcgaagtcccacgataggccgtcagcaaggtgggaaagaaagaagccatagtgactcagtccgaatctgaaaccctcaaaaccagggaagctgaaagtgcagccttcagtctgtgaccaaagatccgagagcccccagcaaaccactaacttaagtccaagagtctaaaggccaaaaaacccggagtgtgatgttcaagggcaggaggagcagaaggaagcatcccgcacgggagaaagaaggaagctggaagacccagcaagtgaagctatcccaccatctgccacctgctttccagccagcctggcagccagttgggttgtgcccacccacactgagtgaggacgagtcttccattcccagtccactgactcaaatgtcagtctcctctggcaacaccctcacagacacccccagaaacaaaactttaacagccatctaggcatccttcaacccaattaagttgacacctaatattgaccatcacaaaccctttgggcgaaaagagcaagaaactattaagaggcaagtatgtatgttttgggataaagaaaatgagtaattatgggtcattctagttctatcatgtcccctgtccttgagaaacaggattctcagtgtgaaagaaagaaaatatagatgtaccatagaagtcaggtaaaaatcctaaggaactaaatttagatgggaagcacccgtataactcattaggcattttatcttaaaaattatgtacatgtaggctgggtgcgatggctcatgcctgtaatcccagcattttgggaggccgaggggggcagatcacttgaggtcaggagttcgacaccagcctggccaacatggtgaaaccccgtctctactaaaaatacaaaaattagccgggtatggtggtgggcgcctgtaatcccaactacttagtaggctgaggcaggataatctcttgaacccaggaggtggaggttgcagtgagccgagatcatgccactgcactctggcctgggtgacagagtgaagctctgtctaaaaaaaaaaagtatgtacatgtgtgtgtctatgtggtatacacacatcactctgttcactgaaaacaccaaaagcaatagctaagtagtgatcagcatagctagcatgcagattatagtctttataaccatttcttactaaatggagaaatggctgactgcaggttttaggtcaggaattgtaccagagggacctggaacatcttgtcgtaatggacagctggaaaggtatctgttaaatctggaaagatttaacttgaccactagggtcaagttaaaaggactcaggagcaaacttgatgagactcccactggacagagatgaggcaattcaagcttcaatgagcagagtacgtcgcaatagactgaaaccaccaaatgtgtttaaatgcctgagttcataatgataataataaactagcaatcacctttgggagatgataaggaaccaattcattatcttgaaaattgataaaggaaaaaaattaagcatttatcctctcttgcctatttgaatagtatgactggatatcaaataccagatgagaggatacatctctttataaaataattccaactaacaaatgaaaaaaattatataattagaatatcaccattctaatgtataaaagacatgaaaaatatcatagaagttcagaggatagactttctttctttttaggatcttgctctgttgttcaggttggagtgcagtggtgtgatctcagctcactgcaacctccatctcctgggctcaagtgatcctccccacctcagcctcccaagtagctgggaacacaggcacatgctactacacttcactaattttttgtattttttttttttgtagagacagggtttcaccatgttacccaggctggtctcgaactcttggactcaagcaatctccccacccacctcggcctcccaaagtgctgggattacagatgtaagccaccatgcttggtcctagaggatagactttcaactccttaataaatttattccagccatactacgcccagctgtgtgactttgagcaacatgcacccttggtgcttcagtctcctcctctgtaaagaggcgtactgaacttgtcctcagagagctgctgtgagattaagttcattacatgtgttgacacagtgccagccacacagtaaatattaggtgttttctggcacctgataacgctcttgcttttgaaagctctcttgcagtctgtccctgctcaagccaggctcccatcactcacatgtggattccacacatggaaggatgacgtgatgcaacaggaagggcacaaatgttggagtcggacccgagttccccttctggctccatgacgtccttcctcagacaagacacagcaccctctgagctcaatcccctcacctctagaatggggaaaacacagagcctgcctggtcacattgggagaaggaagtgaaatattcacgtagggcccttagcacttggcctggcacaggacgggtcctgaggacacggtggtcccctcctcttcctgctttcccctcctcaccaactccaggtgaatcctcccgagcttctgcttctatcatctcactgtcctgctaaagaactctgaacgattcccatctatgttcgaagatggtggatctgcttccattgtcagatttctctggattcgctgtggctgcctgggcttccaaattgagaatgatcccatcgggaaaagtgtgaccatttggccaagcgcggtggcttacgcctgtaatcccaacactttgggaggctgaggtgggtggatcacctgagctcaggagttcgagaccagcgtgggcaacatggagaaacctcgtctgtattaaaaatacaaaaattagccagatgtggtggcatatgcctgtaatcccagctactctggaggctgaggcaggagaatcacttgaacccaggaggtggaggttgcagtgagccgagatcaagccactgcactccagcttgggtgacagaccaagactctgtctcaaaaaaaaaaaaaaaagagaaaaaaagtgtgatcattgagggatgcctaattgcccaggtaacagctcctctgctgtgtacctagttgcctcactgatcagctgggacagctccaagcacctcatccagccacttgagaatttcatcctctggcccccacagctacatccatgccccacaccaactttcctcaaagacttacccccgccccggcagactggtcacctgtacactgctcttcattcaacatcttccccacctccagacctttatcaaaagcccctctccaaatgccggccacatgccatctcccgtagggcccagagagctagccagtgctgcccacactgggtgcagctgtcccagagaagcccctccagcccccacccaccccctcagtcttcccatccaccagccgagagagtcccctctacctctgataggccacaaaataggtcacatcctgggggttgccaagccctgggagccatgtcaggtacacgctgaagttctgggagagcagcgtcacattctggggaggggccagacggggcctccctgggggaaagaaaggggtcatgaagcctggagctcctggctggtcttgactcaggccatcccaagctgaggggcagcacgaagggcaagcaggtgctcactgagtttgaggaaccaggagccactgactggctgtactgcagcccttgtgccatgagagaagaccctttgccaggaggggaggctcctgcacactctgggaccggagggttccagcagaacaccatggaacaggaacctaatggcctccaggagggagcatccttgaggatatcaaggaccaggggctctgtcctgttctcagccacatccccagagcctgcctgccatggcctcagcacatagtaggtgcacaataaacatctgttgagtaaatgaatgaatattacaataacatgggttacaccaaaggcttcctgaccggtctccttgcttccaaccttgtgtaagggagatgacacagcaaaggttgctgcctaggcattagaagtagatgccacactcagatggtccaagccagtggccagagataagaacttcgaggcatctctccctcccggcaaactgggctccccacttcccacccattcctttaaagggatcattcaagcatttgccctcaaacttaacctgacccacaccctagtcccttacataatatacttctcattgccacaagctctcactttctttttgcctgactcttcattcccgcttcatgtagcccaggatggaggatgaccctccctactcattgcaccttccctgctcaggatctgtaagtaataagcctttgaacttgttttgcattgaggtggtgtactgaatttgcaccttccatctcaggaacccaggcccagcccaggcctggttttccctgggttgctgggaacacagtctggctcccagcgccagagcaatggtcagacaggcataaacttggacatggatcagacaagagtcacagggacgtctgccagtataaacaagtgtgaaggacccccagccatgggttagacagctaggctattaggctgtccgccaggtaagaagtatttcatgggccgggcgcagtggctcaagcctgtaatcccagcactttgggaggtcaaggtgggcagatcacctgaggtcaggaattcaagaccagtcttggccaacttggtgaaacctcgtctctactaaaaatgcaaaaattagcagaacatgatggcacagggctgtaatctcagctacctgggaggctgaggcacgagaattgcttgaacccaggaggacgaggttgcagtgagctgagattgtgccactgcattccagcctgggcaacagggcgagactccattccaaaaaaaaaaaaaaaaaagtgttccatgaagggcacactgtaagtacccacgcccagttcgctggcattattcattagggcaggcttgccagccactctgctactggaaccctaatttagctggaggcgatcaaaagcccttgtcccaaggtggatgatcactaaatccacatttggaggcatgttactatggaagtttaggtgacacctatattcattatttatttcacaatttcatttttgtattcacatttcagatttgtgaatgcagtttttttcctgaaaattcattttaacttgaaagtatgtttttaattcccctgatgtaattaatggactatgtgcatatttatacctaggtgtgcttacatgttaataatgtatttgcatagttgtgagaatttcatattggactccatagtggtaaaaaaataaatacaggccgggcgtggtggctcatgcctgtaatcccagtactttgggaggctgatgtgggcagatcccgaggtcaggagttcgagaccagcctgaccaacatggtgaaaccctgtctctactaaaaacacaaaaattagccaggcgtggtggtgcacgcctgtaatcccagctactcaggaggctgaggcaggagaatcgcttgaatccgggaggtggaggttgcagtgagcagagatcacaccactgtactccagcctggtgacacagtgagactccatctcaaataaataaataaataaataaataaataagtaaacacaacatctgtcatatacatttcttttctgttggtttaagaaaatatctgacagctttacctacttctgcaggttcatccaagcccagatattactgaacgaatatattgatgtagagtatgtgttattttgttttcagttctgctctagatcataactatgtaaaaaacactgtcataatcagttatactaaaattcatgagcccaaatgtaagatgaaaagtctgcactgtagtctaaggtcattgctctatcaataattacattctcattttgatttacagaagagctttatggtagaaacaccagaaaacacctcatactattaaaaggctttttccccattaaaaaaaaaaatacaggtcgggcatggcagctgacacctgtaatcccagcactttgggacatcgaggcaggagaatcatttgagaccaggaatttaagacttgcctaggcaacatagtgagaccacatctctacaaaataaattttttaaaaaattagcagggcacaatggtgagagtaaggaggctgaggtgggagtttcgcctgagcccaggagttcaaggctgccgtgattgtgccactgcacttcagtctggccaacagagcaagaccctgtctctacgaaacagacaaatatacaaaacaccttgccttcagtccattctccacatagcaggaaggattaaaaatgaaaatcagatcatgttcatcttctgcttaagccctctaaaggcttccatctcactccaggtaaactcaaaagtctttattatttttattttattttgaggcagagtcttatgctgccacccaggctggagtacagtggcacaatctcagctcactgcaacctccacctcccgggttcaagcgattctcctgcctcagcctccagagtagctgggattacaggcatgtgccaccacacctggctaatttttgtatttttagttgagacgaggtttcaccatgttggctaggctggtctcgaactcctgacctcaggtgatccgcccaccttggcctctcaaagtgctgggattacaggcctgagccactgtgcctggtctaaactccagagtctttacaatcaccaccaaggccctacccaatctgacccaccactcctcccttgctcccatatctccatccacacaggactttttgcccttcctggagcaccccagccacactcccaactccaggcctttgcacacgctgttccctcatgctgttccctctgccttaacagttctgcccctggatatccacctggctcactcctttgctgttttcacattcctttgatgtcactgtctcgaggacactttccctgactccctttaactgacctctattcccctctgtggcacattttccttctcactgttaatcttcatcttctgaaatacgcatctgattacaccactccccagtttcatgccctttccttggcctcagaataaagtccacatttgttattgaggtttgtgaggccctgcctgacgtggcctggcctggcctggccaggccgtcttgctgctctctccccaacagctaccctacaggctcatcaggcaatcttcctgctcgatgttgccaagccactgcattcttctggatgtttttaaacccaggtgtctttgactgcctggtattcaccatctagtctttgaaatacttgattcaaatgtcacttcctccagggaatcttccttgacatatctacgaggtgatgatgatgatgataacgatgatgataataatagcagctaaggccgggcatggtaactcacccctgtgatcccagcattttgggaggcagaggtaggcaaatcacctgaggtcaggagtttgagaccagcctggccaacatggtgaaaccacgtctcttctaaaaatacaaaaattagttgggcatggtggcacacgcctgtcatctcagctacttgggaggctgagacacgagaattgcttgaacccgataggtggaggttgcagtgagccgagattgcgccactgcactccagcctgggtgacagagtgagactctgtctcaaaataaataaataaaataataataataataatagcagctaatgtgtattgtgttctgtgagccaggttctgtgctaaacagtttacctgcactttctcttttaatcctcattacatccctaggaggtaggtattcattataataattataatcgttacagatgggaaaaccaaggccctctcagctattaagttgtagaatcagattcagtccaggcctagccaactccaaagtccgagctcttgactgtactttgtcttctaggttctcatggggtctattgagctttatgattccaactattccatctattgaccactacgagtcaaacaagatctgttgaccacggtgtgccaggggtttcaaagaagaacacaacttcattcctgccctataggagctcatggtcccatggagaattcagggtcctgaagtgtcccatgtgccatgatggaaatccatacgggttgcaaaatggcatcagggagggagggtccagttctgtggatggctgtccccagcctcggctgcctacccatcaccttctagacccaaaagtgggtgcctgcttccacctcatcctgtgtcctctagctgggactgtatcaccacgaggctagtgctattactactcccagcttctggacttcctaacgggtgaccagcaggagaccaggctgtctgcaagccacttgtaaggtatcctatgggcaggacagtccccagattcgagctaggtcacatgagaaaaacagcagttagagcaactttcctctatgaagccttcaaaggatgccaggcactagtttggctctttacatgtaaaacctcaatcacccttgggacagaccaccctatggggtaggtgtcattcattctgcttccatggaaagggcgctaggctcagagacagatgctaactaacttgcctgaggctacacagtcagtttgtgtgggagccagtatttgaacttagatctggctgtacttactcctaaatcatcacaccatagttagtgttgtgtatattaaatacttatcaggtgaaagtacaagaaggtctgggtttgacagtgaaaggggaacagaagaccccaccctccctccacacacaggtacacggtccctcatcagccacagagaacgctgctgtgggcactgggggctggagcatccctggctggcctagtgacccagtggatggacagcctgtcccacgtgcctaccctggaggcaaaagctagccaggcttgctttagcccctcttctctcttctgtgtgcctcacctctgccatccttcttgaggaattccctgaattgctctgagcctcagttttcccatcggaaaagtaaaaataatatctacctccgaggatggctgggtcgtgaggcttccagaataatgcggtgcctggcacaaagaagttgctgaataaatataggcttttatgatgattggattatgcccagggacctttacagctctttaaactgtgagtccaagactaggaaaatatcctgggggcgatttctggaccttctcttccctgcttcggttggagtcgtgggcggtgaggtttggtggttgggtcctacggcgaggaattttgtacctgacaccttactcatcagtagaggtgggaaaacaacaacaacaacaacaacaacaaaacaacaacaaaacaacaaccaccaccaaaagaaagccgtcttgttagaaagcagggcacaggcgaccagagctccgtcccaccagaggcctggcaggaacgggaagggacatcaatcggtcccactttccctgctgtccacactttagggtcaagtgtggttttcacgcagggatcagtgctttctttaggaaacattaaaaagcactttattaaaaaatatgcagtatcaaactgccgctgtcttttttctccagttctcctgaagctggaagcattaggaaactggattcgtttcctgcgggagaggaatatcaaagacccggttctgttcagtcctgggaagaagcaaactgggggcgcgtaggcagggccgattcgcacccggctcgggtggctgcggaccccgtgcctgtcccaggagctccgggtccgagggtaggcgcggcccggcccggggagccctcttccccctccctcccgcggccccgcgcccttacctggagcggcctgcagcaggcacaggagcagggggccccagcgctcgggccccgccatggccttcctgccgcggcgtccccgccc

SEQ ID NO: 186 - DNA, 33119 bp, Homo sapiens; identical to SEQ ID NO: 185
  source 1..33119: mol_type = genomic DNA

SEQ ID NO: 187 - DNA, 33119 bp, Homo sapiens; identical to SEQ ID NO: 185
  source 1..33119: mol_type = genomic DNA

SEQ ID NO: 188 - DNA, 130789 bp, Homo sapiens
  source 1..130789: mol_type = genomic DNA
ggagagaaaggacgcacgcttcccgccattttgttcagcttgccgggcaaccggcccctgctggggactacaagtcccgtaagcctccgcggcggcacgtcctaccctacactgtccagccggctccctttttccccctccccgggggccaagggctccggctgctgcctggcggccaacgggccaggtaggatttccgggagaggctgctgtggaggctgaggaggcggcggcggagatctgggtaagttcagcgagcaagggaaagtgagcaggacgcgctcagtatcaggctgcggcctcctctcaggctgcggcccctttcttggctctgcgagagggtcccggtccgggcagaaggtaacggcccgggtcgccgtcgcttcgggccagggcggggcggggccgccgcctccctcctcggccctcccacaacggtccaacccgggcttctccgcctgaggcagggcccgcgcaggctcgccctctccgccccccgagacttggctgggcccttttgtctgggctgcgttgctccccctttgtgtccgtgcatggagtctccgccacgggggagcctgttcccccggtccccaacagggactgctccctggggatccggttacagtaaccggatcgggtcaaagtacatttttcaaaaccgtcctgcctcagacctctgcacccctgctgggcagaacgggggcttcggagccaggcggagtttctgtaaaaacctggaggttattatttaactttcaaacatcagcctgggcggcttcagggcacgaaactcccgacgtttttcttggtggagagatgagattaaggaaaagaagcgacccctctctcccaccctctacaccccggctccgggaaaccgggaaggcatcgaatttgctgcgatgtctgtgcagctcacatctgtgatcggtggaccaaagaaccagtggtgaatggtagaatggcagttcacgcacctcccaaatctcggaggagagtgacttacagggcatcactgattgcttgcaaaaaaaaaaaaccctccagtgcttcattcggacactcagctcctcgctccttccaacctcttccttttcttgttctttttaaaacaaacagtggaaggaaaaagtccttcagtggaagaatttgctttatagaggaaccagaaacccagtggcttctagaagtcacttactttttcgccaaattaaagaaatgaatttcgggcgtggtggcgcgcgcctgtaatgccaactattctggaggctgaggcaggagaatcgcttgaggccagaagttcgcgaccagcctgggcaacacagcaagaccccatcttaaaaaaaaaaggaatgaagcccgtttagaaatgaagccagtttaggggatgaggtgtggtagattcttaccggaaaccgcggaactgcgtggattgtggattcgatcaaatttggctagataatggtaactgtgtatgtcctcctgttggaagactgcattgctagaatcagcttaaggtaaaatttgtttgtttgtttcatttaagagacaagagtctagcttggttgctgaagcttgagtacagtggagagctcctagttcactgtagcctcgaacttcttggcttaagccatccttccaccagaggctcccagatgcctgggactagaggcatgagccactgtgcccgactatttaatttaatttatttatatttatttatttattttgagacaatctcactttgttacccaggctggaatgcaatggcacgatcttggctcactgcaacctccacttcccaggttgaagcgattctcctgcctcagcctcctgagtagctgggattacaggtgtgtgccaccatgcccagctagtttttgtatttttggtagaaacaaggtttcaccatgttagccaggctggccttgaactcctaacctcaggtgatccacccgcctcggtctcccaaagtgctgggattacaagcgtgagccaccgtgcctggccaatttttatgtatttattttttgaaatagggtctcgctgggtttcccaggctggagtgcagtgagttgagcactgctcactgcagcctggacctcctcctgggctcaagcctctgcctccagagtagctgggacaacagacacaggccaccagcgcagctaattaaaaaaatttttaaaaaaatttttgtattgattggggtcccactctgttgcccaggctggtcttggactcctgggctcaagtgatcctccctcccaaagtgctggtattaaaccttaagataaagaatactgtatttgttttttgagatagagtcttgctctgttgctcaggctgtgcagtggcgtgatcttggctcactgcaacctcttcctcctggtttcaagcgattctcctgcctcagcctcccgagtagctggaattacaggcatgtgccaccactcccggctaattttttttttttttttagtagagatggtgtttcaccgtgttggccaggctggtctggaactcctgacctaaagtaatttacctgcctccgcctcccaaagtgctgggattacaggtgtgagccaccgtgcctggccaataaaaaattctaaagaaggtcattgcaaataacccttttgaaaaataggttaattcgtgtttcaagtctctgggatgaggacagccaggaggacccctttacatgaatcagggaaggttactgaagttagataggttaattcctgccctagccgagtaggcaaaataaagcccttcaccctgtattactttgtttgatatctcataatggaagtgacttactcttgagaatcctagattgtattagtaatactgtatagggatggtagatccttaatgcagttcttcaatttttaatccagcagtgagtgagggtcttttgtgttttcctggctatagtttgaagaagcaaccacagaattgctctagttttaataataaactggttgggcgcggtggctcacacctgtaatcccagcactttgggaggctgaggcaggcagatcacctaaggtcaggtgttcgagatcagcctggccaacatggtaaaatcccatctctactaaaaatataaaaattagccaggtgtggtggtgggcatctgtaatcccagctacttgggaggctgaggcaggagaatcacttgaacctgggaggcggaggttacagcgagctgagattgcgccactgcactccagcctgggcgacagagggagactcagtctcaaaaaaaaaaaaaaacacagaaataataaactaagaaacagcagttactattgactattgcttaattgtacaaacatgacaattttctcaatattatttatttttatgattattattatttttttgaggcaaggtcttgttctgtcccccaggtggagtaaaatgctatgatcatggcccactgtagcctcaacctcttgggctcaaatgatcctcccacttcagccttctgagtagctgggactacaggtgcacactaccacacttggctaattttttaatttttttgtggacacgaggtctccctgtgttgcccaggatggtcttgaactcctggactcaagcagtcctcctaccttagcctccgagagtgctgggattataggcgtgagccagtgtgtctagctatatatttattcatttattttgtttgttttaaacataatttttttttttgagatggagtttcactctttttgcccaggctgaagtgcaatggcacgatcttggctcactgcaacctctgcctcccgggtttaagtgattcttctgcctcagcctcctgagtagctgggattacaggcatgtgccaacatgcctggctaattttgtatttttagtagagacgggaattcaccatgttggccagactggtcttgaactcctgacctcagatgatccgcccacctcagcctcccaaagttctgggattacaggcgtcagccatcacgcctggcccataattttataatttttatagagacaggtctcgccatgttgcccagcctggtctcaaattccttggctcaggcgatcctctcacctcagcctcccaaagtgctgggattacaggcatgagtcaccatgcccggcctcccagtaccattttttaaacaaattaatacacattgtgtcatttaatcctcactacagttctgtgagatggttgttactctcattttacagctgataaagcctagcctctaaaatgttgaagtgacttgcccaaggttatagttaacccaggtaggaaatatcagagtaaaccatacttcaaatctagtcctctttcagttacctcacacttattacagctactaatcttagcagcaccaacagctttaatttgctaaaatctaaatattggagaaaatggaaaatattttccaattaaggcaaattgatttacaaggaactggaatttctggaaccataaacaatgagtctttctcttaaattatattgaacattggtcccattactttgtcttctcatatgctgtgattaccttgtgcctaggcagaatggcagttttatgcaacgctcaaaaagtggtgagttactcagttttggttccccctaatctttgctataaggtttattaaatatgttggagaacataaatacaatagctttggctgctgaaactaacattgaagacagaaccaaaattaagatactgtacttttttagtcagaccatcgggactcaagagaatgctctctctagtttctgcttttaataaaaacttttaatcagtttcaaacctgcagttaagtcttggatttatgttagtacatgccatgaatgtgacatcagaaacagaaacctatttcacctcccttacttattaggtaaaatgcataacatgccaatggaattgagtcaatacaattatgtagtctagcctttctaactggtagtagcctgtttgaaatcttttattattgcattataatgggaaagaactttttttccttgtgcttttgctgttggtttacttcatttccaaaaccatctgttcattcagtcaacaaatacggaaagtctgttatattctaggcactgttgtagacattgaggacaaaacagtgaaaacaagtattttccctcttggggtttacctactgattagggttggctgggaagaggaaggagtctgacagtaaataagcactaaataaataaaattccctcatataactgcaaccttgagcaactcaacctctttgagctttagttttcttgtctttaacatggatgtaattgattcctgctcttcctatcttgtggattgtttctaagagggagtagaataagtatttggatacattattcgcttcaaattcctgtagcaagttatttttactactattagaagaagaggcccagcacggtggctcacgcctgtaatcccagcactctgggaggccaaggcaagcagatcacttgaggccaggagttcgagacgagcctggccaacatggcgaaaccccatctctactaaaaataaaacaattagctgggggtggtggcccatgcctgtagtctcagttacttgggaggctgaggcatgagacttgcttgatcccaggaggcagaggttgcagtgagcagagattgtgccactgcacttcagccggggtgacagagcaagattccatcctcccaccacccctgcccgcccccacccacccccccaaaaaaaaaacaaaagaaaagaaaacaaggagcattggaagaagattatttataaagagagaggctgggcccagtggctcatgcctgtaatcccagtgcttcgggaggctaaggcaggaggatcactttatgtttatcccaggagtttgagaccagcctggcaacatagcaagactttgtctctacaaaaaaaaaaattaaaaatcagccaggcatggtagtggacatctgtactcccagttactcaggaagctgagataggaggatcacttgagctccacggtttgaggctgcagtgagctatgattgtgccaccacactacagcctgtgtggcagagctggagaccctgtttcaaaaaataagtaaataagtaaaataggaaagagagaagggaatggatggattctttattctgagggagctctaaagtcctgttgtaaaactttcacaatcggccaggcgcggtggctcacgcctctaatcccaggactgtgggaggccgaggtgggtggatcacccgaggtccagagttggagaccagcctgaccaacatggagaaaccccgtctctactaaaaatacaaaattagccaggcgtggtggtacacgcctgtaattccagatacttgggaggctgaggcaggagaatggcttgaactcgggaggcggaggttgctgtgagctgagatcacaccattgcactccagcctgggcaacaagagcgaaactccatctcaaaaaaacaaacaaacaaacaaaaaaaactttcacagccgtgtcttcacaggggctaccataaccaaattatgtagacctttttcttttctcttctttctttttcttttttttcactgctgtggtcccagctactcaggaggctgaggcacaggaatcacttgagcctaggaggtggaggttgcaatgagccaagattgtgccactggactccagcctgggtgacagagtgagaccttgtctcaaaaaaaaaaaaaaattgagacagagtcttactctgtcacctaggctggagtccagtgacatgatcagggctcactgaacccttgacctctctcccaggctcaagcactcctcccacctcaaccccctgagtaactgggactacaggcatgcaccaccatgcctggctaattttttcttttttttttttttcttttagtagagacaaggtctcattatgttgcccagaccagtcttgaactcctgagctgaagcgatccacccgccttggcctcccaaagtgctgggattacaggcgtgagccactgcgctgggcctatgtagaccttttaattttttttttgagacggagtcttgctctgtcgcccaggctggagtgcagtggtgcaatctcggctcactgcaagctccacctcccgggttcacgccattttcctgcctcagcctcccaagtagctgggactataggcgcccaccaccacacccggctaatttttttgtatttttagtagagacagggtttcactatgttagccaggatggtctcaatctcctgacctcgtgatccacctgtctcggcctctcaaagtgtggggattacaggcgtgagccagcgcgcccggccttaatttttttttgaaatgagttttgctcttgtcactcaggttggagtgacagtgtgatctcagcttactgcaacctctgcctcccgggttcaagcgattctccagcctcagcctcccaagtagctgggattataggcgctcaccaccatgcccggctaaattttgtatttttagtagagacagggtttcgccatgttggccaggctggtcctgaggttccaaactcctgaactcaggtgatccacctaccttggcctcccaaagtggtaggattacaggcgtgagcctccgcacccagcctttttttttttttttttgtagacgggagtcctgctctgtcacccaggctggagtgcagtggcgtgaactcagcacactgcaacctccgcctcctgggttcaagtgattctcctgcctcagcctcctgagtagttggggttacaggcgtgcaccactatgccctgctaattttttttttttttagtagagatggggtttcaccatgttggccaggctggttttgaactcctgacctcaagtgatccgcccgcctcagcctcccaaagtgccaggatcacaggcatgagccaccacacccagcccatcaaagctttttgaaatgatctgtaggccaggagtggtggctgcggcctgtaatcctaggatcatgaggccacaaggtggagttcaagactagcctggccaacatggcagaaccctgtctctacaaaaactacaaaaaagttagcttggcatgtggcacgcttctatgagtcccagctactctggaggctgaggtgggaggattgcctgagcctggaaggttgaggctgcagtgagccgtaattgcgccactgcactctagcccaggtagacagagtgaaagaccatctcaaaaaaaaaaaaaaaattgcttactatcttgatggttggtgagagggtttagagaaggtatttatgtacttgttaaaaatttttggccagatgtgttggctcacgcctgtaatcccagcactttgggaggctgaggcgggcggatcacgaggtcaggagattgagaccatcctggctaacacggtgaaaccccgtctctactaaaagtacaaaaaattatccgggcatggtggtgggtgcctgtagtcccagctactcgggaggctgaggcaggagaatggcgtgaacctgggaggcacggcttgcagtgagccaagattgtgccactgcgctccagcctgggtgacagagcgagactccatctcataaaaaaaaaaaaaaaaaatttggccaggcgcagtggctcacacctgtattcccagcactttgggaggctgaggcgggtggatcacctgaggtcaggagttcgagaccagcctggctaacatggtgaaaccccgtctctactaaaaaaaaaaaaaaattggctgcgtgtggtggcaagtgcctgtaatcccagctactcaggaggctgaggcaggagaatccctgaacccgggaggcggaggttgcaatgagccaagatcatgccattgcactccagcctgggtgacagagtgagacttcatctcaaaaaaaaagaaaaaagttttttttttaaccatttttttgtttttctttctttctttctccccccagccccccccccctttttttttaacaacccaagggcacaagggggaaaaaatagaggaagtatttagaatgttttgttttgttttgattttaaggatgggagaggtttgacatgtttgaagggaaagggaaagcagccagcagagaggcagatattggagatgtgcacagagaaaatgtagataatgaagaagtcttaggaggaaatagaatgaaaagctcatgaaacagtaaactttgaagaggaatatgaagaaataaagggtgagagaagatatatttggaagtggtggacatggaaggtgaaataagagtagttgttaccagttgattactgttattacccaggcactgatctaggtttatttatttttatttttatttatgtatgtatttatttttttaagacagagtcttgctctgttgcccaagctggagtacagtggcacagtcatggctcactgcagcctcaactcccctgctgggctcaagcaatcttcctgtctcagcctgctgagtagctgggactacaggcataccgccatgcctggctaatttttgggttttttgtagcgatgggatttcgccacattgcctaggctggtcttgaactcctaggcttaagcgatcttcctgcctgggcctcccaaagtgcttgaattacacgcatgagccaccatggccagcctataatttctttctttcttttttttttttttgaaacagagtctcagtctgtcacccaggctggagtgcagtggtgcgaccacagctcactgcaacctctacctcctcaggctcaggtgggtgatccttccacctcagcctcccgggtagctgggactataggtgcgggccaccacgccaggctgattttttaaaatttttgtagagatgggatttcgccatgttgcctaggctggtcttgaactcctggtctcaagtgatccatccaccttggcctgccagagtgctaggattacaggtgtgagcccctgtggctggccctggcctataatttcttttcttttttttttttttgagatggggtctcgctctgttgcccaggctggagtgcagtggcacaatctcggctcagtgccagctccgcctcccgggttcacgccattctcctgcctcagcctcccgagtagctgggactacaggcgcccgccaccacacccgactaattttttgtatttttagtagagacggggtttcaccgtgttagccaggatgatctcgatctcctgacctcgtgatccgcccgcctcggcctcccaaagtgctgggattacaggtgtgagccaccgcgcccagcctataatttcttatattccataattgtaaaattatttttccataagtggagtaaatattatattctcaacttgtgtttctattatcaacttttttttaacttttggacagactaatttagatgtgtgggataaaaatgttattctgtgtttttttaaatgtaactttttttttttttttttttttttgagacggagtctcgctctgtcgcccaggctggagtgcagtggcgcgatctcggctcactgcaagctccgcctcccaggttcacgccattctcctgcctcagcctcccgagtagctgggactacaggcgtccgctaccacgcccggctaattttttgtatttttagtagagacggggtttcactgtgttagccaggatggtctcgatctcctgacctcgtgatccgcccgcctcggcctcccaaagtgctgggattacaggcgtgagccaccgcgcccggccttaaatgtaacttttatgttcagagatatatgtgcatggtttggtatacaggtaaacttgtatcatggaggtttgttgtgtatattattttgtcactcaggtattaagcctagtgcccattagttatttttccagatcctctccctgctcccatcctctactctccaataggcaccagtgagtgttgttcccctctgtgtccatgtgttctcatcatgcaatatttggaacatgtgatatttgtttttctgtttctgcattagtttgctaaagataatggcctccagctccacccatgttcctgcaaaggacatgatcttgttgttttttatggtggcatagtattgcatggtgtatacataccaccttttctttatctagtctacttttgatgggcatttaggttgattccgtgtctttgctgttgtgaatagtgctgcagtgaacatatgtgtgcatatgtctttataatagaatgatttatattcctttgggtatataaccagtaatgggatttctgggttgaatggtatttctaagtctttgaggaattgccacactgtcctccacaatagttgaactaatttatactcccactgacaatgtataagcatttctttttctccacaatctcgccagcattattttttgaattttttttttttttttccgagacagagtcttgctctgtcacccaggctggagtgcagtggagtgatctcggctcactgcagcctctgcctcccgggttcaagcaattctcctctcagcctttccagtagctgggattacaggcccacaccaccacgcccggctaatttttgtatttttgtagggacagggtttcaccatgttggcagtctggtcttgaaatcctgacctcgtgatctgcccgcctcggcctcctaaagtgctgagattacagccgtgagccactgcgcctggccttttttttttttttgagacggagtcttgctctgtcacccaggctggagtgcagtggcgtgatctcagctcactgcaacctccgcctcccgggttcaagcgattctcttgccttagcctcccgagtagctgggactacaggtgcatgccaccacgcctggctaattttttgtgtttttagtagagacgcagttaaaccatgttagccagtatggtctcgatctcctgacctcgtgatccgcccgcctcagcctcccaaagtgctgggattacaggcatgagccactgcgcctggcctggcctatttttttactttttaatactagtcatcctgactggtataagatggtatctcattgtcatttcgattggcatttctctaatggtcagtgatgttgagcttttttcatatgattgttggctgtatgtatgtcttcttttgaaaaatgtcagttcatgtcctttgccgacttttttcttgtttctttttgagacagagtcttgctctgttgtctaggttggagtgcaatggcacaatcttggctcgctgaaacctctgcttcccagcttcaaatgattcttgtgcttcagcctcctgagtagctgggatgactacaccaccacgccaggctaatttttgtatttttagtagagatgaggtttcaacatgttggccaggctggtctcgaactcctggcctcaagtgatccacctgccttggcctcccaaagtgttgggattacaggcgtgagccactgcgcccagccctttgcctactctttaatggggttgtttagttttcttcttacaaatttgtttaagttccttgtagatgctggatattagacctttgtcagatgcatagtttgcaaaaattttctcccattctgtaggttgtttgttcaccctgttgatagtttccttttctgtgcaggagctctttaattagaccccatttatcaatttttgcttttgtagtaattgcttttggtgtctctgtcatgaaattttttttttttttgagacagagtctccctctgttgcccaggctggagtgcagtggcacgatcttggctcactgcaagctccggctcctgagttcactccattctcctgcctcagcctcccgagtagctgggactacaggcgcatgccaccacgcctggctaattttttgtatgtttagtagagacaaggtttcaccgtgctagccgggatggtctcgatctcctgacctcgtgatccgcccgcctcagcctcccaaagtgctgggactacaggcgtgagccaccgcgcccggcctatcatgaaatttttgcccatttttatgtccagaatggtattgcctagcttgtcttccagggtttttgtagtttcgggttttacatttaagtctttaatctgtcttaggttaatttttgtatatagagtaaggaagggatccattttcaatcttctgcatactagccagttatcccagcactgtttattattattaatttatttatttttagacagagtctcgctctgttgcccaggctggagtacagtggcacgatcttggctcactgcaacctctgcctcctggattcaagtgattctcctgactcagcctactgagtagctgggactacaggccccgccaccatgtctggctaatttttgtattttcagtagagacagggtttcaccatgttggtcaggctggtctcgaactcctgacctcaagtgatccacccacgttggcttaccaaagtgttgggattacaggcatgagccaccgcgcctggcctcgtgcaccatttattgaatggggaattcctcattgcctatttttgtctggcttatcaaagatcagatacttgtaggtgtgtggcctttatttctgagttctccattctgttctattggtctatgtgtctttttttgtaccagtaccatgctgtattggttactgtagccctgtggtatagtttgatgttggatagcatgatgcctccagctttgttctttttgcttaggatttccttggctcttttggttccatatgaattttaaaataatttttttttctagttttatgaagaatgtcaatagtattttaataggaatggcatggaatctatacatttcttagagcagtgcggcccttttaacaatattgattcttcctatccataggcatgggacgtttttccatttgtttgtgtcatctctgatttctttgagcagtgttttgtagttctctttgtagagatctttcacctccctggttagctgtattcctaggtatttgtgtgtgtgtgtgtagcagtcgtgaaagggattgtgttcctgatttggcagtcagcttgactgttgttgaggtataggaatgttagtgatttttcacgttgattttgtatcctgaaattttgctgaagttgtttatcagcttaaggagcttttgtgctgagaccatgaggttttctggatacagggtcatgttgtctacagacaaagatagtttgacttcctctcttcctatttagatgcccttaaatacctacttcattgaatttttaacgtgcagtggtattgaattttatcgaaagcctttaatgcatctgttgagataatcatgtggtttttgtctttagttctgtttatgtgatgaatcatatttacgaatttgcatatgttgaaccaaccttgcatcccagggctaaagcctacttgattgtggtgggtaagctttttgatgtgctgcggatttgatttgccagtattttgttgaggatttttgcattgatattcatcaagaatgttgacctgaagttttcttttttttgttgtgtctctgccaagttttggtatcaggatgatgctggcctcatagaatgagttaggaaggagtccctcctcttcattcttttggaatggtttcagcaggaatggtaccagctcttcttggtacatctggtagaattcagctgtgaatccatccggtcctgggctctttttggctgataggctatttattactgactcagtttcagagctcgttattggtctgttcagggattcaatttcttcctggttcagtcttgggagggtgtatgtgtctaggaattatccattttttctagattttctagtttatgtacatagaggtgttcataatattatcagatggttatttgtatttctgtggggtcagtggtaatagccccttttcatttctgattgtgattatatttgaatcttctctctttttgtctttattagtctagctagcagtctgttgtattacttttttcaaagacccaactccaccaggcgcaagggctcatgcttgtaatcccagcactttgggaggccaaggtggatggatcccttgaggcaaggagtttcagaccagcctggccaacatggcaaaaccccatctctactaagaatataattagccatgcatggtggtgcacacctgtaatcccaactacttgggagcctaaggcatgagaatcgcctcaacctgggaggtggaggttgcagttagccaagactgcacctctgtgctccagcctggacaacagagtgagactctatctcaaaaaataataacaaataaataaataaaataaaacaaaaaacccaaatccctcctggatttgttgatcttctgaatgagttttcagtgtctcaatctccttcagttcagctctgatactgattattctcttttgctagctttgggattgatttgctcttggttatctagttcttttagttgtaatgttaggttgttaaattgagatctttgtaactttttgatgtggatacttagtgctctaaatatccctcttaacactgccttagctgtgtcccagagattctggtatgatatatctttgttttcattagtttcaaagaacttcttgatttctgccttaatttcattatttactcaaaagtcattcagggccagtaacagtggcttatgcctgtaatctcagcactttggtaggccgaggcaggtggatcaccagaggtcaggagtttgagaccagcctggccatcatggtagaaccccatctctactaaaaattcaaaaattagccaggcatggtggtgcatgcctatagtcctggcttcttgaaaggccgagacaggagaattgcttgaacctggaggcggaggttgcagtgagctgagatcgtgccactgcactccagcttgggcgacagagcaagactctgtctcaaaaaaaaaaaaaaaaaagtcattcaggagcaggtcattcaatttccatgtaattgtatggttttaagtgaatttttttttttttttttttggagacggagcctcattctgttgcccaggctggagtgcggtggtgcgattccaactcactgcaacctccgcttctgggttcaagcgattctcatgccttagcctcccgagtagctgggattacaggtgtgtgccaccacgcccagctaattttgtatttttagtagagacagggtttcagcatgttagccaggccgatcttgagctcctgacctcaggtgatccgccctccttggcctcccaaagtgctgggattacagacgtaagccaccacgcccggctggttttaagtgaatttcttagtcttaatttctagtttgattccgctgtggtccaagagattgtttactatgatttcagttcttttgcatttgctgagaagtgttttacttccgattatgcaaccaattttagagtatatgccatgtggcaatgagaagaatgtgtattctgtttttcatttgtttgtttgtttttctgagacagagtcttggtgtgtcacccaggctggagtgcagtggtgcgatctcggctcattgcagcctccacctcccagattcaaacaattctcctgcctcagcctcccgagtagctgggactacaggcatgtgccaccaatcttagcaaatttttggacttttagtagagacagggtttcaccatgttggccaggctggtcttgaactcctgacctcaagtgatctgcctgcctcggcctcccaaagtgctaggattacaggcatgagccaccacgcctgaccaattctgttgtttttggatggagggttctgtaggtgtcttatcaggtccctttcacccactgctgtttgaatcctgaatatctttgttaattttctgtctcgatgatctaataatgtcagtggggtgttaaagactctcactattattttgtgggaaactaagtccctttgaaggtctctaagaacttgctttatgaatctgggtgctcctatgttgggtatatatatgtggcggtgtgagccaccgtgcccagccttgtgtttttttaaataatgctatccaattattttcagtagcaattgatttgtgagggcattttgaaccttgtaagacaccaaataatgacgtgtttttattagtcttgtgatactagtatccacctaggtcattagatatttaaaatctgcactttatataggaccaacgatatttaaaaaaatagtgaagtatctttcttacactagtgttgatgatgtgtatatttcttgtttacctgagtatagggctcatagagaaatggttgttctttgggaaagcttaggtgagttgattgtttattaagcaagcttaaaaattagagccctcaggctgggcgagatggctcacgcctgtaatcccagcactttgggaggttgaggcaggtggatcacgaggtcaagagatcgagacaaccctggccaacatggtgaaaccctgtctctactaaaaatacaaaaattagctgggcgtggtggcacgcacctatagtcccagctactcgggaggctgaggtaggagaatcacttgaacccaggaggcagaggttgcagtaagctgagattgtgccactgcactccagtgtggcaacagagcgagaccctgtctcaaaaaaaaaaaaaaaaaaaaattagagccctcaaacagttttccccctcctccagtgagtgacaaatagaaagagggaggattccaagagataatatttaaaaatagccttacatcttcttcccttcattcatggattaatccctgttaaaaatgctgccagtaaatagcaaagaataactgtatagaaccaatcataggatataaaaggactttcttcttccttttacttgcacatacccaattttgcctcctgtcccttcctctaaatttgaatttatttcagggtgagcattatgattcaggatatcagtgcacctttgctgtatgtattaaagggtgaaaggctgggcatggtggctcatacctgtaatcccagcactttgcgggggctgaggctggaggattgcctgaggctaggagtttgagaccagcctgggcagcatagcaagacactgtctctacaaaaaacaatttttttttttttgagatagagtcttgttctgtcgcccaggctggagtgcaatggcacgatcttggcccactgcagcctctgcctcccaggttccagcgattctcctgcctcagcctcctgggtaactgggattacaggtgcacgccaccacgcctggctaatttttgtatctttagtagagacagggtttctccatgttggccaggctggtctcgagctcctaacctcaggtgatccacccgccttggcctcccaaagtgctgggattacaggtgtaagccaccatgcccggcctttgttttttttaattatccaagtatggcaacgtgggcctgtggtctcagctacttgggagcctaaggcaggaagatcacctgagccaggagactgaggatgcagtaagctgtgatggtgccattatgctgcagcctggacgacagagtgagactctgtctcaaaaaaaacaccaaaaaaagatgtcacataatcttaaaatttgtatggaacacaaaaaggctctgaatagtcaaagcaattttgagctaaaagaataaagccagaggcatcatactgtcttatttcaaaatatgcgacaaaactgaagtaaaacagcgtggatctgccataaaaagacatagacaaattgaatagactagggaatccagaaataagtccacgtaggtatggtcaattgattttcgacaaagatgccaagaacacacagtggggaaaggacaatcagtgtcttcagtaaatgatgttgggtaaagtggatatccacatgcagaagaatgaaattagatccatgtctctcaccatcttaaaaaatcaactctggctgggcacggtggctcacgcctgtaatcccagcactttgggagcctgaggcgggcagatcacgaggtcaagagatcaaaaccatcctggccaacatggtgaaaccccgtctctactaaaaatacaaaaattagctgggcgtggtggtgtgcacctgtagtcccagctacttgggaggctgagataggagaatcgcttgaacccaggaggcggaggttgcagtgagctgagatcatgccattgtactccagcctgggcgacagagccagactccatctcaaaaaaaaaatcaactcaaaatggatttaaagacttaaatgtaagacctgaaactgtaaaactactagaagcaaacacaagagaaagcttcatgacttggtctgggcaatgattttttgattatgaccccaaaagcacaggcaacaaaaagcaaaaatagtcaaaggggattacatcaaactcaaaagcttccgcacagcaagggaaacaacagaatgaagagacaacgtatagaatgggagaaaatatttgtaaactatatgtatgattagaggttaataggaaaagttatgaggaactcaacagcaaggaaacaatcccattttaaaatgggcaaaagatctgaatagacatttctcaaaagaagacctataaatggccaacaagtatatgaaaaaatgttcagtatcactaatcctctggaaaatgcaaattaaaaccacaatgagatattacctcacaccgtgttagaatggtttttatcagaaagatgaaagatttgtgggataccatactggtgaagaaaaaaatgtaaaattaaaagaaaaaaaataacaagtgttggcaaggatgtggagaaaagggaaccctcatgcactgttggtggaaatgtaaatttgtatactactttttttttttttttttttgagacacagtctcgctctgttgccaggctggagtgcagtgacgcaatctcggctcactgcaacctccgcctcccaggttcaagcgattctcctgcctcagcttcccgagtagctgggacgacgggcgcgtgccaccacgcccagctaatttttgtatttttagtagagatggggtttcactgtgttggccaagatggtcttgatctcttgacctcgtgatcgcctgcctcggccccccaccaagttttgggattacaggcgtgagccaccgcgcctggcctgtacactactgttctatggaaaacagtatggagattcctcaaaaaattgaaaataggattatcatacaattcagcaattccactactgggtatatatccaaaggaaatgaaatcagtatgttgaggtatctgtacgctcatgttcattgcagcattattcacaagagccaagatacagaatcagtgttaagtgtccatcagtagatgaatggataaagaaaatttggtatatatacacaacgaaatactattcagccttgaaaaagaagggaatcttgtcatttgggacaacatggatgaacttagaggatattacattaagtgaagtcagccaggcacagaaagacaaatgctgcatgctcttattttgttgttacagacagggttttttgctgctgtgttgcccaggctggagtacggtggctattcccaggtgcaatcatagcacactatagcctcgaagtccctcctggtatcaagcgatcctcctgcctcagccttctgagttggtgggactacaggcaggtgccaccatggctggccacatgcttttacttatatatggaatctaaaatgtcaaactcaatcttacaattctcatatacctatattaacaccaccaaggctgtggctaccattagcaacaggagcattaaatatctgttgggtaaactgtagaccaaggcttttagtattacagaatataattctaataaaaattccaggctggggcagggcatggtggttcatgcctgtaatcccagcactttgggaggtcgaggcgggtggatcacctgaggtcaggagtttgagaccagcctggccaacatggtgatacccctatctctactaaaagtacaaaaaaattagccgggcgtggtggcccatacctgtaatcccacatactcaggaggctgaggcaggagaatcacttgaaccccaggggtggaggttgcagtgagccgagatcacgccactgcgctccagcctgggcaacagaaagagactgcatctcaaaaaatagaaaaaattccaggctgggcgcaggtggttcaagcctgtaacacagcattttgctaggtggaggcaggcggattgcttgagcctaggagtttgagaccagcctgggcaacatggtgaaatcccatctctacaaaaaatacgaaaactagctgggtgtgttggtgtgcacctgtagtcccagctacttgggaggctgaggtgggaagatctcacctgagcccagggaggttgaggctgtagtgagccgtgattgtgccactgcattccagcctgggcgacaagagtgagaccctgtctaaaaacagtaaataaaaataggacaggctcagtggttcatgcctgtaatcccagcactttgggaggccgaggcaggcggatcatgaggtcaggagatggagaccatcctggctaacatggtgaaaccccgtctctactaaaaatacaaaaaattagccgggcgtggtggtgggcacctgtagtcccagctactcgggaggctgaggcaggataatggtgtgaacccggaaggcagaggttgcagtgagctgagatcaagccattgcactccagcctgggctacagagggagattctgtctcaaaaaataaataaataaaataataataataataataaagtaaaactcatagaagcagagaataaaatggtggttaccaggagctgggtgggagtggagattgggaaggtgttggtcaaaggatataaaatttctgttagacagaaggaataagcacaagaaatctgttgtacaacatagtgaccttagtaaaaatatattctttttttttttttttttttttttgagacagagtttcactctttttggccagggtggagtgcaatggcatgatcttggctcactgcaacctctgcctcccaggttcaagcgattctcctgcctcagcctcccaagtagctggaattacaggcatgcaccaccatgcccagctaattttttgtatttttagtagagacggagtttctccatgttggtcaggctgatctcaaactcccaacctcaggtgatctgcctgcctaagcctcccaaagtgctgggattagaggtgtgagccaccacgcccggccactaaaaatatattctgtacctgcaaattgctgagagtagattttaagtgttctcaccacaaagaaacgtaattattttaggtaatggatatgttcattagtttgatttagccattccacagtcttcacatacagtagcgctcccccttatccacagttttgctttctgtggttttagttacccaagatcagccatggtctgaagatatgaaaaagaaattccagcaacaaacaattcattagttttaaacagcatgccattctgagtagtgtgatgaaatctctcttgccgtcctgcgtatgtcatgaatcatctctttgctcggtgtctccacactgagtctgctacatgccctttagtagcagacttggttgtcaaattaactcaggctattgcagggctcgtgttcaagtaacccttattttacttaataatggccccaaagtgcaagagtagtgatgctggcaatttggatataccaaggataaattcctttttcttttttttttttttgagacagactcttgctctgttgcccagactggagttcagtggccccatcattgctcactgcaacctccacctcctgagctcaaacaatccttgcacctcagcctccagagtagctgggattacagatgtgcatcaccatgcctggctaatttttgtattttttgtagagatgaggttttgccatgttacctcgaactcctgggctcaagtgatccacccacctcagcctcccaaagtgctgggattacaggtgtgagccaccactcccagccaagaagctattaagtgtatcctttaagcaaaaagatgaaagttctagacttactaaggaaaaaaaaatcttatgccaagattgctaaaatctatagtaaaaatgattttttttttgttttttatgaaccctgcatattgtatttgaaagaatgaattttctatctgtgaaattgtgaagacgaaaaaagaaaattgtgctagttttgctgttgtactccacattgcagaagttacaatcacagtgcacagtaagttcctagtgaagatggaaaagacactaaatttgtgggtgggagacatgaacaaaaacgtactttgattgagtgcaattggattcagtactgtccattgtttcagttatccactgggggctttggaatgtatccctcaaggataagagaggactactgtatttctgaatgtcattttacacaccgtaactatatataatttttgtcagttaaacaaaatatggcacaatctcttttaagctattggtgataccaataagattgggaattttactaacaatcttttacatactttaccttcttaaataaaattaggtaagagataggacttctgggacaacatctttatatacttgggagaagggttcatccttccactatggcaacactaatttattggtaaatgcaaaccactatagtaggctcattctattaaatgaatgcactgcataataacacttctgtcaatgctggactgcacaaatgatggtggtcttgtaaggttaaaatggagctgaaaaattcctattgcctggtgatgtagccatcatgatgttatagcacaatgcattactcacgtttgtggtaatgctggtagtaaacaaacctgtgctggcagtcatataaaactatagcacatacaattatgtatagtatataatacttgataataaatgactatattactggtttatatatttactatactttttaattgttagtgtgtattccttctacacacacacacacacacatatttttattttatttttatttttgagatggggtctcactttgttgcccaggctggagtgcaatggcacaattagggctcactgcagccttgacctctcaggctcaggtgatcttcccacctcagcctcccaagtagctgggactacaggcacatgccaccatactggctaactttttttttttcttcttccctgtagagacaaggttttgccatgttgcccagactggtcttgaactcctgggctcaagcagtttgctcaccttggactcccaaagtgctgtgattacaggtgtgagccacctcacccagccttattttttaaaaaagttaactgtaaaacagcctctggcaggtccttcaggaagtattctagaagaaggcactgttatcataggagatgacagctccatgcctgttagtacccctgaagacctttcaagaagtcaagatgtagaagtggaagacagtgatattcttgatcctgtccctgtggaggcctaggctaatgtgttgttagtgtcttagtttttaacaaaaagttttagaaagtaaaaaaaaaaaaaaaagaaagagggacggagggaaggaaaggagggagggaggaaggaagagggaggagagagacagagcagagagagaaaggaaggaaaggaaaggaagaaagaaaaaaagaaaaaaaagaaaagaaatcctcctgacttatcatcctgaatagctgggacaacagatgtgtcctaccacaccaagctaatttttaaaaaattgtttttatggagatgggatcttgctatgttgcctgggctggtctcaagctcctggcctcaagtgatcttcttgctttgacctacagaagcactaggattacaggtgtgagccacctctcctggccatcttttcttttttttttttttggagatggagttttgctcttgttgcccaggctggagtgcagtggcacgatctcggctcaccacaacctctggctcccaggttcaagtgattctcctggctcagcctcccgagtagctgggattacaggcatgtgccaccacgcctggctaattttgtatttttagtggagatggggtttctccatgttggtcaggctggtctcaaactgccgacctcaggtgttccacctgcctcagcctcccaaattgctgggattactggggtgagccaccatgcctggacctggccatcctttttttctttttttttttttttctgagatgaagtcttgttcttgttgaccaggctggagtacagtggcacggtctcagctcactgcaatctctgccttccgggttcaagcgattctcctgcctcagtctcctgagtagctgggattacaggcgcccaccaccaccctggctaatttttgtacttttagtagagatggggtttcgccatgttggccaggctggtctcaaactccagacctcaggtgatctgcctgccttggcctcctaaagtgctgggatacagccatgagccaccaggcccggctggccatcttttaaaagtatgttttgtctttgaggtttcctcaaaatgtgatacataacgatgccagaaatatatacggcttcatttttgtgggtgttgattttgtcatgatcagtgatgatgatgaattgcccttcctgtgctctgtaagcatgttttctgaaattaatgtcctttataactcactagtgttattttctgggataatttggattagcacgcaatgcttttgcttatcaataagccacacctctgttttaaagagctgattcatgcttcttagtggtaacagaagtactatgtttaacaaagaggaggaggtcagtttttcttcaaagaagaaagtttcatttttatgtctttactcctcagtaatatgttacatattgaatatttgtgcttaaaaacaaacttttcttaagcataactttttttttttttttttttgagtcagagtctcactctgtcgcccaggctggagtgcaatggcaccatcttggctcactgcaagctccaccttccaggttcatgctattctgcctcaacctcccgagtagctgggactacaggcacctgccagctactgttacaattacacgcctggctaattttttttttttttttttttttttagtagagacggggtttcaccgtgttagccaggatggtctcgatctcctgacctcgtgatccgcccgcctcgtcggcctcccaaagtgctgggattacaggcgtgagccaccacgcccggccaacttttttttttttgaacaggcttttccatttgtaaaactcagtccttactaagaacatgattgtaagtctctatataatgtttcattttctttgtgataggcaaaaacaaattaagttctttattaactgcttttatttgtagctactaaatttctctgctaagtgtaacaaaaatagtttagaaatagcaaagaaagttattttagggaaatgtagaggttttctacacttccagatttccagggaaaagggtaaattggtgacagataataaagatgcatgtagccaggcacggtggctcatgcctgtaatccgagcactttgggaggtcgaggcaggcggatcatttgaggtcaggagttcaagaccagcctggccaacatggtgaaatctcgtctctacaaaaatacaaaaattagctgggcgtggtggtatgcacctttaatcccagctactcgggaggctgagtcggaagaatcacttgaacctgggaggcggaggttgcagtgagctgagatcgcaccattgcactccagcctgagtgacaaagcgaaactctgtctcaaaaaaaaaagaagataataaagatgcgtgtagattacagtatttactccttatattaatgtagtagcatctgaaggtcactctagaagaatagataccttattactttcttaattttctctagtgatgtgctttttttttttttgagacggtgttttgttcttgtctcccaggctggagtgcaatggcgcaatctcggctcactgcaacctctgcctcctgggttcaagcgattctcctgcctcagcctcctgagtagctgagattacaggcttacaccaccacgcccggctaatttctttctttctttctttctttttttttttttttttttgtatttttagtagagacggggtttcaccgtgttggccaggctggtctcaaattcctgacatcgggtgatctacccgcctcggcctcctaaagtgctgggattgcaggtgtgagccaccgtgcctggccgtgatatgcttttaaatcaagtccaagaaaatgtggaaataacactttagttgttcagtctgccaatgtaaatttaggtttcattatcttgatggtgtttttagacattgtgtattttgatcaggctttgaatcatgatagaattaaaaactgctttttttgttttagaactgaaatggaggagtgaggtgagctttaagactgccaactatatgccaggcacagcccatttcttcctgttttattttataataaatgctatttcatgagattctcattaaagatgagtattattaatcccacttgaatccccaaagacaagaaggttaaattattctgcaatattatcttttgtaaccaaaatcattaaccagtttgtatatgattgatatttgaaactaacttgtgctaatttgtccaatgaaagataatgcaagttctcttaaccagtaaacttttgttcttttgatttttgcctggcttgttaagctttctcaggagggagaaggttattttgaataacacgggtctagcgttacagcaattacccagaaaggaatagaaaaggcagaaaataatttcattcttgacggtttccatctgagtagattaatttatatttgtatgtacaatctgaggctatcttggacattcaaaatgaaacaaggaatgaagctattattagggtaattgagaaaaaaataatttttgcttttttttttttttttgagtctttctctgtcgccaggctggcgtgcagtggcgcagtctcggctcactgcaacctccacctcctgggttcaagcgattcctctgcctcagcctcccgagtagctgggactacaggtgcgtgccaccatgccctgctaattttttgttgttgttgttgtttttgtatttttagtagaaacgggttttcaccatttgggccaggatggtcttgatctcctgacctcatgatccgcccgcctcggcctcccaaagtgctgggattacaggcatgagccaccgccgctggcctaatttttgcttttaatatcaagtttctagcctgcagtacatgcttctgtgtttctttcactgaactgacctagccacagttaccaagttgaggaattgatacattcgaagagttctgttaaaggtgggaagaggataatatattttagaattctcatatacctatgttaacaccaccaaggctgtggctgccattagcaacagcagcattaaatatctgttgggtggctggccggggtggctcacgcctgtaatcctggaactttgggaggccaaggtgggcagatcatgaggtcaggagtttgagaccagcctggccagcatggtgaaaccccgtctctactaaaaatacaaaaaattagccaggcatagtggcatgtgtctgtagtcccagctactcaggaggctgaggcaggagaatcacttgaaccccacaggcggagggttgcagtgagccgagatcatgccaccgcactccagcctgggcaacagagtagacagaccctgtctcaaaaaataaaataggccgagcacggtggctcatgcctgtaatcccagcactttgggaggctaaggcaggcggatcgcttgaggtcaagagttcgagaccagcctggtgaacatggtgaaaccctgtctctaccaaaaacacaaaaattagccgggcgtgggggcacatgcctataatcccagctacttgggaggctgaggcaggagaattgcttgaacctgggagctggaggttgcagtgagccaagatcgcgctactgcactccagcctgggtgacagagcaagactctgtctcaaaaaagaaaaaaaaatttaattaattaaatactgatattcaaaaagaagcacttttgaggcaatagttttatcagatctcaaatatgtatgttttgtatccatcctactggttctgtttctgagaagaaccctaatacagaaggtattccggaagacacgttagccaagcttgagatttaaaggaattagctgtgtaaagaggtaggaaaggctgggtgcggtggctcacatctgtaatctctgcactttgggaggccgaggcgggtggatcaccagaggtcaggagttcaagaccagcctggccaacatggtggaaccccatctctactaaaaatacaaaaattagctgggtgtggtggcacatgccggtaatctcagctactggggaggctgaggcaggagaatcgcttgaatccaggaggcgggggttatagtaagccaaggtcatgccactgcactccagcctgggcgacagagcaagactctgtctcaaaaaatatatatatgatgaataattttgtgttgatgaaatttctgctgtgtataaatattttttgagtttagtatgtctctactgttaagtgatatggcatgatttatttcttttaccacttttcggtattcacattgccaggaaacttgttcctttgaagttatttggttttctcatggctcacatacgtcatggatacttacctaattccatttctattaatttcttgttggtctcggactatgtagtactgtttggtgctagtgttcatttatttattcagtaagtattttcttagtacctagtgtatgcaccttctaaatgcagggatatagtagtgaacagaacagataaagtatctaatgatactttctagattgggagagacacaataagaacttaggtaagcatatctatagataaattacagatagtataccatcagatagtgatacattaaaataaaaataaaacagggtaaatggatagaatgttttgaaaagggggtgccaaggaaaggcctctctgagggagtcacacttgagtgacctgaaataatggagcaaatcacgcagtttctgggaaaagagcattccaggctgactgaataacaactgcaaaccctagggtaagaatgtgcttgttatgttacagaaacaatagtaagctcagtatgggtaaaacagagtgagcaagagaagtaggaaatgtggtcagtggagcagacagggaccaggacatgtaggatcttataggccgtggtaagaaatttgcagttgtcaagcacaatggctcatgcctgtaatcccagcactttgggaggccaaggtgggcagatcacttgaggtcaggagttcaagaccagcctggccaacatggtgaaaccccatctcttctaaaaatacaaaaattagccgggcgtcttggcgcacgcctgtaatcccagctacttgggaggttgaggcaggagaatcgcttgaacctgggagtcggaggttgcagtgagccaagatcgtgccactgcactccagcctgggtgacagagcaagactccatctcaattaaaaaaaaaaaaaaaaagagaaatctggagttaatttcagatgtaataatgtagccggcttaagtctggctgcttgccactcagaggccaaaaaaaagagaagccaggtgcggtttaaggaaagcagttttattaatcaaatgctaggagctggggaatggccaggctcatgccttcaaaagaccattccagttttttgggctgagtgaaggattttttttgagatggagtctcactctgtcacccaggctggagtgcagtggcgcaatctcagcttagtgcaacctctgcctcccagattgaagcgattctcctgcctcaacctccagagtagccaggactacaggcgcgcgccaccacgccctgctaatttttgtagttttagtagagacggggtttccctatgttggccaggctggtctcgaactcctgacctcaggtgatctgcctgcctcggcctcccacagtgctgggattacaggcatgagccaccacgcccggcctgagtgaagggttttaagaaggcaaagatatgggaaatatgtgatagtggtgcaggaggggataggccttcaaatcttgttcccatggctgtcttgagtaatcacctgtctggagttctggttttttcatcctgatttctgcctaatagtggtgagccaactgttcagaactccccttaggtgggaggattctgcaactggctctctctgcctgatttgtttcaaaattggcccctggaatttgtaagcaagcacataattagataagtgagcattgttcatggaagtacctggtaggaaagggaaacaaagagtttcaaagtatgtttcaaggctgaaagcaagaaaggaaaaaaaagttttaaaacgcattttgaggctgagatacttggctacaacagggatatatgacctgctttacttttttttttttttttttttgggggggatggagtctcgctctgtcacccaggctggagtgcagtggcacgatcttggctcactgcaacctccacctcccgagttcaagccattttcctgcctcagcctcccacgtagctgggattacaggcgcccgccaccatgcccggctaatttttatatttttagtagagacgaggtttcaccatgttggccaggctggttttgaactcctgacctcaggcgatctgcccgccttggcctcccaaaatgctaggagtacaggcatgagccaccatgcccttttttttgttgttgttaatagaggcagggtctggctctgttgcccatgctggagtgccgtggtgcagtcatagctcactgtaacctcaaatttctgggctcaagctgtcttcctgcctcagagtagctaggactacaggcacgcaccaccacgctcatctaatttttaaatttttttagagacagggattttactatgttgcccaagctggccttgaattcctggcctcaagtgatcctaccacttcagtatctgaaagtactgcgattatagccatcagccactgcatccagctctgctttactttttgaaaggatcacccaggccagtctgaggataacagaatataagagtctgagaagaagggaggttaattaggggttgattgtactagtctagcaagagatggtgatagcttagactagagtgagaagtggttaaattatggatatcttttggaggtggaggcaataagacttggtaatgatttaattgtagctgtgagagaaagagaagagtcaaggatgacaccttgttgaacaactagaaaacttaagctgccattttactgaaatgatacaaaatagcagctaacacagatgccagctctttttctaagtgctttacatctgttgccctactcatgaatagggaatacctgggggggaaaaaattgggagtgggaaatcaagagtttgttctttaaaacatagtaagtttatgaaacttcctagatttccaaatagagtattgagtatgctgtagatatatcagtctgttgaagttcaggggagatgttcagcctggaaataagaatttgtttgtatcatcagtgtatatagggggtattaaaaatggtagaactaggctaggcatgttggcctatgtctgtaatcccaacactttgggaggccaagatgggaggatcacttgaggtaaggagtttgagaccagcctagataacatagtgagaccccgtctctacaaaaatttttaaaaatttaggccgggcacctaatttggtgcttactaggtgctgtggctcaccatataggtttgagcatcatctgtttatgggtggttacagaggccataggaatatttctgtcttgcacaggtgtccagttagtggaaacacaaagtaggcttctcctctgcaaaaactacacaggatttttctagcaagacatgcttctgtttgtgattctgtaagaacaggggtattttgttaatggaaactttccatcacaaaccaggatcatcccctaggattgatattataacaacatcaatcaaaagaagtaaatgatttctgtggctttggaagagttcagtataatctaatagagaaattaaaggtctataagagtcccttggaacatgtgaaaggaccatgtggtattgaaaattgcgatctgtgatttcgatagcttaatattagaattggaaggtatcagatggctggcaaactgtcagtaaagtcctattcttaaaggagtactgtcctaggttgggttatctttgaggcagactctgatagtatagcctgaagaatgcttattaggaagtgcccttgggatcaacacccgtagaagggaggggacaggagcagcagtatttggccatagggagaagtcaagtggcaatagagatccaacaggagccttagtggaccccacgggggctctggagctaaaatgaccttttagagttgtcttatatgtgctgtaacggctgggcttacaccctggtcttgattggatgtggacccctgagaaggttgtgaccttccttgagtcaactcttcatatctgaggcactccctgaaaggattgacagttgtaggctgtctcccaacagcagtcctgtcattccttaatggaggatccagccagtgcaacagcatgctaccacagtatacccttgtgttgctcagatctactacttaaaaaacaaaaaaacagtatttttgagatataattcattattgtaaaatttataattacagtttatagtatacaactcaatggcttttaatatatttgcaagttgtgtaaccatcactctaaccaattttagaacattttaattaccccccaaaaaactctgttccccttagctgtcactctgtaatctcctccccacccacccccaacataggccaccgcaaactttctgtctctatagacttacctattatggacatttcatgtaagtggaataatacgctgcatggtcctttgtgattagcctttcatttagtgtgttttaaacgtttatccatgttacaacacgtatcaatacttaatttctttttatgctgaatgtcccgttgtattaattttgtttatccagtgatcagtggaaagacactgggtggttttcactttttagctattatgaataatgctgctatgaacatttgtatacaagtttttcgtttgtttgttttgggggacgtttgtttttgtagttagctgggactataggcacgtgccaccatgctcaagtaatttttgtattttttgtagagacggggtttcaccatgttggctaggcttgtctcaaacttctgacctcaagtgatctgcctgccttgtcctcccaaagtgctgggattacaggcatgagccactgcacctggcctgtgtacaagattttgtatgaacatccttttttttttttttttttttttttgagacggagttttgctctgtaacccagactggagtgcagtggcgcgatctcagctcactgcaacctccgcctcctgggttcaagcgattctcctgcctcagcctcctgagtacctgggactacaggcacctgccaccacgcccagctaatttttgtatttttagtagagacagggtttcaccatattgaccaggctggtctcgaactcctgacctcaggtgatctgcccgcctcagcctcccaaagtgctgggattacaggcgtgagccaccgcacctggccttgacatatgtttttatttctcttggatatatacctaggagtgggtcatatggtaaactctatgtttaactgtttggggaactgttactcttccaaatcggctacatcattttacattctcaccagcagtttattgaggccccagtttctctgcatctttcctaatacttgttatgtatttatttaacttttattttacgttcaggttacacgtacacttgcaggtttgttatataggtaaactgtgtgttacgggggtttggtgtacagataatttagtcaccccggtaataaccataacacctgataggtattttttctgatcctctcatccttcaccctcaagcaggccccagtgtctgttgttcccctcctagtatccatgtgttctcggtttagctcccaacacttgttattacctcttttatttattatagccatcataatgggtgtaaagtgttatctcattgtgacattgatttgcatttcctgtagggctaaaaatgagatgttgaagatcttttcatgtgcctattgactgtatatcttctcttaggaaatgtttatatacatcctttgcccatttttaaattgggttgtctttttgttattgagttattgttctttatgtattctagatataggttccttatcagatagatgatttgcaaaaattttctcccattctgtgggttgccttatcacttttttgatggtgtcctttgaagcacaaaactttaaatttttttctttttcttttttgagaccgaatcttactctgttgcccaggctagagttcagtggcatgttctcagctcactgcaacctccgactcccaggttcaagcaattctcatgcctcagcctcctgagtagctgggactacaggtacaggccaccatgcccagctaattttggtatttttggtagagacagggtttcaccatgttgtccaggctggtctcaaactcctgacctcaggtgatccacccatctcgacctcccaaagtgctgggattacaggtgtgaaccaccacgcctggccccaagtatgtgtatttcaatttcacattcagtgaccagggaatgaccaccagttaggagttcgagaccagcctggccaacatggtgaaactctgtctctactaaaaatacaaaaattagctgggcatggtggcaggtgcctgtaatcccagctactcaggaggctgaggcaggagaatcacttgaacccaggaggcagaggttgcagtgtgctgagattgcaccattgcactccagcctggacaacagagcgaaactccatcttaaaaaaaaaaggaataggaaaagaaaaaaataatctcactagcacagaacccagatttctatctatcttagtaaacaatcaaaagcatatttcactttatgcctcaattgactgctggccaaccataacttctatagcagctctcactttgatactctctagtaaatttaagttatatttaaggttaatttgagtttaatttaattgtttaataataaatttgactgataagattgtattaaaatttaggttatgtttacttaagtgaagcaaggaggtcactcagaatgaaaactttacatttccagtacaaacctatggagttgtcatgtattattctagtttatcatatggtcatgttctttagaatttgtcaccaggctactataataaaactcaatttaccaaattcttcaagatttaacttggtaatgaagctacaaaatttatgaataagtacagactgccctttttgaacagactgttcaaactaaggatggatctaattgatgaactaggtaaaaactactcttgagggggaaaaaaaaagccaaggtcctaaagaaatcatctaaggttgttaaaagcagaaaaattctgatcttacaaggtaataaacagcagtcttctcaaaagctcttaatctgagccagatgattgctagtacgagtagcccatgagccactgcgcccggccctacaactgcatcttactcccaagtttctccagtcattcctgtcagtaggttgtgacttataaaaagcaggctctgaattggagtttagtatttagactgttagggaatgaccttaggataaaaaccacaggaggagtaggaagctgggtagggcagatttgacacttgccttgattgggggtgcaggaggttgtatattatacttagtcaactttcttttgaaacgttttttgttttattttcatacttgagtggataaacttacagcttactgaaccatcctcctgtgtctaaaataacttccattttccttaggcaaaaccaattcccttcttcaaagatgttcctcatgccctttctcaggtgttgtatttttcttacaaaaaaacttgcctttttccctatactctagtaaattcaaaatgaggattggaaagggagcttatttgaggaaactgacaataatatattttaagacaaaaattagccttaaatgttttatgataatctagtattgtacatctgtatctcaattcccctaaaataactcccagcctggcacagtctcaggctgttgtaatcctcaagaggctgacatgggaggctcacttgagcccaagaattaaaatctagtctgggcaacataaggagatcctgtctcaaaaaaaaaaaaaaaactatcatttaataagttgtacatttctataatgttccacttttaaactatagtcaatgttactgaattaggattatttttttaaaagcataaaaggtgatggactatatgtattaagtgtatcatttacctttttctctttttagaaacagtatctcacctccctaaactggttaatagtggcatggaagatccatttggtgagtatcacctacattgttcttagtaaatgacatttctgttttatcctcacctccattaaagctttgagagtaaattggttttttttcatattcagtatgctactctctagaataatgggtctcaaactttttgcttctataagaattcagttatatatttaatgatagagtgccaattaccttttgtttatgtgacatatctattgatgtttgctgtattacaaattaaacctgagaaactttaaaaatattaatttgtttaaaaacaacattgataaacccattatatattacacaaataacatttttaattaaaaaaatcaagaaccatttgacaagataaaatgagaaatttaaatttctctatcttagccaggagtggtggctcacgcctataatcctagcactttgggaagctgaggcaggcagatcacttgaggctaggagttcgagaccagcctggccaacatgacaaaaccccgtctctactaaaaatacaaaaatttagctgggcatggtggcacacacctgtaatcccagctactctggaggctgaagcatgagaaacgcttgaacccaggaagcagaggttgcagtgagctgagatcgcgccactgcgctccatcctgggcaacagagcaagactctgtctcaaaaaaagaaaaataagtaaataaactctgtcttaatcactcagtaacttatgtatacttctctttggttggaaatgtagttctgctcatatttcagaaacaatgtgtgctttgtagtgcttcattagtacttggccaatggaagataacatgaaagtgactgggcgcagtggctcatgcctgtaatcccagcactttgggaggctgagatgggcagatcacttgaggtcaggagtttgagaccagcctggctgacatggtgaaaccccatctactaaaaatacaaaaattagctgggcatggtagtgggtgcctgtaatctcagctactcaggaggttgaggcaggagaaacacttgaggcctggaaggcggaggttgcagtaagccgggatcatgccactgcactccagcctcggcaacacagggagactctgtcttaaaagaaaagaaaagagaaagataacgtggaagtaatcataatagcaggcatgtgtaatatatatgtacgtgtgtgtgtctatatatgtgtgtgtgtgtatatatatatatatttttttttaatttattttttttgagatagtgtctcactctgtcgcccaggctggagtgcagtggcaccatcacagctcactgcagccttgacctcccgggctcaggcaatcctttcaactcagcctcctgagtagctgggactataggtgtgcacccctatgcccgactgatttttttttttttttttggtagagatagggctttgccttgttgagcaggcggctctggaattcataggctcaagggatccacctgccttggcctcccagagtgttagaattacaggcgtgagccactgcacccagcctaatatttctaattaagtttagcctgtgtatatttcatctagcaacatgagtaaaggaatgtaagtctagatatacaaaggtttaatgtctgcctttttggcgataaagtcatttactgtgtgtggaaccccttttctttctttcttttttttttttttttccaagactggatatcactgtgttgcccaggctggagttcagtggctattcacagaagcaatcatagcatgctacatccttgaactcctgggctcaagcagtcttcctgctttagcctcccactgtgtttggatggtaaggggtgaagaagactgagtaaagaggctgttgcattcagcattaattatgcatatttcccacgtagctaggactacaggcatactccaccactcctggccctatttttaactgatgctcatttcaaagtgagagatatgtcttaggatatcagattttttgaaaccataacattgactaggaagactagttaggaagtacttttcattttaaaatacacattagcaaaaaagaaaaaaaagaaatcagaggcagttttacttgtttaatttcagcgtactggaggaagcatccgattcaagcattttctgatccttcatcacacggaaagaagtctgaatccctttttatgccagtgcagcttgaggaagtatagtaaaaatactactatataatactaactgaggttaggctttttgggctactagtactagcaatcatctggctcagattaagagcttttgtcttgctttgagaagactgccctttattactttgtaatatcagaatttttctgcttttaacgaccttagataatttctttaggaccttggctttctttcccccctgaagagtagtttttaggattatgcctagttcatcaattagatccatcatcaattagatccatccttagtttgaacacaagagggcagtctgtacttcttcataaattttttttttttttttttttttttttttttttttgagacagagtctcgctgtgtccccaggctggagtgcagtggggtgatctgggctcgctgcaatctccgcctcccgagttcaagccattctcctgcctcagcttcccgagtagctgggactacaggcacgtgccaccacacccagctcattttttgtatttttagtagagacagggtttcaccatcttggccaggatgatctcgagctcctgacctcatgatctgcccaccttggcctcccaaagtgctgggattacaggcgtgagccaccgtgcccagccacttattcctaaagtttgtagcttcattaccaggttaaatcttgaagaatttggtaaactgagttttattatagtagtctggtgacaaattctaaagaacatgaccatatgataaactagaataatacatgacaactccgtaggtttgtactggaaacctaagttttcattctgagtgacctccttgcttcacttaagtaaacataacctaaattttaatataatcttatcaatcaaatttattattaaacaattaaattaaactgaaattaaccttaaatataacttaaattttctagggagtatcaacgtgagagttgctatagaagttatagttgaccagtagtcaattgaggcataaagtgaaatgtgcttttgattgtttactaagataggtagaaatttgggttctgtgctagtgagattatttttttctttttcttttcttttttttatttgagacggagttttgctcttgtcgccaaggctggagtgcaatggcacagtctcacttcactgcaacctccacctcccgggttcaagtgattctcctgcctcagcctcctgagtagctgggattaccagcacctgccaccatgcccagctaatttttgtatttttagtagagatgaggtttcaccatgttggccaggctggtcttgaactcctgacctcaggtgatccacccgccgtggcctcccaaagtggcgggaattgcaggcgtgagccaccatgcccggctgagattattttttatttttatttttttggtttgtttttgttttttgggggtttttttgaggtggagtcttgctctgtcacccaggctggagtacaatggtgtgatctcggctcactgcaacctccgcctcctgggttcaagcaattctcctgcctcagcctcccaagtagctgggactacaggcacctgccaccacacccaactaatttttgtatttttaatagagacgggatttcgccatattggccaggctggtcttgaactcctgacctcagatgatccacctgcctcggcctccgaaagtgtttggattacaggtgtgagcccggcctgagattatttttttctaaacacttatttaaatcttggaatttgtaaattaacattcattcaatcataatatggagtttataggaaaacagaaatgactcatatttaactaccattctcctctgtctccatttttccttctaaatgttataatgatttttttcttagttgtttactatacatatacacacatatacatatgataagaatttggtgtactcagtgtcatttgacaaagaaaagaattgaggatgtaaaatgagtttgtttcttttggtggagtgagaattttgttataatcaagttagctaataattaagtagaaatattgaaaaagagataaaagactacacattgggtacagtgtacacggcttggatgatggttgcaccagaatcttagaaatcaccactaaagaacgtattcatgtaaccaaatactacccattccccaaaacctattgaagtaaaaaatgacataaaaaaggaaaaaaagaaaacagaaaccacccaaaagaaagaaagaaagaacgaatgaacaaaagaaagaaagaacgaatgaacaaaagaaagaaagaaagagaaagaaagaaagaattatttgtggtattctggaaataaaagtagtgagggatttttacgaataaagtaccagaaggatagacctaaggtctctaggaccttttctacctggacagatgcttacacatttcattatataatatttaaatatcatgttcgttaatatcactattggtctcgttgaaaaaaatgttaaatgttgggaagctgtcaagctcattctggatgtaaattttccaaaataggaatttcacttgaaagcttgaattctatcactagcaacaaatactgttaattttctttattagtgacaggcttacttttgagaaaatgcctgtcagctatctaagcttgaataacatagcttgttgttcagtctttcaagtaaaaatagtattccatgaagaaaactgtctagttcagtttgcaactcagtcacacaaatgcctttcctggagataaccatcatacttagtatacaaatgtgctttatacatatttctgtttcatcataaacagtaataaaaatatatgtactaaagggttgatatttattaaaactaatattttttattgctttatcaaggacattcttaaagttgaatttatttttcactgtaactgtgtagttgtgaagaatacaatgatttctgctacagtttggtgctgttgccttgatttgtgttaaggtgctaacagttttgctcaccattgcttttgtaccatcagtgcaagtgtcaacacagtggaaaaggcaaataatttttttgtattcttatgtatttagttttacctcttggacttctgaaaggatctcagggatccccagagatcagcagattatacttgcttcattttcctgaggttcctagaggcccttctatggaagtcatgagtaaagttaagatttaatcctggagattgtattgggcagggtttcagtgtggactaggtcttggacatttgacagaaatatggtcagagggagtgattagctctgtggtttctcctaagcaggagtaccctgcaccactacccccgggccacaggaggtgagcagtgggccagtgagcattacagtctgagctccacctcctgtcagatcagtgattaggtggaacagtttcatcccaaaccaccccaacacccccgtctgtagaaaaattgtcttccatgaacctggtccctggtgccaaaaaggttggggaccgctgggttaaagaaacttttgtggagcgaaatgagtctggaactcattaggcaatcaagtatgttcaaagaagaaatccataagcatttagtcaagacaggctgagggccaggctcacctgggtactgtgttcttagctttaaaaaggataaatagcagcagagatattggtgatgacagctttcaatatatctcttgagtcacattgctccagtctgtgtacaggtggccttgcagtctgtagaggtggtacgcaactgtcatcctgggttatccagtctccattttcctgacagctttgcttctttcctgtgttagctcctttgtttcctaaaccctcatgtcttcctctgtcttggttgccagtagctttttgatgttgaacctcctggaataattatctaattcatttctttttcctttagatatgtttcctgcaagatttattcaactttatcttctacttttattaaatttttcttttctactattagagtttaatctccaggaggtctttttgaagtctctgcatgtttctttttatactatcctttcattctttcaacagattttccttgccctgcatagtctctttttttcctaacattgtttttaaatattgatttggtttcttttatgttagagtttttctctgatgtctagtaataattaactgtctgctgatggttaaaagtgagggactaaatagccagttagaagctttaaatgtataggcaggttgcctttgggtgagcttcttggccttattgttgatgaacattctcatatcagtatcagggtctaaggggcacagtcttcccactgtgtttggatggtaaggggtgaagaaaactgactgaagagactgctgcattcagcattaattatgcatattttcacttaattctcttccatttttaattttacttgtatttgtattttattttactttatttttatcttttgagatggagtcttgctctgtcacccaggctagagtgcagtggcgccatctcagcttactgcaacctctgcctcctgggttcaaatgattctcctggcctcagcctcccgagtaactgggattacaagcacccatcactgcctggctaatttttgtagttttagggtttcaccatgttggctaggctggtctcgaactcctgacctcaggtgatccgcctgcctcggcctaccaaagtgctgagattacaggcatgagcctctgcagctggccttattttctttttcattttatttttttatttttattttttggggtcagtcttcctctgtctcaaaaaaaaaaaaaaaaaaaaaagcaccgcagcctcgacctcctgagctcaaacaattctcccacctctgcctcccaagtagctgggactataggcacataccaccatgcctgactaatttttttactttttgtaaagatgcagtctccctatgttgcccaggctggtcttgaactcctgggctcaagtgattctcccacctcggcctccccaaaagttgagattacaggcatgagccattgcacccaaccccttccattttttgtaccatatccctaccatcagttgccttttgcgacccctttccagagaccatttgctttacactttcttggaaaacagattccaaaattccgccagagttagtgtaggacagacattgaagatcatggagtagggaaagtgatagaggaatcaaacagcttttaccttgcttctcctgattttaggtcacctccctttcatctcatttcagagacctggataaaatacaatgaatgtattacttgttaacctatactggtgtatactaccagttaaaagaaaaaattaggctgggcgcggtggctcacccccgtaatcctagcactttgggaggccgaggtggacggtttgcctgagctcaggaattcgagaccagcctgggcaacaaggtgaaaccccgcctctactaaaatacaaaaaattacccaggcatgatggcgtgctactgtagtcccagctacttgggaggctgaggcaggagaattgcttgaacccgggaggcggaggttgcagtgagccaagatcacgccactccacgccagcctgggcaacagagcgagactctgtctcaaaaaaaaaaaaaagagagagaaaagaaagaaaaaaattcatggctacactgtacataagtgctgagtgaaggaaggatccagagaggatgtgcatagaatttgtgctaccatgatgctccacaccccactactttcaaaaatagctaattcgtgcttctgctttcttcctcccttttcaactgcttatggagttaacagtcattctcccaagagcataccagaacaaaagggactgaaaccctagcatatcacttatttaaaagtactgagttgtgacttccttctaaagatttttgaggtggaggaggatctgcatactaattgccttcccaaaatgttttaaatcatctgaatacttcattaagtttctatataccctctcttgtataaatatgaacatgacttgttgaaaatacttttttgggtgtgtttggtgattgtttaatgagatgtagattatcagtttgcattctgaatttaaagctagttgcaaaggctttattcatatgcatggcattctggaaacaaatttataagataatacctccttttgattagaatttgtatcatataggaaataggagaagtagtttgttaaggtagcaaatagaatttattatttcctaaacaaagtcaattatttttttcttattctgtatctgaatttatgaattattatgatgatgctataaaggagtttttttctagctgtttaagaacatttgccaaggagccaaactcaagacataatgcacttcaaagttcatgggaaaacatttttgatgttatgttgttatcacttgaagctcaaaatatgccagtaacatagtccttccctccctcctctttaagaatgaaagacaaaatacaagcttaattagttttgaggtcctcagggtgtaggagttaaattcctccagtattacatgatgccaaaattgatgctagttccattttttctcctagtggtcttgatgagaaatttaatatagcattattataaatatatattaaatatcctctgtcatcttatttcctgaaggggtataaaggtcaacatgtttttactgttacatcctacccactgcccagtagtaaacacacaatacatatctgtatgtgtttcttccagtggttttaatttttctgcataagatagaattaccaatcttaaggaaaacagagtacacaggcaccaaattctgtgaacctgaataacagatattatgtaattattttttctgtcagtagaaaaagatgagctgtagtagtagtagtagaagcctggaaaggcagtaatgctgacattctggactattgcctgtgtcctctcaccactttttatcacttctgactacgtcttactcctagaaaatcatagcaagtgggataggttgactaaatgcatggactggtttccatctgaatttattgctgcaaactgagcccttatcaatgtgtcatgcaccctggacagacgatgatatatgtcatacaaatgttttcttccagcctgtggcttgtctatttgctttcagaggcttttaaagtaatgcaatccaatttaatccattttctcttttatagttcataatttttgtgttttcttgaagaaatctttgcttaaccaaagattaggttttattttaagttgttgattctttttgagttaatttttagatatggtacaaagttggaaatattctcctttgtccactgaattaccttgacaccctgttgaattcctgatgaaactggtaattttctttcttgcttttttttttcttttttttgctgttccccccttccttccccctgaaatgggtaattttctaggaaaatataatttgccaaaggaactcaagaaataaaaatcctatgtagactagtgttaaaatgtgattaggccaggggttttgtggacaatttaattcatgttgatgaagcagatgattgcagtagtccctccttatttatgggggatataccaagaccaagaatgccagtggatccctgaaatcatggataatactgaaccccaatatgtactgtttttttcctgtatatacatacatacatatgtacctgtgataaagtttggattataaattaggcacagtaagaatttaataacaataactaataataaaatagaacaaataagtaaaacaaagattacttgaacacaagcactgcaataccgccacagttgatatggcaactgagatggctgctaagtgattaacaggcagtgaacacatacggtgtggatatgctggacaaggtgatggatgattcacccctgggcaggacagagcaggatggcatgagatttcatcatgatactcagagtggcacatgatttaaaacttacaagttatttatttctagaaattttccatattatatctttggactgcagtcaaccacaagtaactgaaactgcagaaagtgaaaccacagataagaggggacagctctataatgctatatcaatcagtatagcagagaaaaagaaagtatacctgtttattttataaagttggcaaaatcttgataactaaaagctgacagtctgggcatagtggctcatgcctctaatctcagtcctttgggaggcccatacgggaggattgcttgagcccaggagttcaagaacagcctaggcaacattgggagaccctacaaaaaaaaaaaaaaaaaagacacaagaatcttttaaaaagttagccaggtatggtggcacacatctatagtcccagctatttgggaggctcaggtgggaggattgcttgagtccaggaggtcaaggctgcagtgaaatgagattgtgccactgcactccagcctggaggacagagcacagccctatctctaaataaataaatgctgacaaagatagtagaaaaatacatttgtccggctgggtgtggtggctcatgcctatcccagcacattgggaagccaaggcaggcagatcacatgaggtcaggagtttgagaccacactgcccaacatggcgaaagcctgactctactaaaaatacaaaaaaaaaaaataataataataatagctgggcgtggtggcaggcaactgtaaccccagctacttgggaggctgaggcaggagaaacatctaaacctgggaggcagaggttgcagtgactcaagattgcgccactgcactctggactgggtgacagagcaagactccatctcaaaaacaaaaaacaaaacaaaacaaacaaacaaatacatttgttctattccacttaatacagctgtagaaagtctatataaattacatgtagattaaatccaacaaatcattattttttcttattacaaaaacaatatatatttctttgagaaaaatgagaaaatatggcataaaggagaaaattttaaggccaggtgcaatggctcacacctgtaatctcaggactttgggaggctgaggcagtggatcacctgaggtcaggagttcgagaccagcctggctaatatggtggaaacctgtctctactaaaaatacaaaatttagccgggcatgatggtgtgcgcctgtagtcccagctacttgggaggctgagacaggagaattgcttgaaccctggaggcagaggttgcaataagctgagattgtgccactgcacaccagcctgggtgacagagagagactccatctcaaaaaataaaaaaaggagaaaaatttaaatcatttgacctttctatccattggtaattactaataacattttgatatatctacttttatgatttttttctagggaagttttctatgtacagtagttacattttttaacatgccaatttatagctagctgttttctgcttgtttggtgcccgcccccatgcccagctaatttttttgtatttttagtagagacagggtttcaccatgtcggccaggctggtctcgaactcctgaaattaagtaatccacccgcctcggcctcccagagtgccaggattacaggcgtgagcgaccgtggctggcctgtttttgtccccatttgatatgtcaaatctataaatatattgaaagaatatgacccaagaggatttattgcaatatctaaggattatgtagatatattatcactttacacatatatatacacacacacatataaagtgtaaatatatatgtgtatatagtgtaaaaaacatatataaagtgatacatgtatgtgtgtgtgtatatatacacacacacactttttttgagatgaagtctacctctgcctcctgggttcaagcgattctcctgcctcagcctgccgagtagctgggactataggtgagcagccaccatgcctggctaatctataaatagttacaaattattaccttgataggtcaaaaactagaacgaaaatgatatgcttgcttatctttgtagatgggaaaattcaactcttctagttaaaagctttagttaccctaggaataggataatgtatttttattcttaaatacttaaataatatcaacatctgcatttctaccaaattgatttaaaaattgataacattaagacacattttataaagtaaaacttgttagataaagtctcctttgaccacctttgtctagtgacaacccatacataccacgaatgttgtgtatatccttctagttcatttttttctgttacaacattgcttacatactttgataggatcaagaccagttctctaggccagatgcagtggctcacacctgtaatcccagtgctttgggaggctgaggcaggcaaatcgtctgagcgcagcctgagcaacattgtgagaccccatctctacaaaaaatacaaaaatgaactgtgagtggtctcgcagtactgtggtcccagccactcaggaggctgggagaatcacttgtgcctgggagattgaggctgcagtgagccattgatatgggtaggctttgtcttcccacccaaatctcatcatgaattgtaaaccccataatgcctatcatccccacgtgtcaaggtagagaccaggtggaggtaattgaattatgggggcagtttaccccatgctgttctcatgatactgagttctcacaagatctgatggttttataaggcgctcttcccccttcactcagcccttctccttcctgccaccttgtaaagaagacaccttgcttctccttcacctcccaccattatggtaagtttcctgaggcctccccagccatgctgaactgtgagtcaattaaacccctttcctttataaactacccagtcttgggcacttccttatagcagtgtgagaacaaactaatacaagccatgattgtgccactgcactccagcctgggtgacaggatgagaccctgtctcaaaataaaagaggattgttatctatagaaaatctaaaggagttatttacaataacaacccaaattataaaatacctaggagtgatctcagcaacatagcccatatgataaaactagaagtgtgctgtagataaataaatagatccattatgtcaagtaatgggaaaaactggaaaagttattggtgtcatttattcctaaatttattatatatgtttaatacaacattaatagttgaagagaacttacattagcttttgatatttgacaaagtgatgatcaaatataacttagaaaaaaattaaagctaagaagttaacaaactcccctttttaatgggtttatgatgccagtttggtcacactaagttttgtaaggtcttgggtgtatttttggactttatgttcttttctgttgaacaatttgtcagtttttgtaccagttctacaatgtgtttattactacagtcaaaacaacgtcactggctgacttctgcatgtcctatcttattcaaaatgacctttcatgatcagagctttgagttgacccaaaggcagggtaatttttacaagattactgtttgaaacgtcaatgaaaccagagcacatgggcatgtgcacatatatacacacacatacacactcacatgttataattgaggcttccattgaatgaaagtaatggtagtataatggaccatcttgtagatggtgctgatggcctctaatcctcgttgaagattcgtgggtttttttgtttttttttttttgattcctcatcaaaccagtgttttatcttgcggtagccagagtaacatcatatcagattgtaatctatagctatagctttcctttttactattgcataaaaattaatattatatttgacctctttaagaatttttagatttcttatttaggtttcctttaatgctgctatattctgtttcttttcattgatttcttaaaataatttagatgctctaaaacgtaggcctggctgctttattttgtccatttccccgcacagggtgagtcagtcttttcctcacttcagtttagagctcagtaatcaaagggcacaaatagcaagaaggcttaagaattatgtcttaaatagtataagacaaaagtggcaccaaaggaaggacattcctgctaggatggggagcttggcttaatactaaaggtgtgtatttgtttagttctggttataatctcataatacatccgggatacatggcttaatgttggtttcagtgaaggccagttactatcctaaccccaccccaaaggtgaatgatggatggatgtatgattggctgactgaatgacttattaattcattcaataaatttttgttggctcactgccctaactgccatgcaggaaaaagatgagtaagttacattttcagctctcaaagaggagattgagaacttttaatgtgagacagagtgaagttattttatacaaataaaaatacttgtgttattggaatttcctgccatgttattcagcatgatttgtacttgtggaaattattaaaacttaattgtatagcatgtgtagtcagccctctgtttctgagggtttcacatccatggatttaaccaaccacagattgaaaatgcttggggaaaaaataataattatacaacaataaatgataatgcaatttttaaaaaatacagtataaaaactttacatcacatttacactgttaggtattataaataatctagagaagactaagtattatggaggatgtgtataggttatatgtaaacactttgccactttatataagggacttaaacatccatggattttggtgtccaaggagagtcctggaacaaatcccccttggatactgaaggatgactgtatttcccttcttttcctttactttttatttttaaggctagtcaaatgaagcagtgggaggggagaaggaacaaagaaatcttaagtggttgtgatcaattagttgtaaaccccactgcattctgaccagcccatatttcttttcctgtatctgtgttctttgaacagtttagtggcgatttctttagggcaagttttttgttttaccgtgtttgttttgtatctaaaaagagaatttggtgaccctggggaaataggtaaaaactagagacttctttttttgagacagagtctcactctgtcgccaggctggagtgcagtggtgccatctcagctcactgcaaccttcacctcccgggttcaagcaattctcctgcctcagcctcccaagtagctgggactaccggcgcatgccactgcgcccagctaatgtttttgtagttttagtagagacggggtttccccatgttgaccaggctggtctcaaactcctgacctcaggtaatccgcctgcctccatctcccaaattgctgggattacaggcatgagccaccacacccggcctaaaactagagacttcttaactaccttagagagtatagatagggctgggcatggcggctcatgcctgtaatcccagcactctgggaggcgggaggatcccttgagcccaggagttcaaggcctttctggggcaacatagcaagaccttgtcttgacaaaaaataaacagaattagccaggtgtggtggtgcatgcctatagtcccagctatttaagtggctgagatgggaggattgtttaagccagggaggtcgaggctgcagtgaagcatgatcatatcactacactccagcctgggcaacagagcaagatcctgcctcaaataaataaataaataaataaataaataaataaatgagtaaataaatatcttgcgctctcataaaacatacttgtacattgctaataataatgctccatgtagcataagtatggttaaaaggttatataaacctgtgcttcagtaattttgggtttctcatgaaagactatggctagagagtttttgttgtatatgtaggtttatggtgtagcaaagaatggagactcagatccagattacttagatgtgaatcctaactttgccagtttgccagtttttaacttagaccagtttactcctatgtgactcagtttcctcatatacaaaatgggaataataaatgctgtcttgctcatagacttgtaagaattagacaagttagtatatgtaaaatatttagaataatcgttgggattataacacacgttcaattcatgttagctattattattcaaacagaattgggagaaggaatacttgggaagttgaatttagtttattttctaagttttagctttcttcaaatcttttcacacataacagagtagataaatttgaacttaactttattttatttatgttctaatttttcagataccagtttttaccatttagggaaatgatcagaaaccaggaaacataaatcaaggagagaagaaatagagaacagaaatcagctttgagtgattaaaaactggtagtgctgcagttttgtccttctaagtgtttcttacaggaactagaaaagcagagctatttttaaaaattattaattaattatttttttatttttatttttgaggcagggtctcactctgttgcccagactggagtacaatggtgtgaacagggctcactgcagccttcacctcctgagttcaagtgaccctcctgcctcagcctcctgtgtagctggaaccacaggcatatgccaccactcccaaccttgttgcctaggctggtctccacctctggagctcaagcaatcttcccacttcagccttccaaagtgctaagattacaggtgtgagccaccatatccagctgaagagctattttcatttatttttatttttaaattttatttattattttttttagtcagagtctctctgccacccaggctggagtgcagtggcaccatctcagctcactgcaacctccgcctcctgggttcaagcgattctcctgcctcagcctcccaagtagcagggactacaggcacgtgccaccacacttggcttattttttctatttttagtagagatggggtttcactgtgttagccaggatggtctcgatatcctgaccttgtgatctgcccgcctcagcctcccaaagtgctgggattacaggtgtgagccaccgtggctggcctgtttttttgttgtgtttttttttgagatggagtcgtgttctgtcgcccagcttggaatgcagtggtgcaatctaggctcactgcaacctcttcctcccaggttcaaacaattctccctgcctcagcctcctgggaagctggggttacaggcatgcaccaccaccccggctaatttttgtatttttagtagagatggcattttcactgttggtcaggctggtctcgaactcctgaccttaggtgatccaccttccttggcctcccaaagtgctgggattataggcatgagctaccacgcccagccttattttttaaattttatttatttatttatgtatttctttattttgagacagagtctcactgtcacccaatctggagtgcattggcacgatcttcagctaactgcagcctccacctcccagggtcaagcagttctcctgccttagcctccccagtagctgggactacaggcatccaccaccacacccagctaagttttgtattttcagtagagacagggtttcaccatgttggccaggctggtctcaaactcctgacctcgtgatctgcctgccttggcctcccaaagtgctgggattacaggagtgagccaccaagcctgaccacaacaaagtgcttttgaattactggcttgaagaggtttgatataaacactatttatatagtcatcctagttcttctacaggaatttttattgagtcgtagtgtaactaggtgttcattactgagaatttttatttagtagagaatgaaggctatattctcctattcatgtactggaaaatgatattgtttaaggagatttcttgttaggaatttctgcataacttttacaaatgttatagctagctgtcatcagacacatactgtgttcccactggatatctagtgttggtaatattcaggtttctttctcactcacttaaagtgaatattgagggccagccgaattaggaagagttgtgaaagagagagaaggaagaataattggcagtggctaatagtcatctctttgagtcactagtcatagtcacatgtttcaaacctctgtgatgtgggctccttgatttctgactagtttctacacatcagtgatacctcttggttccttaatagatgtcaactgggccgggcacggtggctcacgcctgtaatcccagcactttgggaggcagagatgggcagatcacctgaggtcaggagttcgagaccagcctgaccaacatggtgaaaccccagtctctactaaaatacaaaaattagccaggcgtagtggcaggcgcctgtaatctcagctactcgggaggctgaggcgggagaatcgcttgaacccgggaggcggaggttgcggtgagctgagatcacaccactgcattccagtctgagcaacagagcgagaaaccttctcaaaaaaaaaaattgtgaatataaatagtccaatagtttgaaactaaataaaatgaaacttttatttagctgtgaagatttcttcagcgcatactaccaatagtagttggtactatgaaaaacagataacacatgctgatgaaacgtggaattgggaggccaggcatggtggctcacgcctgtaatcccagtactttgggaggctgaggcgggtggatcacgaggtcaggagatcaagaccatctggctaacacagtgaaaccccatctctactaaaaatacaaaaaaaacccaattagccaggcgtggtggtgggcgcctgtagtcccagctactctggaggctgaggcaggagaatggcgtgaacccgggaggcggagcttgcagtgagccgagattgcaccactgcactccaacctgggcgacagagcgagactccgtctcaaaaaaaaaaagaaacgtggaattggttctttgagatactctgttattactggaagactttttttttttttttaatagagacaagatctgcccccactggtctcaaactcctgggctcaagcaatcctcccaccttggcctcccaaagtgctgggattacagtaatgaacctggactgcacctggccgtggaagaattctgagtgggctttaaaaatccttttaagttcagcatgtccagtagaactttctgcaaagatggaaatgttctgtatctgccactctcccatgtgtagtcatatgtagctagctactgagcacctaaaatgtggctagtaaaagtgagagactgaattgtaaattgtatctcattttaataatacaaatgtaaataatcatgtgtggctagtggccacagtattggacagtacacatagacatttgagaactgagcagcaagtttgataaccaatacttctctaccaatgattaaaataatgtaattcttatttacttttagtatgcttggaaatgttgctttttgttttgctgccattagaaccaataacagtataatatttggccggacgcagtggctcacacctgtaatcccagcacttcgggaggcagcgggatgtggatcacttgaggtcaggagtttgagatcagcctggccaacatggtgaaaccccgtctctactaaaaatacaaaaattagccaggcatggtggtgcgcacctgtaatcccagctacttgggggcctgaggcaggagaatcacttgaactcgggaggcggacgttgcagtaagctgaaattgcaccactgcattccagcctgggcaacagagcgagaccctgtctcaaaataaaaaataaaaaataaaaaggctatagtattaggaagaagacagaggaagttaatttaggaatgtgttgtttactgcgggtcttcacttatacatcatcttcccactgaggcccttccgctcacccagtttataatttagcacccttcctttcagcccaccttattttcctttcctcccttttttactctgtggtacttgtcaccatctaatgtaatgggaagagggcagggattattttcccctgttgtattcactgctgtgtcccaacacctagaatgatacctgacacattagaggtactcagcaagtatttgtggagtgaataagtgagggttgtggtttctcaataattataatctaattcatttaacacttattttgcatatagcaagcattgagttagattaggtatatagagtacactatggtcactaccctttccatagtaaaacatttatttctttgtgagcttcaaatcactgacaagaaaaaaatttagaaaactaaaaacatttctttgaaccattatttaaaacagaatattgaatcggttaaatcattggttggaagggacttggcaatgatttgaatcagttgtctgatgtcacatggtggtttaaagttccatcagtgtcatttacatcctcttctcatttccccttttccttcatcccacaacatatgaaccttttgctcacttactttttctacatcttctcatctccattcagctagttctcactttcttctaggcctgcctttcccactgactttactggaccttaaggaactcctcaaatccctatccaatattaactgaaactttcctgttgattatgatttcttataactccttcctcagttccagaatcttctccctatcccctgggatatcctcaagagcttattggcctgaaaaccaaaacttgaagagaaagcaacaaggcagaatccctatatctccagtttctttgagtgtgatctttcattttgtggagctgaaagccatcctgctggcataatttcagtttctctcgctaataaaagtccaacatattgtaggttttaaacatatacattacttcatgcctaccattattgagagaagaagaaataatgtagcttctgtgacataaaagcatgacagaacctctccagtttttcctaaagaactgtggtggtttaatttaaactattggggaggtggggttcatttatatagagaatctaaatggaaggagaggagccaaaatatattaagcacctctaatcattaggtagtctttggaaatttttcttatttaatcctcataactctatgagcagttttcttcattttacagatgtgtaaactgaagtgcatgtaagtaaagtaactttccagagtaacctaatcagtaaatgggaaagctgagattttacatagttatatgactgtaaaccctgtgcttttttccattggtaagccatgctgccttctagaagtggaggcaagggagggaacaagagttacagcgtttgatgtagaataggaggcagtttgtttgtttttcacatccagtgagctagccacataaataaaccagtattatttgtggtaagtggcatgagtatctggtgattccagtggccctgccttaactttaaccttctgtcgctttcagcctgttcttcaggctagttcacatgaagtacaaacacttcctactaaggatcttgagcctcacagttgtgattaaatgagggagtatgtgaagcttcatatgacaaatctatcccctttcttactacttgcaaagcagtatgttctcaaaaaccacatgaacataccattttttccccacaaaagcaagagtttcacagcagctcccaggattgtgtggaatgatagagtagtctatggtctcgacgttttttctggcctccgtgagaaaagttccactgttggaggtcggaagaaatgtagagatgatgggctattctatccatggtagaatagtggatgaatagcctaccttggatgaatatagtggatgaatattctgccagggtaaaatagtctatggtagaatagaatctctgagaaaagtttaaaattaaagaatgctgtttctttccttatactcaagattaataatactcggtgcgtgtatactgtacatcaaatgtgacaagcattgagagtttaaggataaatacatcatgggccctgcccacaaggaatttctagcttaattgagaagtctgaagattactgcatttcaggctggtgtacttaataacagagtatgataacttaggcactgtgccaacatatattggtaggtgtaagtgtgtctagctttgtcctgaggtcagagaaaaaaacttttttttggtggtgtgtccagaaaaccatagttatgattagctctttacctctcctgtattatcccttgatgcttgtacctatttctcacttctgtcatccctcctatggctgactctttcaggttcttttttttttttgagacagagtctcgcactgtcacccaggctagagtgcagtggcgtgatctcggcttactgcaagctccgtctcccgggttcacgccattctcctgcctcagcctcccgagtagctgggactacaggcacccgccaccacaccaggctaattttttttgtatttttagtagagatagggtttcaccatgttagccaggatggtcttgatctgctgacctcgtgatctgtccgcctcggcctcccaaagtgctgggattacaggcatgagccactgcgcccggccttccagacagttcttaatggatgggtaggaatttgccaaatatatctaggagagaaattcctggcgaagggagcaatttgtacaaatagatgagaaatgaagagtttgcagattaccagcaaggctttctaatttccacatgtagcttgaggcacatgttatcaattgtaggatgttacctcccttaactatccagtgccagccagcctagagtagatcatggggtaaagaaaagaaagctgctctttcccctaattatatattcagaggttgaaaattagtctttgatgtgaatatgtatttgtgtgatttgctagtaatttctgttggtcatcacgtcctagaggaaagtgacttcttcctaacccctcactggagtttacctccctcagacatctcaagccataagaaagaagtatgctgaattaagctgagggagctataattaaaatagtcaatagctgattttcctaggtaatccaatttgtattcatacttcagcataaaaatacatttaatttaaagcattctactcttgtgattgatcttgtaaactgcttattaaaaatataggctgggcacagtggctcactcctgtaatcccagcactttgggaggccgaggcaggcggatcacgaggtcgggagatcgagaccatcttggctaacacagtgaaaccctgtttctactaaaaaatacaaaaaaattagccaggcgtggtggcaggcgcctgtagtcccagctactcgggatgctgaggcaggagaatggagtgtatccaggaggcggagcttgcagtgagctgagatcgcgccactgcactccagcctgggccacagagcgagactccatctcaaaaaaaaaaaaaccaaaatatatatatatatatataaacatggggctgggtgcagtggctcatgcctgtaattccagcactttgggaggccgaggcgggtggatcatgaggtcaggagatctagaccattctggcctcccaagtagctgggactacaggcacgtgccaccatgcccagctaatttttgtatttttagtaaagacagggtttcaccatgttagccaggatggtcttgatctcttgacctcgtgattcacctgcctcggcctcccaaagtgctgggattacaggcgtgagccaccgcaccagccactacaatacaatttttatagtgaatttaaaacaccaaacaccacattccaaaaagaactctgagtcagacaccaacagtaaaagcttaccgtgatctcagtctgtctttagtaatgaagcccaatgactaacatataagaagacaattcaaactatactttgttcaggaaaaggaagataaagtcttccacatcttctggatggaacctgggaaagatattccacagtgtcttactgcttataaacaattttaacaaatcagcattagcttaatggagggaaggaacaattcatggcttcctgatgagaaattcagttcacatttatgtggcctgctttggagcaacttgtgctgttagctgatgatcttaagtttctctgttgagcactacctgtggaactgtccaaatctgggcttttaggaaaataatatcttggccgggcacagtggctcacgcctgtaatcccagcactttgggaggccgaagtgggcagatcatgaggttaggagttcgagacgagcctgaccaacatggtgaaaccctatctctactaaaaatacaaaaattagctgggtgtggtggctcacgcctgtaatcccagctactcaggagggtgaggcaggagaatcacttgaacccaggaggtggaggttgcagtgagccgagatcgtgccactgcactccagcccaggtgacagagcgagactctgtatcaaaaaaaaaagaatatctttggtatgcccagcaatttataggttatatgtggtaattagaaacagttctttaataaaacaaggaaggcttaggtcgggtgcagtggctcatgcctataatcccagcactttgggaagctgaggctagaggatctctctctctctttttttttttttttttgagtaaaactttaaatttttctcccactaggatctcttgagtccaggagtttgagactgcctggacaacatagtgtgaccctgtctctataaaaaaaaattaaaaaattagctgggtgggtggcacatgcctgatgttctagctactccggaggctgaggtgggaggattacttgaggccaggagttccagtgagctatgatcgcacctctgcactccagcctaagtgacagagcaagactctgtctgtaaaaaaaaataaaaatgaaaaaaggctctcattagagggctttaagtgctgtctaaatctcaatggtagcttcaattcctttgcctattaaatcttatttttctaaggtgttttattttttttgagacagggtctcactatcatccaggctggagttcaatagcacgatctcagctcactgcaacttcgcatcctgggctcaaacaatccttctgcctcagcttcccaagtagctgggatcactggcatgtgccaccatgcctgactaatttttgtattttttttttttgtagagatggggttttaccatgttacccaggctggtcttgaactcctggactcaagcaacccccgcttggcctcccaaagtgctgggattagaggcgtgagccactgcacctgacctaaggtttcttgttctttccctaagtaaaataggaagagaatcacaaattttaattctgctacttccccttgagggactaagctggggagaataagtactctaaaaagggagtatcttattagctaacaaataacaagagatagctgtctacttcttacaaagttaaagtgattcttccttttacatttctaaaacataatgcatggaagactaaaatgaactcaaggctttattgttaattttaatgtcattagtgtgccagtatcgtcctacctttctgcttgtctacttaccaattagcacagagtaaatactgattgttagaagaaaaatgaaacatgatggtcagggaacatgtagtgtcttggcacataggcaacagacttagcatttctttctttcttttttttctttttttctttttttttttttttgagacagtctcgccctgtcacccaggctggagtgcactggcacaatctcagctcactgcaacctctgcctcccaggttcaagcaattttcctgcctcagcctcctgtgtagctggtactacaggtgccagccaccacacccggctactttttgtatttttagtagagacggagtttttccatgttggccaggctggtctcaaactcctgaccccaggtgatccgcccgcctcggtttctgaaagtgctgggattacaggagtgagccactgcaccgggcctagacttagcatttcattttattttgttttttattttattttttgagacagtctcgctctgtcacccaggctagagtgcaatggtgcaatcttggtcactgcaacctccgcttcctggattcaagccattctcctgcctcagcctcctgagtagctgggattacaggctcccgccaccacgcccggctaatatttgtatttttagtagagaggggtttcaccatgttggtcaggctcttcttgaactcctaatctcatgatccgcccaccttggcctcccaaagtgctgggattacaggcgtgagccactgcacctgtctaaatttagcatttctaagagattagttgtagagcatggacttccttggaaaataaatatttcttttggagcttaaaaattcttggccatttatacaagagtttcagtaagtccgggagtcagactaaggatacctggattttagtcctggctctgagcaggcatttaacctctttgaacctcagtttcctccttctgcaaaaagtaggagattgaaattgagccaaaagattgctaagaatcctttcttttttttttttttgagatggagtttcactcttgtcaccccggctggaatgcagtagcgctatcttggctcactgcaacctctgcctcccaggttcaagtgattctcctgccacagcctcctgagtagctgggactacaggcacgtaccaccaagcccagctaatttttgtatttttagtagagacgggatttcaccatgttggccaagatgttctcaatctcctgaccttgcgatctgcctaccctggcctcccaaagtgctgggattacaggcatgagccactgtgcccagcccctttcattctttaagttttattgacactctcacaatatcgtagaatcagcagtgagccatgccaagatttggcttttattttattttatttattagagacagggccttactatattgcccaggctggtctcaaactcctaggctcgagggatcctcctaccttcgcctgtccaaatgctgggattataggaatgagccactgtgcctggccttttacatttggcaggtcgtttttattttggcatttaaatttggcagatggttttagcagctatacctagatccataaatctatcttgttatactcttgtatggtcatgtctacataaattagattagaaggtactgtttctgggctgtgtgtgtgtgtgtattttcaatgtgcccagtttgaacttacccaaatattcaaggtaatgcttttatctgggtccttccatttgcttaatatttctatacaccaactggttgtgttcagactttctctctggcctgcttcttccaacttgctccctggagtcatactcttgacctggcccctcctttctcgatttgcatttattgagaggttttcaggtaccaggaacattacaaagcactttatttctgttcatgtcatttaatccttacaaattccctgtattaacaatttttttttcttcgagacagagtctcgccctgttgcccaggctggagtgcggtggcatgatcatggctcactgcaacctctgcttcctgagttcaagcgattctcacgcctcagcctcctgagtatctgagattacaggcatgtgccaccactcccagctaatttttgtatttttagtagagccagggtttcaccatgttggccaggctggtctcaaactcctgacctcaggtgatctgcctgccttggcctcctaaagtgctgggattataggcgtgagccaccacgtccagccttgtactagtaattgttgtatacttttataatactagaaaactgagacttagagaggtgaagtaacttgtctagtgttaacacttaataagtggtagagctggaattaaaatttcaatctgactccaaagctcatgctcttaagcaatatactgtgttagttccatgatgatgatgatggtgataacgatgttgttaattacaatatgttgagcacctcctgagtgacaagcaatgcattgccaccttttgcattcccattttacaatagtggaaactgcttttgctcatggtctgcttttaggctaataagtataagtacctaggttccaaagtattgggcattattgaattgtgctttcagtgcatttttccttttactttctttcctgttttaatggtcaacatcataatgtttttctaattactaccagtattaacaatttaatgttgtctgaatgtttctgtacttttttcccttactgatgccttagcattgaggttttcttatttgttacctttgctgttttttctctatcaaaagcagataatggggctaagataatagagaagggattgtaccaaggacaagctaagtacaggaaagttcagatgctagaaatctttctgggatctcagtttggagaataaagatttaaatgaaaaactcccattttttggtagctgtctttttttaaaaaattattttaatttttttttttagagacagggctcactgtgttgccgaggctggactcaaactcttggtgtcaagtgatcctcccacctcagcctcctgagtaactgagactacaggtgcacgccactccacccagtggtagctgtcttttattgaaggaatattagggctttggtacttactagcttggtgatattagacacaggatttgaccttactagccctagttttcttacctgaaaatagggtaaataaatatacctcacaatgcatggttagttgtggtgatgattaaatgcagtaacaagtgtaaaactccttaatatattactcagaattgttagcttcctcttttaccttcagatgttagtggaataatccaggttatgtggaggttatgttaaggttgtgttatgtgtgtcttttttacatttagaaaatttagtgttagtatactaaataaaaatttatcaagctgtatccttaatatttatgtacttggctatatgtaagttagttacggataaaaaaggaaaaatcaatgtgcaaactggacgttcatttgctgcatgtgattagctgatctttccatgtattatgcccagcatgtagggctactctttgtaattttttattccccaagatcatatggaaattattgagttttagcaagaagagactgttatataataccttccaaatatttatttcgtttattgttttagtaagcagattttcagaaatatttgtttgtattctcagaaaaggtatattcaatcctaaaatactgtttctaatgttattaattcccagtacatagatctcaccttgctttaggcatgcccacctacaggtaggaaataaaattttagaataagcagcatgtcttagtctgttcaggctattataacagaatactatagactggggggcttaaacaacaaacatttctttctttcttttatttttatttatttatttttgagacagggtcttgcattgttgcctaggctggagtgcagtggtgtaatcacagctcacaactcacctcctgggctcaggcaatcctcccacctcacctcccctccctccagtagctgggactactggcacatgccaccatgcctggctaatttttaaattttttatagagacagagtctcattatgttacccacgctgatctcgagctcttgggcttaagtaatccttcagccttggcctcccaaagtgctaggattacaggcatgagtcaccaggcccagccacagacatttatttctaacagttctggatactgggaagtccaaggtcaaggtgccaggagactgggtatctgtgagggccttcttcctggtttccagacagttgtcttcttgcgtagcctcacatgatggaaaaagagaactctctgggtcttttttgataaagtactaatcctattagtgagggctttaaaaccctcaatgacctaattatctcccaaagaacccatttcctatcaccatcacattggtcattagaatttccatatataaattgtaaggggacacaaacattcagtccataacacagtgaaatctgatacttttgaggtaaacctgtgtctaaaacacacctttgaatggactactgctcctattagccttttactcaaaaccatcctggtgtttttgtgtgattaaatttgtaaattctttggtgtactcttgagcaggctccctttcttctgtgactcagagcctggagcgttgcagccaagctcaaaagtcaggaacgggggtgtggacttttgggctatgccagtcagcagccagaatgtggttggcagtctcctccccttcctgcacttcagctctacacagtgtgcattctggaatgacaggcattcctgtgtgaagagtgccagtgtgaagacagttttgtaagaactgcaagtgctcaggctgtatgggaaacagaaacttcagcagatgaactgaccttatgccatttcctgatgtttggcagtgacactgaaagaggaccgcatgtcccctctttatgtggatttatcttttatgaaaagtttgcttttgtccgggacagtttgttgtcgtgagatacatcagacaatataatcatgggacaagctgatgtctccagaccggtaaatccagatgcagttggtgagtaatagaaggcagagaaacagaaaatcttgacagaagcaaggcagatttacaggtgaacttgagtatttatgtgaagttaaacacgagaatgttgatgatcccaactttgaaatgtttatgtttgtgaagaatgaatgaagtcatgcggaacatggcgagaaactttaaaaaattaagttttttaaaacttaaaaacttaaattcagtttattaatttatcgctcacagttttgttttacttgatctctttgaagttttttatattatattgctaaggaattatctgttaatttcttgccgttactaaagataaatgctacagaaacttatttagaattcagagatattttgttagtattttacagaacttggaaaatagaactgttgacttctatagacagaaccacttttaagaattaagtttttagacttggttatacattttcctaataagtctcaggcattttccattgcactagtgtttccgtttctcttaagtcaacactttgatataaacttttctgaagttagtactttacatttgaaatgttactaagggatagctagagagcaagctgattgtgagtatagctcagagtttcaaatcttctatgtgaaatggtagtcacttgtcactgcaagctcattttcctaatcttgtagggttttatatgacaatcataaattgggaaaaacagttttaagcagatgttcattaaagggttgcttaagtataagcaaaactagggaaagcctgtgaatcatttctagacattataatatttaagaaagatttataccttcactttgatttatggagcagcagaaaacatgttcagtcctaggctgcattttttgttttttgtttttcagaaacaaaaaatgttggtgacttaaaaaaaaagcataaagtgtggaaacacaggtaacactcccaaatgtttcataatgtagtgagattttgtttctaaaggtagtattttcacctgagagcttcctagatgaaatatcttcagtatttttcatgtattattgaaactgaggcacatggatcacaaagtgagtcattcagcaacagattttcagaactgaagtcaggacttgactcactttaccttgatcactagggctgtgtctttatcaattcattaactcatttaaaaaaatgaaatgtttcataaatagaaaaaggtataaagaaaaatataaagaatcatctggggccactccccagcctaacagatgaaatttagaacataaagataaacctcacactatccttctcttctgcattcccttctgatgacattttgcttctttgtttccagaattaaacactctcctatatttgataaataactcacttttgggctgtaaattctcctgtggtttctacgccaaacattagttgtttgttagcaagtatagtaaggactcaatgctaggcatttatctatgagatggaaatgaaagggctttgacaaacaataaattgtaaagcaagtaaaatttagtggtgagtggtggtatttaagaagaatgcccatctaagatctatatactgtattaaaaacttcatctgaggccgggcgcggtggctcacgcctgtaatcccagcacgttgggaggccgaggcaggcggatcatgaggtcaggcgatcgagaccattctggctaacacggtgaaaccccgtctctactaaaaatacaaaaaaatcagctgggcgtggtggcgggcgcctgtagccccagctactcgggaggctgaggcaggagaatggcgtgaacccgggaggcggagcttgcagtgagccgagatcgtgccactgcactccagcctgggcgacagagcgaaactccgtctcaaaaagaaaaaaaaaaaaaaaaaaaagttcatctgagtaacgtttggtatttgtatgcttctgaaaaaaagtaagaatcaaattcatcaattctttttttttttttttttttgagacggagtcttactctgtcgcccaggctggagtgcagtggcttgatctcggctcactgaaagctccgcctcccgggttcacgccattctcctgcctcagcctcccgagtagctgaaattcatcaattctattcctaccagtagccctaataaaagacatttgaggaagaaatagaaatcaggagcttaactaagttttttatgtttcctctggatttaattttggggttttatttcctattacctagataataagtagttgactatcagcagttttcatggactgactccattattatgctatttataattcaggatgtattctgtttgagcagatcaggaccaggttatgaaggcttaactgaaaaccttgaggactataccaattccaataaaggttttcaccaaacaacagtttcttaatttaattttcaaagcctttatgtgggtagctgtttggaaaatctcaccattttacttggaatgataaatatacaaagtaaattaaaacctaaattatctgtttactattctaggcctataatacagcacttagttttgagctttgaaattaatagtactagatttagcaagtcaactgatgcaaaacacatgaatgaatatattgaattgatttattattactttcaggcactgtgaataacatagaggcccctatgtagatattattcatgtctatgccctcaagaagtttgtcttctagttgagaatttaaaatatgaaaaagtatccaaaatatttgtaaaatttttttaaagattaaggcatacttctttttttttaatttaattttattttttttttacttaaaaaatatttgtgtgtgtgaaaatggggtctcactgtcgtgaccaggctggtctcgaactctagcctcaattgatcctcccacctcgggctcccaaagtgctaggattacaggtgtgagccaccagtcctgcagttaaaaaaaggacccactcctttaagttaattgattcccttgacttgtaatggaaggccagcgctattaaccaaagagtctgctttcaaataaataacctttgcatgaggattcatatgcaaatttatgagatgttataaccatatccaaccagagtttctactgtaggatctttctaacaactggtgaactgagtatttgaatgtacattaggaatctatgctgtggtatccattcaaggaaataagttctcatcagttcattgaaaaaaattaaataaaatacgttcataggagaagcatgtagatttatctagataaaacattgcaatcagggcagagtgcattggttcgtgtctataatcccagcactttgggaggctgacgcaggagaatcacttgagtccaggagtttgggatcagcctgggcaacatagggcaacaccgtttctacaaaaataaaaatttagccactgtggtggtacttatctgtagtcccagctacttgggaagcttaggtgggaggatcgcttgagcctggtaggttgaggctgcagtgactcatgattgtacctctgcactccagcctgggtgtcagagggagacactgtctcaagaaaaagaaacacaaactttcaaatcctactttgtagttcttaatgaacataaaaactgtttttttgctcaccaaaattctttactatgtgtcatattaaaacaactagctaattatcacatatccttaaattaggcacaagaccgaagaattttttcaatttattttttattttttaaatgtatttttttggctgggcgcagtgtctcatgcctgtaatcccagcactttgggaggccaaggcgggtgaatcacgaggtcaggagatgagacaaccctggccaacatggtgaaaccctgtctctactaaaaatacaaaaattagctgagcatggtggcgcgtgcctgtagtcccagctactcaggaggctgagacaggagaatcgcttgaaacaaggaggcggaggatgcagtgagccgagatcgtgccactgcactccagcctggcgacagagtgagactctgtctcaaaaaaaaagaaaaaaaagtttttgtttgtttgtttgtgtatttatttatttacttttttttgagatgaagtctcactctgtcacccaagttggagtgcagtggcgtgatttcgactcactgcaacttctgctttccaggttcaagtgattctcctgtctcatcctcccgagtagctgggactacaggtgcccaccactaagcctggctaatttttgtatttttgtagagacggggtttcgccatgttggccaggttgctttcaaactcctgacctcaagtgatccgcctgccttggcttcccaaagtgctgggattacaagtgtgagccactgtgcctggcaaattttttttttaattgaaaataattgtacctgttcatgggctacataatggatatttccatatgtatgatgtgattagattagggtaattagcatattcatcatctccaacatgtatttatttatattgggaaggttgaaatcctcctcagctatttgaaactacatattattaactatagtcattctgcagtggcatagaacactagaactttttcctcttatctagctgtaattttgtattctttaacaaatctttccctacccatcccttcccattatctctcccagcctctagtagcctctgttgtactttttactcctatgagatcaacttttttttagcttctatgtatgagtgagaacatgtggtgttaaacttcctgttcctagcttatttaacttaaaataatgtccttagttccatccatgttgctgagaatgacaggatttcattgtctttctttctctctctctcttctttctttctttcgttctttcgtctcaactctgtcaccgaggctggagtgcagtggcgcgatctcggctcactgcaacctccacctcccaggttcaagcaattctcctgcctcagcctcccgagtagctgggactacgggtgcacactgtcatacccagctaattctttttttttttcttgagacagaatcccactctgtcacccaggctggagtacagtgacacaatcatagctcactgcagcttcagcctcctagattcaagcgatcctcccccctcagcctcctaagtagctgggactacaggcacatgccaccacacctggctagttttttttattttttgacgaaacgaggtctcactctctttccctggctggtctcaaactcctggacctggactcaagtgatcttcctgcctcagccttccaaagtgctgggattacagttgtgagctagtacacctggctcattcttttttatggctaaatagtattccattttgtatatataccacattttctttatccattcatctgttgttgaacacctaggttgattccatatcttggctgttgttgagtagtactacagtaaacatggaagtgcagatatctcttcagtataatgatttcctttcctttggatatattcccagtaatggtattgctggatcatatggtagcgctatttgtagtttttctttcttttgaggaccctccatactgttccccatagtggctatactagtttacattcccaccgacagtgtatagtgttccctttactctgtaccctcaccagcactggctactttttgtctttttgataatagcctcctaactggggtgagatgatacctcattgtggttttgatttgcattcacctgatgatttgttatgttgagcatttaaaaaaatatatttggcttttttttttttttttttttttttttttttgagacagagtcttgctctgtcgccaggctggaatgcagtggcgtgagcagtcttggctcactgcaacctccgactccctggttcaggctgttctcctgccccagcctcccgagtagctgggattacaggcacgtgccaccatgaccagctaatttttgtatttttaatacagacagggtttcaccatgttggccaggatggtcttgatctcctgaccttgtgatccgcccacttcagcctcccaaagtactgggactacaggcataagccacagcccttggcctatttgggcatttttatgtcttcttttgagaaatgtctcttcagatcatttggtctttcccatttttatattatttatttttttatttttattattattattttttgagacagagtctcgctgtgttggccaggctggagtgcagtggcgcgatctcggctcactgcaagctccacctcccgggttcacgccattctcctgcctcagcctcccaagtagctaggactacaggcgcctgccaccgcacccagctaattttttttttttttttttgtatttttagtagagacggggtttcaccgtgttagccaggatggtctcgatctcctgacctcgtgatccacttgcctcggcatcccaaagtgctgggattacaggtgtgagccactgcgcccagcctcccatttttatattatttaactatttatttatttattttatttttttgaggcagagtctttctctgttgcccaggcggagtgcagtggcacgatttcagctcactgcaacctccacctctcgggttcaagcaattctctgcctcagcctcctgagtagctgggattacaggcgcctgccagcatgcccgactaatttttgtattttaggtagagacggggtttcaccatcttggccaggctggtcctgaactcctgacctcatgatccacctgcctcagccccccaaagtgctgggattacaggcgtgagccacctcacctggccatatttaattattcttttttaagacagagtctcgctatgttgcccaggctggtcttgaactcctgggctcatgcgatcctcccactttggcctcccaaagtgctaggattacaaacataagtcactgcacccagcccttcctaattctaattagaaggaccaaagatttttaataaattctctccaaccatttggcttggaactttccttctctgtctttccattttacctctctttttttttcctttttgccccttcatttaccctaattcactaattaacttttccccccacttttcttttgcataataatatattgctataaaagatactgtatgttctctttcctacattccttttccataaccatttgatttattttctctgaaacttggagttatggggttctcacccttatgatactggaagcagttttggggaacgtgatttggaaatatatcatcccccatctctacaaaaaaaatgtaacaattagtcaggtgtggtggtgcacacctgcagtcccagctgttcaggaggctgagatgggaggatcacttgagcccaggaggttgaggctgcagtgagccatgatcatgtcactgcactgcagcctggctaacagagcgagactgtgtttgaaaaacaaaaaagaaaggaaaagaaatatattatcacttagaggcaaaatcctaaggagattgcaggatgaataaaatttaacatagctacataacaacaataaaactggagtaaataataggttaatttaaaataaagtacttcatgagattttggagaaaaaggcttagtagtatttggttatcagaattataaagacatttctcatacctgtctgctgtttatctaacagtaaatgctttcttttaaaaaaggagaaacaggcatactttcctcatgtaatccagtgttcaggaggaggtggcaatataggggtctgtcataaactccttaaaagattctctgttatcaaatttggactaccaaccaaaacttattgatccctctctctgctccagtggattttctaaataggccattaataaggtttggatctaggtccccaaccagatcccatgttaaattgtaatccccagtgttggaagtgggacctggtgggaggtgattggggtggatttctcacgaatggtttaacaccatccacttagtactgtcctcaagatagtaagttctcatgagatctggtcatttaaaagtgtgtggaggctgggtgcagtggctcatgcctgtaatcccagcactttgggaggccgaggcaggtggatcatgaggtcgggagttcaagaccagcctggccaacatggtgaaaccctgtctttactaaaactacaaaaattagccgggcatggtggcgtgtgcctgtagtcccagctattcaggaggctgaggcaggagaatcccttgaaccctggaggcggaggttgtcgtgagccaggattgcgccactgtactccagcctgggcaacagagtgaggctccatctcaaaaaaaaagaaaagtgtgtggcacctgcccccttgctctcttgctcctgttctgggccatgtgacgtgtctactcccccttcatcttccaccatgattgtaagttcctgcagcttcccccgaagccaggcagatactagcatcattcttcctatacagactgcagaaacatgagccaattaagcctcttttctttataaattacccagtctcaggtatttctttttatttatttatttatttatttatttagatagagtctcactttgttgcccaggctggagtccagtggtgcgatctcagctcactgcaacctctacctcctgggttcaaagtaattctcctgccttggcctcctgagtagctgggactacaggcgcgtgccaccaagcctggctactttttgtatttttagtagagacggggtttcgccgtattggccaggctggtcttgaactcctgacctcaggtgatcctcctgccttggcctcccaaagtgctgggattacaggtgtgagccactgtacctggcctcaggtaattctttatagcaatgcaagaatggactaatagacctattatcacaacctacatatgtatttcctctttcttttttcttttttttttttttgagacagtctcactctgtcgcccaggctggagtgcagtggcacgatctcgacttactacaacctctgcctcctggattcaggtgattctcctgcctcagcctcccaagtagctggcattacaggtgcccaccaccatgcctggctatgtatttcgtctttctacttgcaagtaaactttggaaagtttgaagttttttttccatgagtgaatagcttatattctggcccttcactataaaaacatacccttaacctggaattttttgtcagaacagtgtgcacattaagttgccagtggtaaagcaacttcacttcttgatacaatcataggcagaaaactatttttccagaggtagaatctcagacataactgtacctgcaagttcagagagagaccttccacctgactatcttctcctgacggctttaccgagttctttctaattcccaagggtcagatctatgcaatatttccacaggaagttgtgggccttctctatacaaagcctgctttgttcattagtggcaggtttattttctgtaattttgccgaagttttctgaaacagttgtttaaagccaataataatcctcttttagaaggcaaaaatgaataagtacagtagtgtaaataccataaatgaatgttctacgtttacaatgttctgatactgtgaaaaggttgtttatagcaaatctgtttccagctaggtgggcttaaaaacagactaaaccattatattatgaagatatttggtacttcttcacagtgaagtatgtataccttgttgaataaaatcatacattaaaattttggacaaataggctgggcacggtggctcatgcctgtaatcctagcactttgggaggtcgaagcggatagatcactgttggccaggctggctggaactcctgacctcaggtgatcacaccattgcactccagcctgggtgacagagcaagactttgtttcaaaaaaaaagaaaagaaaagaaaggaaaggaaaggggaaaggaaaaaggaaaggaaaggaaaggaaaggaaaggaaacctgataaggtggccgggcgctgtgtcttatgcctgtaatcccagcactgtgggaggccgaggagggcggatcatgaggtcaggagatcgagaccatcctggctaacacagtgaaatcccatctctacttaaaaaaaaaaaaaaaaaaaaaaattagctgggcatggtggtgggcgcctgtagtcccagctacttgggaggctgaggcaggagaatggcgtgaacccgggaggtggagcttgcagtgagccgagatcgtgccactgcactccagcctgggcgacagagcgagactccatctcaaaaaaaaaaaaaaaaaaaaaaaacctgataaggtgtaaaacatacagagagttcatacagatccaataactttgttacttattaccaagtcaagtaaagcggggggcgggggtggggggacaaggcatggtagctcacacactttgagaggctgaggcaggaggattgcttgagaccaggagttcgagaccagcctgggcaacatagcgaaacctgatctctactaaaaaaattagccagataaggtggtctgcacctgtagttctatcttctcagaggctgaggcaggaagattgcttgagcccaggagtccaaggttgcagtgagttatgatcatgccattgtattccaagctgggtgaaagagtgagacactgtctcaaaacaaaacaacaacaacaacaacaactggctgtgccaggtgcagtggtgcacccctagagccccagtgacttgagaggctgaagcagcaggattgcttgagaccaggagtttgaggctgcactgtgccatgatcgcgcccattaatagccactgtactctagcctgggtaacataccccatatctaaaaaataaaaatatatatgtataataaaataaataattggttgtaaatctaattctaaaattaacattatctttgacctagggcatattgtttaatcctgttttatctcatatctccatcaagttatgcaggtataatatgtatctatagcaaatagttaatgaatactttatccgaagatgaaaggtgctaagtggtttttataaatatcatacatttatttaaaaatcacagccaatggcccagtgctgtggctcacacctgtaatcccagcactttgggaggccaaagtgggtggatcacctgaggtcaggagtttgagaccagcctggccaacatggtgaaaccctgtctctactaaaaatacaaaagttagccaggcgtggtggtgggcacctgtaatcccagctacttgggaggctgagacaggagaatcccttgaacccaggaggcaggggttgcagtgagctgagatcgtgccattgccctccagccagggtgacagagtgacactctgtataaaaaaaaaaaaaatcacccctgaaattcatatgaaacaactacacttgcacttaaaaacttcaattaaatatttactaggaaaaatatggtggttgaagaaactactagaactctgcataattaatgatgtaagaaacaagcctatgatatgtgaggtgctacaacttgaatgagggagtaagtagtttaaataccaggcctggtttcagggtactactcaaacaggaaactccaaactgtaatttggttagttatcttccactcccagcctccaccccctccaaaaaacaccaagactgtcaactctgtgacgtgctttcctaatggcctgtagctacatgactcaaagaaaaaggtgttttctttggaacacacaattgtaaaactatacccagcatcctacaccctgatttctggcaaacaaaggaaaactacctttttttttttttttcactcatagaaaacagaatggggccataggccatttaaaatgccataactagtttaaacagaaacaacagtctatccaaatgtgactgcatgcctatatgttctctgtcaaattggaaattagagggagcattttataaaatcagatgctgagaacaaagatttatgtgcagaattggcgtatgaacagtttcaggcccatctttcttagtcctttattagtataaaacaaatttgggtgtacttatataattttttaaaaaacagtgatgatttctggatacctgagtatattttttgtttttgttttttttggttgtttgtttgtttgttttgaggcaggttctccctctgtcacccaggttgtagtacagtggtatgatcacagctcactgcaacctcaaccacctgagcttaagcagttccctcgccttagcctaccgagtatctgggactgcaggtgcatgccaccacgcccagccaattgttgtgtgtgtgtgtgtggttttcgttttgttttgtttttgagagggagtcttgctctgtggcccatgctggagtgcagtggagttgtctcagctcactgcagcctctgcctcccgggttcaagagattctcatgcctcagcctccccagtagctggaactacaggcatgtaccaccacacccagcttttttttttttttttttttgtatttttagtagaaacagggtttcatgttggccatgctggtctccaactcctgacctcaagtgacccgcccacctcggcctcccaaaatgctaggattataggcacgagccaccgcacccagcctaatttttgtatttttgtaaagatgatgtctcagtatgttgcccaggctggtcttgaactcctgggtttaagcaatccacccacctggccttccaatgtgctgggattacaggcgtgagccactgcatccagcctactctttgttctgtaatgtattcatctgtcagtttctctttgtttctattacagtttctaagcattgcaattgaatcctcctgtcaaacagaaattcatactaagaagcttgaagcttgaactattgtagcaggattttttttttttttaattttagatacagggtattgctgtgttgcccaggctggagtgcagtggctattcacaggtgcaatgatacatatcacaatacagcctcaactcctagactcaagcaatcttcctgcctcagcctcctgagtaactaggacaacaggtgcgcatcactgtgccctgcccagtgttattgtagcagttttagagataaatggcttaattagatctaatcagccactgctatgaagcacttatgcattaatttttttctttgagacagggtctcacttgttgcccaggctggagtgcagtggcacaatcacagctcactacagcctcaacctcctcagatcaaaggatcctcctgccccagcctcccaagtagctaagactataggcaagcaccacacttggctaattttttttttttgtagaggcagggtctccctatgttgctcaagctgatcttaaactcctgggctcaagtgatccccactacctcgacctcccagagtgctaggattaaaagcatgagccaccatgcctggcaaatttatgcattcttcaaaactctttattatacagctaaaacacttttacctggcatatttagatcttcattaaatttggtttctagctcctttagcacaatattttacttgtggcaaactaggagaatatacttaaaagaactcttagaatccagattacagttgacctttaaacaacacaggtttcaactgtgtgggttcttatgtgtggatgtttttcaataaatgtattgacagattgtttggagatttacaacaatttgaaaaaaaaaactcacaggcagaccagatgtggtggcttttgcctgtaatcccagcactttgggaatctgaggcaagaggattacttgaggccaggagttcaaggtcgacctgggcgacatagtgagaccccatctctacaaaaaattaaaaaattagccaggtgtggtggcacatgcctgttgtcccagctactcagacagctgaggtgggaggatcacttgatcccaccaggagttggaggctgcagtgagctctcatctcaccactgcactctagcctgggcaagagtgagatgctgtctcaaaaattttaaaaagaggctgggcacaatggctcatgcctgtaatcccagcactctgggaggccaaggtgggtagatcactttagatctggagttcaagaccagcctggccaacatgttgaaacctcatctctactaagattagctgggcgtggtggtacacgcctatagtcccagctactcaggaggctaaggcagaagaatcacttgaacctgggaggcggaggttgcagtgagccaagatcacaccactgcactccagcctgggagacagagtgagactccatctcaaaaaataaaaaatacaaacaaataataaaaataaaaataagtccgggcacagtggctcacgcctgtaatcccagcactttgggaggccaaggtgggtggatcacttgaggtcaggagctcgagaccagcctagccaacatggcgaaaccctatctctactaaaaatacaaaagttagccgggtgtggttttgcgtacctgtaatcccggctacttgggaggctgaggcaggagaatcgcttgaacccaggaggcagaggttgtggtgagccgagatcacgccattgcactccagcctgggcaacaagaatgaaactttgtctcaaaaaaataaataaataaaaataaaaatgaattaaattaactagcatatactgtactgctgtaatttcatagccacctcctattactattgaagtgagctcaagtattgccagtatccacttaaaatgctgtatgatgctaattttctagtgagcagttcttcatagcttagtgcaatatcataaatcttgaataacaccacgggacctacaacacgtgccactaatgatactggaattgctcttaagaagcagagaagagtcatgacattataagaaaaagttgaaaacgaaaaaaagagaaaacacaaggaaaagttgaatcgcctgatgtgatgcataccatagattgaggtctgtagctgcagttgcctgccatttttataagtatatatacataggtggtggctgggctggggaaatggcggcttcacgagagagtgggacttgggcagcagaggcagcacagtggatgcatttctgaccttctacagtgaggtgaaacaaatagagaagagagactcggttctaacatccaaaaatcagattgaaagatggacccgtcctggttcctcttacttcaatttgaacccatttgaggttcttcagttagatcctgaagttacagatgaagaaattaaaaaaagaggtttcagcagttatccacattggtgcgtcctgacaaaaatcatgatgctgacagagcacaaaaggcttttgaagctgtggacaaagcataaaagttgctactggatcaggaccaaaagaagaggaccctggatgtaattcaggcaggaaaagaatacatggaacacggccaggcacggtggcacacgcccgtaatcttagcactttggaaggccaaggtgggaggatcccttgagctcaggggtttgagaccagcctgggcaagatagcaagaccttgtctctattaaaaaaaaattttttttttaattagccaggtgtagtggcacacgcttttaatcccagctgctctggagactgaggccagaggattgattgaacccagaaagataaaaaagtccattcaaaaggaagatataataactctaaatttgtatatacctcataacagcttcaaagtatataaagcaaaaattaatagaactaagagagaaatcactttgtcttttttttttttttttttttttttgagacggagtctcgctctgtcgcccaggctggagtacagtggcgtgatctcggctctctgcaagctccacctcccgggttcacgccattctcctgcctcagcctccctagtagctgggactataggcacccgccactgcgcccggctaattttttgtatttttagtagagatggggtttcaccatggtctcgatctcctgacctcgtgatccgcccacctcggcctcccaaagtgctgggattacaggtgtgagccgccgcgcccggccatcactttcataattagagatgttaacatacctctctcagttactgatagagcaaacagacaacaaatcagaagggatcttaatgatttgtatatgattaaccaccttgacctaattggcatatttagaacaccatacccaacaattgcacaatacactttccaataacacataattggagataatgtattataaatttgggaagaaacaactgtaagcttctgttgtttatttgcaacttggaccatatttgagatatataggaaaagcattaaatataaatggcctaaacactccaattatcctaccacgttgggagactgaggtggaaggaccacttgaacccagcagtttgagaccagctcagctcactgtaacctccacctcccgcattcaagccattctcctgcctcagcctcccaagtagctgggattataggtgcctgccaccatactcagctaatttttttttgttgttgtatttttaatagagacagggtttcctcatgttggccaggctggtctcaacctcctgccctcaagtgatccacctgtctcggcctcccaaagtgttgggattacaggcatgagccaccgcatctggcctcatttttctttttctttttctttctttcttttttttttttttttttttgagacagagttttgctttcacccaggctggagtgcagtgatgtgatcttggctcactgcaacctccgcctcccaagttcaagattctcctgcctcagcctcccgagtagctgggattataggcgtgtaccaccacacccagctaatttttgtatttttagtagagacgaggtttcaccatgttggctaggctggtctcaaactcctgatctcaggtggtctgcctgcctcggcttcccaaagtgctgggattacaggcatgagtcaccatgcctggcccctaattcatttttcttcaacaaagaagcagcctatagccagaaaatgtctgcctctgtctcttttaacctccatgaggtttccagataataatctggtattgggtttaacacacctgactgaccttaggaccctaggctgacctggagagattttttaaaacagattctgaaagtcctacctcctggagattctgtattttgaaaaggcaattgggctgattccaagtatttggacagatttcggagtcttggaaataatgtactgtttgtcctggagagtaggaaaaagaggggaaggaaggagggagaatatgaggatatgaatatgtatgtgtgaatttgagataactgagtcagggccaggtgtggctctaccccaacacaggaggtaagaggaaagaaggacatctgcctctaaaagttttgtaaaagtgaaaatcaagcacatttgcatgagaagcaaagaaaatgttgctctgttttttgtattcagtggctttattttttttatacatattttgcttatgtatcaactattttttttttgagacaaggtccctgtattaagccattcttgcattgctataaagagatccctgggactggataatttataaagaaaagagctttatttgactcgtggttctgtaggctgtacaggaaacataatgcttgcaactgccctgcttctggggaggtctcaggaaacttacaatcatgaatcatgacagaaaaccaaccaggaataagcatgtcacgtgaccagagcaggaacaagagagcaaagagggagatgccacatacttttaaacgaccagatctcacgagaactcactcactattgctaaggcagcaccatatggatggtgctaaactattcatgagaaatccacccccatgatccagtcacctccaaccaggccccacttccagtactgaagattacaattcaacctgagatttgagcgggacacatatctaaactatatcagtatggctctgtcgcccaggctggagtgcagtggcacgatcacagctcattgcagcctggacctgctgagctcaagcgatcttcccacctcagcctcgcaagtagctgggactaggcacatggcaccctgcccaactaatttttttttttttttaagagacagggtttcttcatgttccccaggctggtctttctttacctaaaaaagaagagaagccagatgctgtagccagtgtctgtaatctgagacattctcataatttcaactatttgcctgtaatctcagctactcaggaggctgaggcagaggattgcttgagtcctggagttgaaggctcagtgagctgtgattgtgccactgcactccatgctgggcaacagaacgaaaccctgtctctaaaataactagataaatagatagagagacagatagatagatagatagatagatagatagataatcagattctagtgtatttcatgtaaagtgttaaagtaattgagacccagaatgtccttgtataagtcatgcaactaggaagagtcactgtcctcttgtcatttccatcttttgcactttagtaatgaggatgctattttgcctaagtcttctgggcatagcaaactaatgcatcagtagtcaccattgcatttactgtgataattacgattgtataaatctaacctttattgaaaaacttccctaaacctccatcaatcaagtgaaaaaaagattgaatttggcagttgtttcttttaaaaatttaatgctgttggttgtatattttctcttttgaaaatacctagttttaaaagagagagaggccaggtgtggtggtacacacctttaatcccagtgcttttgggaggccaagcagggaggatctcttgagaccaggcatttgagaccaccctgagcaatttggtgagaccctatctctacaaaacaaaattgtttttgtaattagccaggagtgatggtacatgcttatagtcctggctactcaggaggctgaggcaggaggatcatttgagatcgggaatttgaggctgcagtgagctgtgattacactactgcacttcatcctgggcaacagagtgagaccctgtttctaaaataataataataataataataaatttttttaaaaaagatgttttagtgactattatgacctttttaccctcctccaaaagtgttacttgcttcagatgtgaaattgtttacagtcaacatgttagcttatcatatgctgttccttgatgtatttctacaaagtagaggttccactttaatttcaggatggtttttccacatgactctttttttcttcctctctagacttctccagagaaccttggaacagtaggtggagtgcaaagctgcattgtgtaccttcctgcttttttttggttgccttcctgctggtttttttttttttcctttctttaaattcttggccccgccttggctctcctttctctgccattaaaactaactaactaaaccctgcatgcatggtcattatgaggggttcatggccttttatttcagttctgcacatgtatcatgtcagttatgttttatgtcaaatccttaatattatggtgtgtgtgtttgtgtgtgtgtgtgtgtgtgtgtgtgtgtgtgtgtgtgtgtgtgtgtgtttgagacaggctctcactctgttgcccaggctggagtgcagtatcttaatcacagccaactgcagcattgacctcccaggctcaagccatcttcccaactcagcctcctgagtagttgggactacaggtgcacaccaccatgcccagctaatttttgtttttgtattatttgtagagacagggtttcaccttactgccctggttgatctcaagctcctgagcttaagcgatctgcctgcctcagcctcccacagtgctgggattacagaaatgagccactgtgctcagcctatgattgtctctaaggcactactatggtaaacaaattggaatctcacctctactttctgaaaacatttccctccaatttaatgtacccgctttctaatgcttctgccccgcaaccctgagcactttccaatacctagggtccttttgtgaagggagaaaataatttgatgagcagatataagtaaggtactaacaatgtgttacctctccctgaactatttatatcctgaaaagggcagggaaagggcaatgtttaatagagaaaatgattcactcactaatgaggcaggaattccctgcctcagtaaggcaagatctcatgcatttgttaagatatccacattttgtatacatgcgcctttaaaagattttgagccggctctgatcatttcaccagattttgtcctaaaatgatgtcagcttggtttggttcctttttctccttagtagtttatctgttaatggattttgatgtttggtgtccatgtgatgtccaggagtctccctgtctgcatgattgtttatcgttgctccgatcctttccaactaccacaggaagagaggggaagggacattttagagattatgctgaaataatacatttgcttccttccctctcttcttttcatgtaacagaggaagcagaccagcccactacagagccaggcatggtcctggacagtgtggaagcaggagacacaacacctcctaccaaaaggaagagcaagttctcaggctttggcaagatcttcaagccctggaaatggaggaaaaaaaaaagtagtgataaatttaaagagacttcagaaggtgagatattaagggttaaatgtgtgttctgagttagaattctctatgttagatgtatttaatttttccttatcttcccaagtttctgtagtcctctatttgaagagggtatttaatgttttattctttccttcttctttttttttttttttttttttggtgagacaggatctccctctgttgcccaggctagagtacagtggcgcaatcacagttcactgcagattcaacctcctgggctcatgtaatcctcctgcctcagcctcccaagtagctggaagtacaagcatgagctactgtgcccagttaatttttaaattctttgtagagatggggtctccttatgtttcccaggctggtcttgaactcctgggctcaagcgatcctcccacctcagcctcccaaagtgctgggattacaagcatgagccactgtggctggccagagtttaatcttttagaattaaacatcaaaatggtcatgtactaaacctaatattgtataccctcattcccaggtttgtattttgatggcatataagtatctattgagtggtgaatggagttcctgaactgtcgcaaatctaagatgcttctttccatcagaacttggtgaagaaaatgactgaatgagttgatacatacataaataaaatgcttattttctactctgcccatccacacaaagttcatccgtaaataacttactaatgaaattttctcttaagttacaattatgtaaggctagttttttggaagtgatgctttcctgacagcacaggttataaaagaaatttaagagttttaatttgaagttagtctgctagttattttctttcctgagaatataaacttaaactactttattcttttacctgtagaattagaatgctaagtgtaaggttgactttcaactgtcacatttctgagtgccattttccaatttaatgttagttttagaacggaaaatatctatgcgaaagccaagagaagagctggttaaaagaggggttctgttggaagaccctgagcaaggtgagtttacaaataaatagcatatgcctgtctctgtgcacttggtctttgattgggtctgacgagatatttgaattttctttctttcttttatattgctatttttgggttggagggtggcctttaaaaaaaaaagttcacccttccttccttggggcaaacattcctttcctctgtgtacatcctcaactttgtgccagctacaatattgcgtgtcttttttttcccccccttgagacagagtcttgctctgttgcccaggctggagtgcagtggcacaatcttggctcactgcaacctctgcctcctgggttcaagcaattctcgtgcctcagcctcccaagtagctgggattacaggcacctgtcaccacccccagctaacttttgactttttagtagagatggggtttcaccatgttggtcaggctggtcttgaacttctaacctcaggtgatccgcccgccttggcctcccaaagttctgggactacaggtgtgagccactgtgcctggctaattttttcatttttagtagagatgaggtttcaccaagttggccaggctggtctcgaactcctgacctcaggtgttctgcccacctcggcctcccaaagtgctgggattacaggcttgagccaccgcgcccagctcattttcttttttgaacacatttgtccccatgcccatatcactgcaccagtctaccagtcattgtttgtttaataatgtcaagactttcttcaatgtgtgactctatgaagcaagttattgcaaatgtgaaagtatagtacattggttgcatctcatttctcttcatctgagttatgttgcatgaggcaaaatctgaaagccatattgtatactggccaggcatggtggctcacgcctgtaatcccagtattttaggaggccgagacgggcagaacacttaaggtcaggagtttgagaccagcctggccaaaatggtgaaaccccatctctactaaaaatacaaaaaattaggagggcatagtagcaggcacctgtagtaccagctacttgggaggctgaggcaggagaatcacttgaactcaggaggcagaggttgcagtgagctgagatggcgccactgcactccagcctgggcaacagagcaagactccttctcaaaaaaatttaaaaaatcatatcctttgaagaataggggaaaggaaccaaatagatggagtattactgtatactttttgggctttaaaccatgcgaatatattgcctattcaaaaaattaaattgtatgtattgaagatttattatctcaactgtataaaaactaaccagagacaacaagcttgaaggagcaatttgaaatattattacaattggttacctctgaagttgaggtgggaacatgggtgggctttttttttgttttttaattgagacagggtctccctatgttgcccaggctagtctcaaactcatgggcagcacaagcagtcttcctgcctcagcctcccaaagtgctgggattacaggcgtgagctgctgtgcccaggtgctatgcgatgttttctttctttctttttttttttttgtatgtgactagttatgagcatatataacttttgttttatataactctatttgtttttttacattaggacacaaaatcttctcagtatttaggtagttacgtactactttaatggtttcactgtagcacctctttggcccttgctttgctttcttttttgagacagagtctcactctctctcccaggctggagtgcagtggtgtgatcttggctcactgcaacctccatctgctgggttcaagcaattttccagcctcagcctcccgaggagctgtgattacaggcatccgccaccacacctggctaatttttgtatttttagtagagttggggttttcaccatgttggccagactggtctcgaactcctgacctcaagtgatccagccacctcagcctcccaaagtgctgggattacaggcgtgagccaccatgcctggcctggcccttgcttttttgatacagctgttccactttccatggcctttcttttcacctttcttgctcacttatcataaaccacatacattactcatttcttgtttttcaccttcagtctcttttgccctacactcacggcaacctctgcctcctgggttcaagcaattctccttcctcagcctcccgagtagctggaattataggcatgcatcaccacacccagctaatttttgtatttttaatagacagggtttcaccgttttggccaggctggtctcaaactcctgagctcaagtgatccacctgcctcggccttccaaagttctgggattataggcatgagccaccacgcctgatgatcttttgccctatactttctattagcccctaatccaagttgtttttagcctacaagttcacaggcccaattaataaacgagttgcagccattggacaagatgccattctgccaaccagataaatgacctaagctttattctgtatctaaaaacagggatgggcctcatgctggcttatagatctgcattttaggccaaaagtagtgtttgaaccttgaagtcctctgcatacttaaagggaacttttggctggcctggcgcggtggctcatgctgtaatcccagcactttgggaggccagtgtgggaggatcccttgaactcagtagttccagaccagcctgagcaacatagtgagacctcatctctataaaagattttttaaattagccaggtatggtagtgcaggcctgtagtcctagctacttgagcccaaaagatggaggatggcttgagcccagaagattgaaggctgcagtaagtattaattgcaccactgcactccagcctgggcgacagagtgagaccctgtttttttttttaaaaaaaggtggcttttggcttgattatagtgctaacttgactgtactgtaaaatatttaattgattttaattgattttctgggtttagggagaacattcagtgatgttaaagccccatagtactactccacttcattaacattgcagaaccctctatatttaatataagaaatgatactgcaaagtagacatccctgattaagtaacttgagataactgatcacttttgcatgtatttcactagtgtgtgctgagtagaaactaattaacactgtcttaaactttattatgttgttttcacaaagagcagcctttgttgactttgaaatcattgcttcagtattctagaaaatcttgtttttgttaaacatgggcagtaacttactatttttgtatagttgttgtcatcttacccccaccctgttttaaaaataaaaagtagttgtcagattactttggctttagaagtaccttttcacttgccttagaatcttcattactttgagcctacactccacctcttattggaacttcatgaagaatgatgttggatttcactctgtcacccaggctagagcacagtggtctgatcatggcttactgtacccttgacctcctgggttcaaacagtcctcccacctcagcctcccaggtagctgggactaggcatgtgccaccacacccagctagtttttttacttttttgtagagacagggtcttactatgtttcgcaggctgatctcaaactcttgggctcaacgatcctcccgcctcagcctcccaaattgttgggattacaggcatgagcaccactgtgcccagcccataaccatttcttttttttttttttttttgagatggagtctgttgcctcagcctcccgagtagctgggattacaggcacctgccaccacacccgaataatttttgtattgttagtaaagacggggtttcaccatgttggccaggctggtctcaaactcctgacctcagatgatccacccgcctcggcctcccagagtgttgggattacaggcgtgagccactacacccggccccccataaccatttcttatgtgaatctattctcctgccagaccaaactagttgccagtgccccaaacacgttgaataacttcacacctttatacatgctgtccttcttccaaacagactgtctttattcagtgtggtaggctcctactccttcaagatccagttcaaagcaaggcatggtggtgtgtgctatagtcccatctactagggagtctgagagaggaggactgtttgagcccaggagttcaaggcccattctggtaacatagcaagaccatctcaactccagctcagatactttctgtgatgccttcctaactctattctcactccaggaaaatgatttcttcttcattcctaccacagtacttcactaattagagctcttgacatttaacattgtagttacttatatataagtttgccctattcgtttgtctttttttttctttctttgagttggaagttttgctctgctgcccaggctggagtgcaatgacacaatcttggcttactgcaacctctgcctcctgggttcagttgattctcctgcctcagcctcctgaatagctgggattacaggcgcttgctaccatgcctggataatttttgtatttttagtagagacaaggttttaccatgttagacaggctggtctcgaactcttgacctcaggtgatccacctgcctcagcctcccaaagtgctgagattacaggtgtgagacactgcgcccggcttttatttgtcttattcatataacaacgtacttggcacatagtaggctatcaaacatgtattggaaaaagaaatcacttgtttctgtttaagcatccagataatctagatctcaataataaactaaaacaggaagacgagggaaagaagataagaaaggttagaaatcaccaaccctgggccgggcacggtggctcacgcctgtaatcccagcactttgggggctgaggcgggcagatcacgaggtcaggagatcgagaccatcctggctaacacggtgaaaccccgtctccactaaaaaatacaaaaaattagtcgggcgtggtggcaggcgtctagtcccagatactcaggaggctgaggcaggagaatggcgtgaacccgggaggcagaggctgcagcgagccaagatcatgccactgcactccagcctggtctgtgagaccctgtctcaaatcaccaactctggccaggcgcagtgattcatgccatttatcctagcacttcgggagaccaaggcgggctgattgcttgagcccaggagttcaagaccagcctgggcaacatagtgagaccctgtctcaatttaaaaaagagagagaaagaaaaaaagaaattactaactcttctttctatctgttcatgccaacttcatcactttgtactcttctttcaccttgcaggtggtgaggatccaggaaagccaagcgatgccatgttaaagaatggccataccacccccatagggaatgccagatcatctagtccagtccaagtagaggaagagccagtaagattagcaagtcttaggaaagctattccagaagaggacctaaagaaacgactaggtaagaaactctggatttttgagtttaagagccacgggccagttattctccttacataaggggtttgcaagagaacagggaaaagtgaaatctagagagaattacattctcctttaacaataccttaactagcaacttcaaggggaatttcctcccccaccccgcttttattcactaaatacctaaatttgtgatcctcaagaagggaagaggatgttaagtatcagatacctataggattttttccagctacacattccacttctttcacccaaggaattttgttgtggctctcctccagtagcctggcccttgtgtgaagaatcactaccacaatgagcatctcttagtgagcctttcttactgacatttcttaagtatggggaggttgggaggcattgagaatggtaacctataagctaatctataaattaattggtgaaattggccacaaattcatagatgtgttagctttttcagtttctcttgttactctctcttccctttttataccatacatgttattacacaggctcaactggaagccagcctaattctgaagcagagtctgttcctgagaatgtacccaaaccacctttacttcctcccaaaagacccttgtcctcttctcatgaagcaagtgaagggcaagcaaaggatgccacttcctctggcggcacggcaaggttcatcatctccacctccatcaccacagcacccgctgccaccactgctgccacaagccttgcaaagactgttaatctctctgtcaccccttccccagcacccaggactctgcctgctgctcctgccagcactaacactactgctaccccaagcctcactcatatggtccctgccaagcagccccctatccctccccctaaaccagctcacagaaatagcaaccctgtcattggtaagtaagtctttaggcttccagtgttttgggtttggtttgatgttggatggttattttatttgataactggtacaacattgatttggtctgtgagaattttccatatcttgtccctttgaatgacctcaatatggagaaaagtcttaggttaagaaaaaataggccaggtgcggtggctcacgcctgtaatcccagcactttgggaggccgaggtgggtggatcacaaggtcaggagattgagaccatcctggcaacatggtgaaaccccatctctactaaaaatacaaaaaattagccaggcgtggtggcacgtgcctgtagtcccagctacttgggaggctgaggcaagagaattgcttgaacccaggaggcggaggttgcagtgagccaagattgtgccaatgcaccccagcctaggcgacagagagagactccgtctcaaaaaaacaaaaacaaacaaacaaaaaaagtcatgaaactgaggcagatggccataaatgtaaacatcactaagattagatttaagttttgggggttttaacctattttttaatctaatatttaatctgtttttctaaaacaatgattccaaaacactatacatatttgtgtgtgtgtgtgtgtgtgtgtgtgtgtgtgtgtgtgtaattggactggatatgtgaaaaccataacagattccacctgcatggaattatctgtggcacttgctgaaaaattagaataatgcctcagctcacaaggggcaaggcaaacttttcaaatgaaaatttttaaatctacttaaaactacctatgccttccataagcattaatgagtctagtagataaaaggatgattctgtagatgccagtggaatttgggattcagtgtctggcatagttatcttcacagggaactgcagaagctattacttaaattgttctgataaaatcatgttttatcttgggagaattaagaatgctattcttatgttaaaataagtgatggtagagaaagcagggaatataatcagtaaaatttgtatgggtttagtaaattttttgcatttacccaaagttctatttaagtctactttctttatataaatgcacaatttcttagaagaattttcaagaaagggagaggaaagctaatgagtgcttcaaagctaataaaaatatagttttttcaggaaaaatgatactaggcttagtattgcttaaagttcttgttcacgattgaacgaatgaataaaaactatactcattaaatatttaatatcaccatgttgggtggagtgattcaaaccttgaaaaacaggcttagaatattttatgagtatgacagtttggagtagcttgatgaaaacaggatgaagttgttattaccaccactttggatggatagtgtcatgttgacttatctgtgaggaacttggggagctttcacatacttattttcaaaactaccttgtgctgcaggaaaccaattttatcttttccataggtagggcaattagaacatgaagacattgtgactcattcaaggttgtaggccaggcgcagtggctcatgcctgtaatcccagcactttgggaggcagaggcgggtggatcacctgaggtcaggagttcaagaccagcctggccaacatggtgaaacgccatctctactaaaaatacaaaaaattagccgggcatggtggtaggcacctgtaatcccagctactcgggaggctgaagcaggagaattgcttgcacgtgggaagcagacgttgcagtgagctgagattgtgccactgcattgcagcctgagcaacaagagcaaaactccatctcaaaaaaaaagaagaaggttgtagttagtgaaagatagaaactgaacataggcttttcaactctcaggtccagacctctgttccttacagtagtgtttgcaaactggtgttctcctcaggatcacctagaaagcttatgataacagactgctggacactacccgtagagtttctgattttagtaagcctgggatgggcttgagaatttgcctttctaataggttcccagatgacactgatgctgctctccagggagcacacattaagagcctctgctctacaccagtggcataccacccttttcaagttaaggcaacatataaaatgataatttgtgtatgataccctggactaaactgcagagctcattcttagcttgaggtaaatagcccaaaacaatagaccttgtaactgaggaatcagtattagtccatgaggggtcctcaacaaaagaagaaaaatagaacagttcacagagcatttcttagagctaaatagatttaatttaaaggactctcttttattctaaaattacaaccttcctaatcctttggtgttaaaatgccatttctttcacaaaaggattatgatcataaatggtttacttaatatcaagccttatttggaaatcttagaaaatgacaacctcaaaaaaacactagaaaaaaaaccaacaatctgaggttgatcaagatttttgttattgttttggtcactgaaatccaaaagtttggaaatcattgcttcagaagtactactgtcttctcatccatataacatggagtattacgactaaggaaaaaccaccagcaatagctgaacgggtgaaagggaattattacccatcccagaaacactctgaaatttttccacagaactacagccagatgctgttgtcagggtatatataccagaatttacttccttaacatatatgccttcctcaaattaccaaatagaatttattttattaattcaaaagtaaaaatattcatttatggtctcatcaggaatgagttttgttgtagatggaatagctaacagctatttttagagaatcagcaaaaatccaatctttccaaaaatatctctttcactgctcctaaaattcacatttttagaatctttttgtgtgtgtatgcagtgtttttctagaaagccttttttaaaatttatttatggggccaggcatggtggctcatgcctgtaatcccagcacttcgggaggccgaggtgggcagatcgcttgaggcccagagtttgagaccagcctgggcaacatggtgaaaccccatctctactaaaaatacaaaaaatgatctgggtatgatggtgcatgcctataatcccagctactcaggaggctgaggcaggagagaatcacttgaacccgggaagtggcggttgcagtgagccaaaattgcaccactgtactccaacctaggcaacagagcgagactctgtctcaaaaaaaaaaaaattatttatgatgagagacattaaaacattacaaaattaggccaggcacagtggctcaatgcctataatcccagcatttggggaggccgaggtgggaagatcacttgaggccaggagttcaagaccagcctgagcaacgtagcaagaccccatctctataaaatatttaaaaattagctgggcatggtgacatgtgcctgtaattctagctacttgggagattgaggtaagaggattgggtaagcacaggagttcaaggctgcagtgagttatgattgcaccactgcactctagcctgggtaacagagcaacatcctgtctctaaaaaaaaagaaaaggctaggtacagtggctcacacctgtagtaccaacactttgggaggctgaggcaggtagattacctgagcccaggagtttgagaccagcctaggcaacatggagaaacccatctctacaaaaaataccccccccaaaaattagccgggcatggtggcacatgcctatggtcccagctacttgggaggctgaggtgggaggatcacctgagcccagggaggtcaaaattgcagtgagccgtgactgcgccactgcactccagtgacacagtgtgagaccctgtctaaaataaattaatttaatttaaaaataaaaataaatttaaaaagaaaagaggctgggtgtggtggctcacatccataatcccagcactttgggaggctgagataggtgtatcactggagcccaggacctcaagaccagcctgggcagcatagtgagaccttgtctctactaaaaattaaaaaaattagtcaggcatgggggcatgggcctgtagtcctagctacttgggaggctgtagcaagaggatcacttgaacccaggagatcgaggctgcagtgagctattgttcatgccactgcactccagtctgggcaacagagggagaccttgtctcaaaagaaaaaaaaaaaaagaattataaaattagctagccttggccgggcaaagcggacatgcctgtaatcccagcactttgggaggccgaggcgggtggatcacctgaggtcgggagttcaagaccagcctgaccaacatggagaaaccccatctctactaaaaatacaaaaaattagccgggcgtggtggcacatgcctgtaatcccagctactcaggaggctgaggtaggagaatcacttgaacccaggaggtggaggttgcagttagccgagatggcgccattgcactccagcctgggcaacgagtgaaactccatctcaaaaaagaaaaaaataattagctagccttttactttgaacatctccaattttggagatttaggacaaatacagttttatttaagggaagtttttgagagtgtttgagaatactgagtgggatgaaactaaagggtttgagtagaaggttagaggttggtgatcaaaagaactactttttttttttttttcctgtcagcagggaaaaaataactaccctttaattactttaccagttttactcctgtgtgatctgatgatccacttcttacaggtcatctggagccctccaaagggactttgctgaaacaacaccaacacctttgctgagtcattgtgggctttggtgaaactataggaatatatactgtcatgatacagggtgaaggcttctcatctaataaacatatattgagggtccactagatgccaggtactgtgcacagccctgtggatgatatgttgatggagacaaggttgccctgccatcaaggagcccatgatatagtggagagtgaacatgggaagctgaggtgcaaagggaacataagaggtgtgcataccaataaaaattagagacagtaggccgggcgcggtggctcacgactgtaatcccagcactttgggaggccgaggcgggcggatcacgaggtcaggagattgagaccatcctggctaacatgatgaaaccccgtctttactaaaaatacacaaaaaattagccgggagtggtggtgggcgcctgtagtcccagctacttgggaggctgaggcaggcgaatggtgtgaacccgggaggcagagcttgcagtgagccgagatggcaccactgcactccagcctgggcgacaagactccgtctcaaaaaaaaaaaaaaattagagacagtaggatgcagtcaaatagtcagagacttggataccagctgagtccatgccagtttgtagtatgatcttgggcaaagtcacctagcttctgtggccttgccttttccttctgaaaaatggtaaagatgctatattttttcccctgtcacctcaggtggtataaggagaatatgacttcaaggacaaaaaacactttgatttcttcaaaggactttgcaattgctataaaaattcaagatgtcagtattgacagttttataacacagagctaagatatctagataccattatcaggatatggtaacaatacccactaatacttattttatgctatctgaatgtttaaattttttaatggagtactgttatacaaaataacttttttttttttgagtcagagtcttgtgctgtccagcctggagtgcagtggcatgaccttgactcactgcagcctccgcctcccaggttcaagagattctcgtgcctcagcctctcctgagtagctgggattataggtgcccaccaccacacctagctaatttttgtaattttttttttttttttttagtagagacggggtttcaccatgttggccaggctggtctcgaactcctgacctcaagtaatctgcccacctcggcctcccaaagtattgggattacaggtgtgagccaccgtgccagccacaagataactttttatcagattttttttgtctctattcatattaactacaccaagatcaagttacaaaaagttgtcagccgggtgccatggctcacgcctgtaatcccaacactttgagaggccaaggcaggtggatcatttgaggtcaggagttcgagaccagcctggccaacatggtgaaagcccgcctctactaaaaatacaaaaattagccgggccgtagtggcgtgcgcctgtaatctcagctacttggtagactgaggcaggagtatcgcttgagcccgggaggcagaggttgcggtaagccaagatcgcgccactgcactccagtctgggcgagagagtgagaccctgtctcaaaaaaaaaaaaaaaaaaaaaattgtcatatctgttgccatagcaatgaagtaagctactcatcagtcttcctacacctctgtacatttattaagccttctatttgaataaatataaacttcatttcaggataaaatatatagggaatggcaaaactatgaaattatttaacttgcttaaaagattaaaactgaactcaactttaattctaggccctgggccggcccttcaaagcattggaaagtcgtgaaattgatgtgttgctctctcttttccagctgaactgtcccaagcaataaacagtggtacattgttatcaaaaccgtccccacccttaccacctaagagaggcattccatcaacctcagtacccaccttggagtctgctgctgccatcaccacaaaaacaccaagtgatgaaagagagaagagcacgtgttctatgggctcggaactactaccaatgatctcacctcgctctccgtcccccccactgcctactcatatacctccagagcctccacgcacccctccattccctgctaagacttttcaagttgtgccagaaattgagtttccaccatccttagatctacaccaggagattccccagcaggaagatcagaaaaaggaagtccccaagaggatactggaccagaactttggggagccccatataccctctaggctgcctccactcccactgcatattcgaatccagcaggccctcaccagcccacttcccatgactcctattctggagggttctcacagagctcattcgttgctttttgaaaacagtgacagcttttctgaggacagcagtacgctgggtcggaccaggtctcttcccatcactattgaaatgctaaaagtgtaagtgcctttaaagcttgcctcttatttctcctttactctagatagccctgcttggaaaaaattacttataaaaagaaaatgtgggccgggcctagtggcccacacctgtaagcccagcactttgggaagctgaggcaaatggaccgatcacctgaggtcaggagttcaagaccagcctggccaatacagtaaaaccctgtctcgatgaaaataacaaaaattggccaggcgtggtggcacatacctgtaatcccagctactcgggaggctgaggcaggagaatcgctttaacagggaggtggaggttgcagtgagccaagactgtgccactgtactccagcctgggcgacaaagcgagtctctgtctcacagaaaaaaagaaaatgtgaataatttttttttttccgagatggagtcctgctctgtcacccgggctggagtgcagtggcacgatctccgctcactgtaacctctgccgcccaggttcaagcgattctcctgcctcagcctcccgagtagctgagactacaggcatgtgccaccacattcggctgatttttgtatttttagtggagatggggtttcaacatgttggccaggctggtctcgaactcctgacctcaggtgatccacctgcatcggtctcacaaagtgctgggattgcaagtgtgagccaccgcgcccagcattgtgaataaatttaaagtacaaagaatactctgccaaaagaataagttatagaatttggactctttctttttttaatcttaccttaaaactttatttttatttatttatttatttatttatgtttgagacaggttctcactctctcactcaagctggagtcagtggtgcagtcttggctcactgcaacctccatctcctgggctcaagcaattctccctcctcagcctcccgagtaactgtgactacaggcgcatgccatcacacccagctaatttttatattttttgttagagatgggattttgccatgttgcccaggctcaccctgaactcctgggctcaagcagtctgcctgcctcaacctcccagaatgctgggatcatgggtgtgagccactgcgcctggccaaattttgattttttactcttgtgattttttttttttcatggagatttttgtgatgacacaaaatttacaaaattatgtacatgaaaaattacaaccgctagttttatatactacagggaaggcattgtataatgttgtgcttaagagcattcaccttggagtgagatagccctgggttcaaattgcagcactaccactcttagcttatagtagtgttaagttactgaagccttctgctctttagttatatcatctctaaatgggaataatatttactctgtaggcttgtgagaatgacattagacaaattctggaaagcaccagtgcctaataagtggtaaagctgggatctgaacccttagattaatacctgctaaaaagtttcttagtaagattgttaaagttaagggagagaattaattataagttacttcatccatagatttttttgtatttatggttatttcagtcctttgtcttttttttttttttgagatagaatctcactcttgtcacccaggctggaatgtagtggcacaatctcggttcacttcaacctctgcctcctgggttcaagagattctcctgcctcagcctctcaagtagctgggattacaggcacctgccaccatgccaggctaatttttgtatttttagtagacacagggtttcaccatgttggccaggctggtctcaaactcctgacctcaggtgaatttgcccacctccatctcccaaagtgctgggattacagccatgagccaccacgcccagtctttatttcagtcctttgtcttaaaagtcagttatcctcttcatttctaaaaggaaaatataattatgttaatttgttagtccagacgatgaagaagaagaggagcaaacctgtccatccacattcagtgaagaaatgacacctacctcagtcattcctaaattaccacagtgtctacgggaggaagaagagaaggagagcgactctgattcagaaggtcccattcagtaccgagatgaagaagatgaagatgaaagctatcagagtaagaaagggagggaaaagcaaaacagagaattcttttccagataaaactatttgctgatcttagcaagtgtcaaaagagatatggaaacaggtaccttctcccattaagtcatctggctaactgatgttggaagccactgtgaaggactccttgtccctattatcacccctctgttaaaacaagccaagacagggatccaagtagattgagtcactcaggttttaggttttttgtttttttttgttttaatttttttttttttttttggacaaggttttgatctgtcacccagctggagtacagtggtgcaatcgtcgctcactgtagcctccaactcctggacttaagtgatccttacgcctcaacctcccaaatagctaggacagatgtgtgccacaactggttaggtttctttgattttttgttttgttttttgtttttgtagagacagggtctcgttaggttgcctagcctgttctttttttttttttttgagacggagttttgctcttgttgcccaggctggagtgcaatggtgcgatctcggctcagtttaacctccacctcccaggttcaagcaattctcctgtctcagcctcccaagtagctgggattacaggcatgtgccaccacacctggctaattttgtatttttagtagagatggggcttcaccatgttggtcagactggtctcaaactcccgacctcaggtgatctgcctgcctcggcctcccaaagtgctgggattataggtgtcagccaccgtgcctggccataaaagatatatatataattttttttttttttttagacagagtcttgctctgtcatccagactggagtgcaggggcacgatctcaactcactgcaacctccacctcccgggttcaagcaattctcctgcctcagcctcccaagtagctgggattacaggcgtctgccactaggcccagctaatttttttttatttttagtagaggcggcgcttcactgtgttggccaggctggtctcgaactcgacctcgtgatccgcccacctcccacagtgctgagattataggtgtgagccactgtgcccagctgcccaggctgttattgaactcctgacctcatgtgatccccctgccttgacctcccaaagctctaggattacaggcatgagccaccgtgcctagcctatttttaatttttatagatatataatagtaatatatatttatggggtacatgagatattttgatataagcatgtgtgtatgggtaattaggctatccatctcaagcacttatcatttgtttgtattgggattattccaaatctacctttctggttatcttgaaatatacaatgaattattgttaactatagtcaccctattgtgccaccgaacactagatcttattcctttttttttgagacagtgtctcactctgcaggctagagtgcagtggcacaatctcagctcaatggaacctccacttcctggctcaagcaatgctccaacctcagcctcccaagtagctgagaacacaggtgtgagccaccacgcccagctcatttttgtatttttttatagagacagcgtttcaccatgttgcccaggctggtctcgaacttgtgagctcaaagtgatctgcccacctcagctcccaaagtgctgcgattacaggcatgagccaccacgcccggcctagatcttatttcttctatctaattctgtttttatacccattaaccagtctctctctcccccatcccctctacccttccctgcctctggtaaccaccattttatttattacctccatgagatcaacttttttagctcccacgtaagagtgagaacatacaacatttatctttctgtgcctggcttatttcacttaacgtaattgtcctccagttccatccattttgttgcacataacaggatttctttctttttcatggcagaataatcttcaattgtgtatatacaccacgttttctttatcccttcatttattgatggacatttagtctgattccatatcttggggattataaatagtactgcaataagcatgactgattgatttgctgatttcctttcttttggatatgtacccaacagtgggattgctggatcgtatggtagttctattttttttttaatagacggaggctcactctgtcaccaggcaggagtgcagaggcacgatctcagctcactgtaacctccgcctcccaggttcaagcgattctcctgcctcagcctcccaagtagctgggattacaggtgtgtatcaccatgcccagctcattttagtttttgtttttgtttttgtttttgtttttttagtggagacagggtttcaccatattggctgggatggtcttgatctcttgacctcatgatccacctgccttggcctcccaaagtgctgggattacaggcatgagccaccgtgactggcccggtagttctatttttaagggtgttttgtttgttttgttttgttttttaagtagagacacagtcttgctgtgttgctcagactgatctgaaactcccagcctcaagcaatcctcctgccttggcctcccaatgtgctgcattacaagcatgagccacctcatttggcctattttcagttttttaaggaacctccatagtgttttccacaatggctgtactaatttcaggtttttgtttgcccccaattttaaaactattcacctaagtgcctctaatcccagcactttgggaggccgaggccggtgaggtcaggagcttgagaccagcctggccaacatggtgaaaccccatctcttctaaagatagaaaaaattagccaggcatggctggccacggtggctcacacctataatcccaacactttgggaggccgaggcaggcggatcacctgaggtcaggagttcgagatcagcctggccaatgtggtgaaaccccatctctactaaaaataaaaaattggctgagcatggtagcaggcgcctgtaatcccagctactcaggaggctgaggcaggagaattgcttgaacccaggagacggaagtcgcagtgagccaagactgtgccactacactccagccggggtcacagagcgagactctgtcgcaaaaaaaaaaaaaaaaagccaggcatggtgacaggcacctgtaaccccagctactcaggaggctgaggcaggagaattgcttgagcctgggaggcggaggttgcagtgagccgagatcttgccactgcactgcaacctgggcaacagagcaagactccgcctcagaaaaaaaaaaaaaaaaagaggccaggcgtggtggctcacgcctataatccctgcactttgggaggccgaggtgggtggatcacctgaggtcaggagttcaaaccagcctggccaacataacgaaacccgaaacccggtgtctactaaaaatacaaaaaattagctgggcgtggtgacccacgcctataatctcagctactcaggaggctaaggcaggagaatcacttgaacctgggaggcggaggttgcaatgagctgaaatcgtgacactgcactccagcctgggcaacaagagcaaaagctctgtctcaaacaaacaaacaaacaaaaaaaccaacaacaatatggagtagaggaaaggtggcacatgggctaaggtgaaaagataaaagtgatgttttccctttggtctaatgaacttattgccacagggcagagaaaaataaacattttcataccctcacatctttgcaaataattgagtcctgattaattgaagtagaaaggcagctttaaaaacagatagactatgaggtgttagtatgaaagcctttatgttttaattcagagggctgtcccatgcttagattctctctcctgtagcaactcttaccaaggaggaaaaatgtagaggcctgatagaagagaaaagataccttttaaccatcttagtccacctggctaaaaagatttttaggtgtctttagctttacccccacctcagtgttcagctggatcatttgaggccaggtgggaactgggaattaaatattgtatttgttcagactcttgactagctccaggtaaggttgaacctttggctttaagcctcaagttctacatttttttcttccccgtgtgcaaaggtgctctcgccaacaaagtgaagaggaaagacacactggcaatgaagttgaaccacagacccagtgaaccagagttgaacctgaattcttggccttgtaaaagcaaggaggagtggaatgaaatacggcaccagattggaaacacactgatccggtaggcctttgcttagatttgcttgattgatttggttatgccagtatttgtgttagatgttgttagatgtgttgtttttttgtgtgtgttttgtttcgttttctgagacagggtcttgctctgtcacccaggctggagtagtggcgcgatctcggctcactgtaacctccacctcccaggttcgagcaattctcctgcatcagtctcctgagtagctggcgttataggcacctgccaccacgccaggctaatttttgtattcttagcaaagacagcgtttcgccatgttggccgggctggtctcgaactgctggcctcaagtgatcacccaccttggcctccacaagtgctgggattacaggcatgagcccctatacctagtctatatgtttactttgttgtggagtattcatttatcttttttagtgtgatttttttttcttttcagacagagtcttgatctgtcacccaggctggagtgcagtggttcaatcatggctcaccacctccaactcttgggttcaaggcaccctcccacctcagcctcttgactagctgggtcctcaggcatgcgccaccatgcactgctaatttttgtaattttttgtagagacagggtctctctgtgtttcccaggctggtctcaaactcatggcctcaaacattcctcccacgttgccctccgaaagtcctgggattataggtgtaagccaccacacccatcactttgagtataattttaaaaaatacatattgggttttgcatgaaaggagagaaggttagcactccacttgacaaggatggaagaggccctttgggcctgacaacacacatacaaggcattgccacctactacgtggcatctaactatctttacaaaaaaagaaaaagaaaagaaaagaggctgggtgcagtggctcatgcctgtaatcctagaacttcgggaggctgaggtaggcagatcatctgaggtcaggagttcaagaccagcctgaccaatatgatgaaaccccatctctactaaaaatacaaaaattagccaggcatggtggcatgcgcctatagtcccagctactcgggaggctgagatcggagaattgcttgaacccaagaggcagaggctgcagtgagctgagatcgcgccactgtactgcagcctgggcaacagagtgagactccatctaaaaaaaaaaaaaagaaaagaaaagaaacaaaaaaatatatattggacacagttgggtatcctctaagaatttggaaattgaagatgtagctgcctgtgagagttttattttatttattttatttttgagatggagcctcgctctgtcacccaggctggagtgcaatggtgcaatctcggcttactgcaacctctgcctcccgggttcaagtgcttctcctgcctcagcctcctgagtagctgggactacaagctcataccaccacacctggctaatttttgtatttttagtaaagatggggtttcaccatgttggccaggctggtctcgatctcctgactcaggtgatctgcccgccttcgactcacaaagtgctgggattacaggtgtgagccaccacacctggccagcctgtgagagctttaaaccatgagatagacatatggttttgcaaaagtttctacataaatcagaatggttcccagaacagaaaggctcctctgtcactttttttatctggttgcttaaccataagatgccaacccaattaacagtcacacccatatttgcattatatctgtttcatatgttccgtgtaactgcctcctttcaaagtgttggtatatttttcaagtcaactggaaccaaaagtatagagaaactgaatgcaagccagctttctgcatatgtaacagtgtaagaatccaggttgtatagatgggtttttgtttgacacagatgtttctcccagtaaagagaggataaggagctggaactcgtggcacagttccctacaaaataattaattgatcatgtctactaattaaaatttctttttctgtactattgcagatacctggttttggctgggcaaggtggctcacacctataatcccaacattttgggaggctcacttgaggtgggaggctcacttgagcccaggagtttcagagcaacccgggcaacaaagtgagatcccatctgtacaaaaaattaaaaaattagctgggcatggtggcacatacctctagtccagctattctggaagcttaggtagaaggatcacttgagcctgagagatcaaggccgcagtatgctgtaattgcaccactgcactccaccctgggtgacagagcaaaaccctgtctcaaaaaaaaaaaaaaagagacacctggctttactgtgtatgctgtacctcagggcaagttttccctttgtcttctaatagacactttttggatccagaaattgttctctgcaatttctttacttaaacataattatcagcctgtatgacctctgtggtctgactactttgaaattaagggagaaggctgggcacggtggctcactcctgtaatcccagcactttgggaggctgaggtgggcggatcacttgagcccaggagttcgaggcaacatgacaagaccctgtctcgacaaaaaaacaaaaaacttagccagacatggtgacacacgtttatggtcccagctactcaagaggctgaggcagggggattgcttgagcccaggaggggctcaaggtcggcccaggaggtcaagacccaggcgatcaaggcccaggaggtcaagactgcagtgagctgtgctcatgccccactgcactccagcccagtcatcagagcaaaaccttgtctcaaaaaaaagtaaagaaagacatgtttattatatggtagtttgaaaaattacaaaaaaaagagataaatcatggccggacgcggtggctcacgcctgtaatctcagcactttgggaggccgaggcgggtggatcatgaggtcaggagatcaaggccatcctggctaacacgatgaaaccccgtctctactaaaaatacaaaaaaattagctgggtgtggtgctgggcctgtagcccagctactcgggaggctgaggcaggagaatggcatgaacctgggaggtggagcttgcagtgagctgacatcgtgccactgcactccagcctgggtgacagagcaagactccgtctcaaaaaaaaaaaaaaaaaaaaagagagagataaatcagccataatcctataccctataagccaggatttggcaaacttcttctgtaaagaaccaaatagtaaatattttaggatagggtgcagtggctcatgcctataatctccgtactttgggaggccagtgtggaagaattgcttgaggccaggagtttgagaccagcctgggtaacatagtaagactctatcactacaaaaataaaaataggtcaggcacagtggctcacacctgtaatcccagcacgtttgaaggccgaggcaggtggatcacatgagatcaggagttccagaccagcctggccaacatggtgaaaccccatctactaaaaatacaaaaattagccaggcgtggtggcgcccacctgtaatcccagctactcaggacactgaggcaagagaatcacttgaacccaggaggcagaggtttcagtgagctgagatcacaccatggcactccagtctggacgacagagtaagactccatctcaaaaaataataaataaaatagccaggcatggtagcatgcccctgtagtcctagctacgtgggaggctgtggcagcagaactacttaagcccagtagtctatatactagacagggcataaatatagttatatttaatatatttaatatatgtgtgtatgtgtatatatatgtgtgtatgtgtatatatatgtgtgtatgtgtatatatgtgtgtatgtgtatatatatgtgtgtatgtaatatatatgtgtgtatgtaatatatatgtgtacgtgtgtgtatatatgtccatatatatatatggatttgatggccatataaactctctctttttttttttcctacctttaaaaatataaaaacatgggtcgggcgcagtggctcatgcctgtaatcccagcactttgggaggccgaggcgggtggatcacgaggtcaggagacagagaccatcctggctaacacggtgaaaccccatctctactaaaattacaaaaaatttagccgggtggtggcaggcacctgtagtcccagctactcgggaggctgaggcaggagaatcgcttgaacccaggggacagaggttgcagtgagctgagttcacaccactgcactccagcctgggcaacaagagcaaaagaaactccgtttcaaaagaaaatatagtttatacatacagtggaatattatttaatcttaaaaaagaaggaaatcctccaatatgctaacaacatagtcaaaccttgaggacattaatatgagtaagccagtcacagaacaataaatactgcatgattccacttctgcgaggtatctgaaatagtcacatttatagaagcagagagtagaaagatagttgtcaggggctcgggattgaaggcaggggtgatagggagttgctaataaataagtataaagttttagttatgcatgatgagtaagttctagagatccactgtacaacattgtgtttatagttaatactgtagactgggcgcggtggctcacgcctgtaatcccaacactttgggacaccgaggcaggcagatcacgaggtcaggaggtcaagaccagcctggccaacgtgatgaaaccccatctctactaaaaatacaaaaattagccgggtgttgtggcaggcacctgtaatcccagctagtcaggaggctgaggcaggagaattgcttgaacccgggaggcagaggtttcagtgagccgggatcccgtgccactgcactccagcctgggcaacagagtgagactctgtctcaatcaatcagtcaatagttaatactgtattggccaggtgtggtggctcatgcctataatcccaatactttgggaggccgaggcaggcgtatcacgaggtcaggagttccagaccagcctgaccaacatggtgaaaccccatctctactaaaaatacaaaaattagccgggtgtggtggcgcatgcctgtaatcccagctactcaggaggctgaggcaggagaatcgcttgaacctgggaggcagaggttgcaatgagccaagatcacgccactgcactccagcctgggcaacagagtgagactctccatctcaaaaaaaataataataatactgtattgtacacttaaaagtctgttcaaaaggtagatctcatagtaagtgttatcactataaaataagattgaaatttaaaaaaacacacacaataagagaccaccacgagtacactaggatggctaaagttatgcaatttaaaagactgacaaggccgggtgtggtggctcacccctgtaatcccagcactttgggaggccgaggcaggcagatcacctgaggttgggagttcgagaccagcctgatcaacatggagaaacttcatctctactaaaaatacaaaattagctgggcgtggtagcacatgcctgtaatcccagctacttgggaggctgaggcaggagaatcacttgaaccggggaggcagaggttacagtgagccaagatcgggccactgcactccagcttgggcaacagtgcaaaactctgtctcaaaaagaaaggaaaggaaataaatacaggagtgatatgttcattcttgcaattgtgatgatgatttcacaggtgatatatggcaaaagtggccaaattgtacatgttaagtatgtacacagttgtacatatttacagtattattgtgtcagttatatcgtattaaagctggtttgttttttgttttttgttttttgtttttccgaagaacatttaaaaaggaaggcccaggccaggcatggtggctcatgcctgtaatcccaacactttgggaggctgaggtaggaagatcacttaacgtctggagttcaagaccagcctgaccaacatgctgaaaccccatctctattaaaagttagctgggcctagtggtgcatgcctgtagtctcagctactcaggaggctgaggcagggcaatcacttgaacccaggaggctgaggttgcagtgagccaaggtggcgccagtgcactccagcctgggcgacagagtgagactctgtctcaaaaaaaaaaacaggaaggtccagctgggtgtggtggctaacatctctaattccagccctttgggaggctgagctgggggaatcacttgagcccaggaatttgagaccagcctgggcaatatggcaaaactccatcactaccaaaaataaaaaaattagccagcccagtctctaaataaataaatacatacatacatacatacgtactttttaaaaaataaaatggggcggggcacagtggctcacgcctgtaatcccagcactttgggaggccgaggcaggcggatcacaaggtcaggagattgagaccatcctggctaacacggtgaaacgccatctctactaaaactacaaaaacttagccgggcatggtggcacgcgcctatagtcccagctactcgggaggctgcggcaggagaatctcttgaacctgggaggcggaggttgcagtgagccgagatcaagccactgtattccagcctgggcggcagagcaagattctgcctaaaaaaaaataaaaataaaataaaaataaataaataaaatggaagatccttgaggtaggaggatcatttgagcctaggaggtggagctgcagtgagctgtgatcgcaccactgcactctagcctgggtacagagtgagaccctgacacacacacaaaaaaaaaaaaaaaaaaaggaaggtcttgttcagaaagaaaagttgtatatagaatgggactggaagttccttatgcaagcaacagaagagttgaaaattttgcaagtactagctaattagcccaaatactgtctgagaagtataaattaaaagtaagaaatgaataactttctgatttcaaaaatgacaaattgtagttttttgttgttttttttttttttttttttttttttgagatggaatctcactctgtcgcccaagcaggagtgcagtagcatgagcttcagctcactgcaacctccatctcccaggttcaagcattctcctgcctcagcctcccgagtagctgggactacaggagcacgccacaacatccggctaatttttgtatttttcagtagagacagggtttcaccatgttggccaggctggttttgagttcctgacctcaggtgatccacctgcttcagcttcccaaagtgctggggattacatgcatgagccaccacacctggccaacaaattgttattggtgaataacatctcagaactgtgatgaggtgagataactttatcaaatgcttcacagagaagactgagatttaaatcatagaattatagaatatcacacagaaagagacaaacttaaattccagtggttcctaaaccactgatttaaaaacctagctgggcatggccaggcgtggtggctcacgcctgtaatcccagcactttgggaggccgaggcaggcggatcacaaggtcaggagatcgagaccatcctggctaacacggtgaaaccccgtctctactaaaaatacaaaaaattagccaggcgtggtggcaggcgcctgtagtcccagctacttggaaggctgaggcaggagaatgtcatgaacccgggaggcggagcttgtagtgagccgagattgcaccactgcactccagcctaggtgacagagcaagactccatctcaaaaataacctagctggacataatggcttgcgcctataatcccagcagtttggggggccaaggcgggaagatagcttgagcccaggaggagttcaagactatcctgggcaacagagtgagaccctcatctctattttcaaaaaattgtaaaaaaaaaaaatctaaagaggggcatctgagtcatagaagaagttttgtgaaaaaaaaaatctatatatagatatatgtaatttcatttttcatcctgattttctgaatcagaatttctgttaacgtttcttgggaatctgtgttttctaaaaagtctctaatgcttctgaaggagcaaatttgtttaggagccaccagttcggtccaaaccttcgcttcacggatgaggacactcaaggtctaactgaacttttttgtgctaatagctcttatcaaggtctagaactagaatcctggccacttgtttgcatatacagttcctttttataatgtgatatctgtgttaacacttttaatgtgaaattgttttataaacaatcataaataaatgaaatatatcagtttgaaaatttgttgatttcttacttatataggggctaatatatactgtgaccaaaaaaatctttataaacaagattgggaggtttaacataaacattacctttatttatctcatttttaggcgactgagtcaaagaccaacaccagaagaactagaacaacgcaatatattgcaacgtgagtccagttatggaaataaagttgtatagattttctttgtatgtttctgactttaatatacataaaagaaaaaagaagcgtttgctacaagggctaagggagagtgttccagccaggcaaggactatttatttccccatgaaggaacagagcttaccaagcttcctttggaagatgctattatggtattgtttagtgtgctgtgatactctagaaagctttgtttcagtgttctcactgtatcctggaactgccttgggcatttgggaggctttgacagtatatgggagatgtgcccaatttttctgttttcagggagctaaggaggtagctgtgcatatggagaccttcctattcctagaatgtgagggctggggcccaaagcaagtcccaaatgcagcagcttttctcttggtttaatcccttaagactttcttacctctgtagttaccaaatgggaccatatatttaatttgctgtctgtgtacataattaatttcctgaaatagcattctaatctagtacatatttcatttgtttttccagaatatagagtgaaatttggccttaaaagtctcctcactgagaaggtttgggcttccttggggctatttgtgagcatgttcagtctgaccaatccatcccctgttctctcagcactacttgggtatacacaacttaataacttagtacattttctagtgtgggagcccttataacgtatcacacaaaactcagtgtgatcaccattgtccattcttagcagttactcttgagcaagaatctgcaggcttttccttaaagcatacatagtaaacattttgggttttgcaggccaaaaagcaaatgaacaactatacgtaataggtccttacaaaaccatttaaaaatgtgaagactattcttagttcatgggcaggaaaaatacaggcaactggcgagatgtggtgccatagtttgctgactcttgcttttaagtatttgtatcgttgacaagaaaattgttttgtttagccatccccaaagttagtattttattctgatttgggcctataagaaatatctgggccgaggcgagtggatcacaaggtcaggagatcgagaccatcctggctaacatggtgaaaccccgtctctactaaaaatacaaaaaaattagccgggcatggtggcgggcgcctgtagtcccagctactcgggaggctgaggcaggagaatggcgtgaacccgggaagcggagcttgcagtgagccgagattgcgccactgcactccagcatgggcgacaaagcaagactccatctcaaaaaaaaaaaagaaaaaaaaagaaatatctgggctgggcacggtggctcacgcctgtaatcccagcactttggaaggccgaggcgggtggatcacctgaggtcaggagtttgagaccagcctgaccaatatgatgaaactctgtctctactaaaaatacaaaaatcagctgtgcatggcatgtgcctgtaatcccagctactcgggaggctgagacaggagaatcgcttgaactcgggaggccgaggttgcagtgagccaagattgtaccattgcactccagcctgggcaacaagagcaaaactccgtctcaaaaaaaaaaaacaaaaaagaaatatctgtaatgtaattactaaaacgtttgatatgcaaattgtcatttgtgagtaatattccttccttctgattgtcaactgtagctaaaaatgaagctgatcgtcaggcagaaaaacgagaaattaaacgtcggctcactagaaaggtactactgcctgtgtgttcagttaactatatgtgttatatttggatggcctatttgattggaaatgaattcacagctgggcacagtggcttgcgcctgtaatcccagcactttggaaggccatggcaggaggattgcttgagcccaggagttcaagaccagcctggggaaaacagtgaaaccttgtgtctacattaaaaaaaaaaaaaagaagaagaaagaaaagaaaaagaaaaaaatgaatttgcagcctgggcaacatggcaagaccccacctctacaaaaaaaaatatatattagccaggcatggtggtatgcgcctgtaatatcagctacttgggaggctgaggtaggaggatcatttgagcttgggaggttgaggctgcagtgagctgtgattgtgccactgcactccagcctgggtgacagggcaagaccctgtctcaaaaaaaaaaacaaaacaaaaaaccacctgataaccataatcactgggggtgggacctccagggatcaatagtgtctaaagctcccccaggtgattccaatgaagattgaagcactgggttagaggcaatttgaatgcatgattgatgcctaattattggcttggtgaactaagaggctccgtttccttcagctcagtcaaaggccaactgtcgctgaactccttgccaggaagattctgaggtttaatgaatatgtagaggtaacagatgctcaagattatgaccggcgagccgacaaaccttggaccaaactgacccctgctgacaaggtacctggaaagcactctcttgctttttttctctttctctttttctctttatttggaggatccaagatactaactagaagggagaaccataaacaaaacttctagttttaatataatattaaatttcaaatcaagatacaaaatgccaagttgaacaagtcaaaatgttatactaactcagtatgttttggtaactccaccaccaatactgaaagaaagaaaatccctgctatctcacagagtaaaaatactggaaggaataaatacatttcaaacagtggttgtttggttagagggagtttgggctatatattttagtaattaccaatatttcatttttataatgctgtgaaaaactataaaagctggccaggcgtggtggcttatgcctgtaatcctagcactttgggaggccaatgcagagggatcactcgaggtaaggagttcgagaccagcctggccaacatggtgaaaccccatctctactaaaaatacaaaaattagctgggtgtgatggcatgcacctgtaataccagctacttggaaggctgaagcaggagaattgcttgaacctaggaggtggaggttgcagtgagccaagatcatgccaatgcactccagcctgggcagcagagtgagactccacctcaaaaataaaaataaaaaattaaaattaaaaaaaaaacaaaactagccaggtgcagtggctcacacctgtaatcccagcactttgggaggccgaagcaggtagatctcttgaggtcaggagttcaagaccagcctggccaacatggtgaaaccctgtctgtactaaaaatacaaaatagccggacgtggtagtgcgcacctgtaatcccagctattcgggaggctgaggcaggagaatcgcctgaacccaggagctgaaggttgcagtgagctgagattgcaccactgcactccagccccagcaacggagcgagattccatctcagggaaaaacaaaaataaaaacaaaactataaaagctacaatatatctttcaagattttcaagtattttgattaaactaaaaattttaggtttattatgagacagatgggtatcattgtgttgacctggtgtctgggttgcctgtgaggggttgcagtgacttacaaagttaaacacagtacagaaaaatgacaagttacactgctgtgcaaagcagccagaagaagctgaaacatttttgtctctactccacaggctgccataagaaaagaattaaatgaatttaaaagctccgagatggaggttcatgaagagagcaaacattttacacggtaagacccaaaagacccaatcatatatgtgctaggtagagttttccaaaaaattgttcagatatgaagggctctaatgacatcagtaaaaaggaaaacactcagtgttgattgcaagactgcattcaaagggatgaaaagtaagaagcaatagtaaatgcctaggccaggtgcggtggctcacgcctgtaatcccagtactttgggaggctgaggcaggtggatcacctgaggtcaggagtttgagaccagccggaccaacatggcaaaaccccatctctactaaaaatacaaaaattagctgggcctggtagcaggcgcctgtaatcccaactattagggaggatgatgcgggagaatcacttgaacccgggagatggaggttgtagtgagctgagatcatgccattgcactccagcctgggtgacaagagcaaaactccatctcaaaaaaaaaaaaaaaataagtaaatgtgtattctgattatggcatttcatgtatattatttaatccttgtaataaacatgcaagatgtgttaacatccccattttatcactgaggaaatggaggctcacaatggttaagtaacttggttgacttgctagtaaattgcagaaccaggattcggagaaagaaatcaatgacttcaaggatgtgaggtgctctcttccttgtaccttactctctcaggttataaatgaggagactgtgctaagttagacaagatcttgccctctctggttcagttctgtctagcacagttgatcttaccaacttaatgtataaacaacattttaattagctgtcttcatgaaacaagccaagaaatccaacaaagccaacaagccaacaaatcaagtgttttgatttggaattacggttgtgattaaggacccacccatatccaaagaatcagctagccacaaatggaatcagtgaaagtatctttacatgattcttagaacatttacaaaaagaggcaaatgaggctgagtgcagtggttcatgcctgtaatctcgacactttgagtggctgaggcgggaggatcgcttgagcacaggagtttgacaccagcctgagcaacatagtaagactccatccctacaaaaaaaaaaaaaatctattttttgatttaggcaggggcctggtgcagtggtacacacctgtaatcctagcactttgggaggccgaggtgggaggatcactttgagaccagcctgggaaacacggtgagccccatctctacaaaaaataaacttaaaaaaaaaataagcaaggtgcagccaggcgcagtggctcacacctgtaatcccagcactttgggaggctgaggcaggtggatcacttgaggccagttggagaccagcctggtcaacatggtgaaaccctgtctctactaaaaatacaaaaattagccgggcatggtggcatgcctgtagtcccagatacttgggaggctgaagcaggagaatcacttgaaccccggaagcagaggttgcagtgagccgagatcgcgcaactgcgctccaacctgggcaacagagcaagactgtctctcaaaaaaagaaaaagaaggaccagcttaagcaagacgatgggagagaggaaaacacatggtgtttctgggtaacagaaaatgtagctggatcagaggatgtttggggcagtgtggtgaaaataaactagaaaatgggttgcagtccctcgcaatgctttgactgttatgctaggatgttggaaccattggcagttcataagcaggaaattctgtgtatttcagaacaagctctgatgcaaacaacaaagatgatatggaaggatgaagagactagcagcaaggaaaacaggaagtatctgaaataatcttagtgagcatagtggtagctcacaccagagatagtgagaatgcaaaggtgatagatttgtaagacatttcaagcatagaatcaacaagatgtggcaatttgttggattccagagatgaaataaaggagtagtcaaaatgactctgatatttttaacttgtattttttgaggtctttgaaggtgataagtttagctgaacagtttagtttattcaacaaatactgagcacctaccacgataggtatagtgctaggtccttgggctacagcaggaaataagataaagtctctgtcctcaatgaggctttattctttttttttctttttttaatagagatggggtctcactatgtttcccaggctggtcttgaattcctggcctcaagtgatcctcccatcttggcctcccgaagtgttgggattacaagtgtgagccactatgcctggccaagcttttattctaaaagaagaaggcagacaatgaacaagctagaaaataaattgcatgtgtttagtttgaggagcctatgacacatggagatacctagaagaccattagatatgcagcctagaatccagaaagaaagcaaagtctcaagatacaaatgaaagaagatagtggacctttaggggggattttatttttatttatttattttttttttttttattttttgagacaaggtctcactctgtcacccaggctggagtgcagtggcatgatcgtggctcactgcagcctcaacctctcatgttcaagccatcctcccacctcagcctcctcagtagctgtgactacaggcacaggccaccacacctggctaactttttgatcatttgtagagacagggtctccgtatgttgcccaggctgctctcaaactcctggtctcaaatgatcttctcaccttggcctcccaaagtgttgggattgattacaggcatgagccaccgtgactggccaaggaaagttgttttttatttaaagggtagacagaggaaaatgaaccaggacagcatactgagaaagatcaattgaagaagagagaaaattatggaaaagatagtgttacagaagccaagagaagagttcttttttttttttttttttttttttgagacggagtctcgctgtgtcacccaggctggagtgcagtggcgcgatctcggctcactgcaaactccacctcccaggttcacgccattctcctgcctcagcctcgcgagtagctgggactacaggtgcgcgccaccacgcccagctaattttttgtatttttagtagagacagggtttcaccgtgttagccaggatggtctcaatctcctgacctcttgatccgcccgcctcggcctcccaaagtgctgggattacaggtgtgaaccattgcgcccagccgagaagagttttaagaaggaagcagatgaggagtatcagatgcaacagaaaggtcaggtcgaattagagcagaggaaaggcagtgttaattaggtataacatttcattactactgatacattaatagcaaagcaatgtacatcatgtggtaacttgtctcttttttaatctcttttagctaccatcgtccatgatgccaaaggttgagagaggaatcaacatggctgctttgctgcttccttctccaaagtgacatatggagggaactttagcacttcccagcacagccagaattgcatcctctgggatcttctgaggtggacagcactttgaatgtagcatttcactggaacagagtcttatgtgctgcaccgggggcaaaacaacactttgtcagtgcttttgaacctttcaatattgtagcatgcttgaggagtttttcccttactggccaccaaagttctgaaccacttgcaggttccaggttttactggctgcaccacaccccttcccctagatgactgcctgtgcagagacacagtttgcaccattagccttacctgccctgccctgattgtgagacccaaatgtgtaggctctaaattccagccatcaaatccaattcctggtggggaaaaccttctggagacccccaaccttctgataaaagagtctctacctccagggaaagccttcttaccacactggcatatcagatgaaagcattgcactgtacctctcgtaacacagcaatacagtcctcttgaggcactcaagcctgagaggaagctcaggatctgacatgttcttccttttcctcacaagtcatcatgattttttattttaaaataatctggaagtaatgggaacttagtttttcctgaactccaaccagaatccaaattggttagatgaggccaggcgcggtggctcacgcctgtaatcccagcactttgggaggccgaggtgggtggatcacctgaggtcaggagttcaagaccagcctggccaacatggtgaaaccccatctctactaaaaatacaaaaattagccaggtgtggtggcgcctggttgaggcatgagaatcgcttgaacccaggaggtggaggttgcagtgagccaagatcatgcctactgcactccagcctgggcaacaaagtgggactctgtcttaaaaaaaaaaaaaaaaaaaaaatcggttagatgagaaagcatgtatattttctatatacaaaaacaagaaaggcgttttgagcccctgtgctcaggcccactcccacactgtggagtgtactttcattttcaataaatccccttattccttccttgcaaaaaaaaaaaaaaaaaaagccttagccagattcagtggctcacgcctgtaatcccaacactttgggaggctgaggcgggtggatcacctgagttcaggagttcaagaccagcctggccaacatggcaaaaccctgtctctactaaaaagtaaaaaaaattagccgggcatggtggcttgtgccttgtagtcccagccactggggaggctgaggcgggagaattgcttgaacctgggaggtggagattgcagtgagccgagatcgcgccactgcactccagcctgggtgacagagcgagactccgtctcaaaaaaaaaaaaaaagccttaatattaatgctaacgtggcagaaaactagcaggttacattttataggctattgtagttttatttaccaaatgatattctctaaatcacttcgaccaataaatgtattctcctccttaaagcagagttgtatcaactctgtgggagcatttatgagctgtcagtccccacacttctagccagaatcacaataaggtctggctgggtgtggggtgctgcataggaaagggtctctggagaagcaagaagggcacaatcatggcccactgctcccctcttcttctcagtgctctttgccctctcctgctgcgtgcttcctcttcactccagtgctgatcctcctgctctctctggcagcttccacctcacccgcccctcttccacactataaccagtatggttggtgctggggcattgactcagcccccctgctttctgcatttgtaatagatattaatatgatttcctaaaacagaagattttgttgctttctttgaacttgtattgaaaaccatacagtctcactgttttgctttaattcctatccacactataaatggaagaaaaaaattaatagcttctgtttaatctgatgaatgtggctttttttcccttcactttaatgttcaagaagttgtggctatttcatagatttcttctgatttattctgtgggtccctgttatctgttctttatgtaatctttcagtagattttcatcctttcatatccacattcttatgtggacttgctgaagaaacagaatatcagttcaaaacaaaacctaggccaggcatggtggttcacgcctataatctcagcactttgggaagccaaggcggtcaggagtttgagaccagcctgaccaacatgatgaaaccctgtctctactaaaaatacaaaaattagcctggcgtggtggcacgcatctgtaatcccaactactcaggacgctgaggcaggagagtcgcttgaacccaggaggcggagattgcagtgagccaagattgcaccactgcactccagcctgggcaacagagcgagactccatcaaaaaaaaaaaaaaaaaagaaggaaggaaggaaagcaagccctgaatccacatctccttgaagttttttttgttttattttgtttttgagacagaattttgctcttgttgcccaggccggagtgcaatggtgcaatctcagctcactgcaacctccgcctcccgggttgaggcgattctcctacctcagcctcccaagtagctaggattacaggcatgagccaccacgcctggctaattttatatttctagtagagatgaggtttctccatgttggtcaggctggtctcaaactcccgacctcaggtgatccacccacctcagcctcccaaagtggtgggattacaggcatgagccaccgtgccgagccttccttgaagttttttgtttggttttgatttgttttgttttgttttgttttgttttgtttttggagatagggtctcactctgttacccatgctggagtgcagtggcacaatcttggctcagagcaacctctgcctcccaggctcaagcaatcctcccacttcagtctaagtagctgggactacaggcacgtgccaccaggcccagctaatttttgtgttttgttagagatgaggttttgccatattgcccaggctcgtcttgaacaccggggctcaaggaatctgcccatcttcgcctcccaaagttctgagatagcaggtgtgagtcatcatgcccagcctccttgaagtttactaacaattgggataactgagggaagagaagtgacaattccactcagtctattagaggtctggatataaggtagccacacaataactctaacttgacttctaaccattctatcttattgatttggaggctgtcttctgccagattttttgtggcttgagatgatattttcgaacccttctttcactacctttcttacccttaatgtgccaagcttgaaacaggatttgatttcctgagctacttgttcgccttctgtgcgtcaccaagtaatctggttcatctttcgtctcattcatgttattttcaagtgaaacaagacattttgggggtcaagtctctttgggtgttttgtttttatgtatataaaaatggattttgtgttccctttccatgtaagtaccaacttatatggaaactcacaatcataatgtaaagaagaaatgaaagcctggtgtattgtacttcaagatgcctccctgatgtatagaatctccttgtaaaataaataattgcattgtatatcagtcttcccatcaatattaattattaaatattttagaatttttaaataccaactata

SEQ ID NO: 189 - DNA, 62221 bp, Homo sapiens
  source 1..62221: mol_type = genomic DNA
attcctgtgtgaagagtgccagtgtgaagacagttttgtaagaactgcaagtgctcaggctgtatgggaaacagaaacttcagcagatgaactgaccttatgccatttcctgatgtttggcagtgacactgaaagaggaccgcatgtcccctctttatgtggatttatcttttatgaaaagtttgcttttgtccgggacagtttgttgtcgtgagatacatcagacaatataatcatgggacaagctgatgtctccagaccggtaaatccagatgcagttggtgagtaatagaaggcagagaaacagaaaatcttgacagaagcaaggcagatttacaggtgaacttgagtatttatgtgaagttaaacacgagaatgttgatgatcccaactttgaaatgtttatgtttgtgaagaatgaatgaagtcatgcggaacatggcgagaaactttaaaaaattaagttttttaaaacttaaaaacttaaattcagtttattaatttatcgctcacagttttgttttacttgatctctttgaagttttttatattatattgctaaggaattatctgttaatttcttgccgttactaaagataaatgctacagaaacttatttagaattcagagatattttgttagtattttacagaacttggaaaatagaactgttgacttctatagacagaaccacttttaagaattaagtttttagacttggttatacattttcctaataagtctcaggcattttccattgcactagtgtttccgtttctcttaagtcaacactttgatataaacttttctgaagttagtactttacatttgaaatgttactaagggatagctagagagcaagctgattgtgagtatagctcagagtttcaaatcttctatgtgaaatggtagtcacttgtcactgcaagctcattttcctaatcttgtagggttttatatgacaatcataaattgggaaaaacagttttaagcagatgttcattaaagggttgcttaagtataagcaaaactagggaaagcctgtgaatcatttctagacattataatatttaagaaagatttataccttcactttgatttatggagcagcagaaaacatgttcagtcctaggctgcattttttgttttttgtttttcagaaacaaaaaatgttggtgacttaaaaaaaaagcataaagtgtggaaacacaggtaacactcccaaatgtttcataatgtagtgagattttgtttctaaaggtagtattttcacctgagagcttcctagatgaaatatcttcagtatttttcatgtattattgaaactgaggcacatggatcacaaagtgagtcattcagcaacagattttcagaactgaagtcaggacttgactcactttaccttgatcactagggctgtgtctttatcaattcattaactcatttaaaaaaatgaaatgtttcataaatagaaaaaggtataaagaaaaatataaagaatcatctggggccactccccagcctaacagatgaaatttagaacataaagataaacctcacactatccttctcttctgcattcccttctgatgacattttgcttctttgtttccagaattaaacactctcctatatttgataaataactcacttttgggctgtaaattctcctgtggtttctacgccaaacattagttgtttgttagcaagtatagtaaggactcaatgctaggcatttatctatgagatggaaatgaaagggctttgacaaacaataaattgtaaagcaagtaaaatttagtggtgagtggtggtatttaagaagaatgcccatctaagatctatatactgtattaaaaacttcatctgaggccgggcgcggtggctcacgcctgtaatcccagcacgttgggaggccgaggcaggcggatcatgaggtcaggcgatcgagaccattctggctaacacggtgaaaccccgtctctactaaaaatacaaaaaaatcagctgggcgtggtggcgggcgcctgtagccccagctactcgggaggctgaggcaggagaatggcgtgaacccgggaggcggagcttgcagtgagccgagatcgtgccactgcactccagcctgggcgacagagcgaaactccgtctcaaaaagaaaaaaaaaaaaaaaaaaaagttcatctgagtaacgtttggtatttgtatgcttctgaaaaaaagtaagaatcaaattcatcaattctttttttttttttttttttgagacggagtcttactctgtcgcccaggctggagtgcagtggcttgatctcggctcactgaaagctccgcctcccgggttcacgccattctcctgcctcagcctcccgagtagctgaaattcatcaattctattcctaccagtagccctaataaaagacatttgaggaagaaatagaaatcaggagcttaactaagttttttatgtttcctctggatttaattttggggttttatttcctattacctagataataagtagttgactatcagcagttttcatggactgactccattattatgctatttataattcaggatgtattctgtttgagcagatcaggaccaggttatgaaggcttaactgaaaaccttgaggactataccaattccaataaaggttttcaccaaacaacagtttcttaatttaattttcaaagcctttatgtgggtagctgtttggaaaatctcaccattttacttggaatgataaatatacaaagtaaattaaaacctaaattatctgtttactattctaggcctataatacagcacttagttttgagctttgaaattaatagtactagatttagcaagtcaactgatgcaaaacacatgaatgaatatattgaattgatttattattactttcaggcactgtgaataacatagaggcccctatgtagatattattcatgtctatgccctcaagaagtttgtcttctagttgagaatttaaaatatgaaaaagtatccaaaatatttgtaaaatttttttaaagattaaggcatacttctttttttttaatttaattttattttttttttacttaaaaaatatttgtgtgtgtgaaaatggggtctcactgtcgtgaccaggctggtctcgaactctagcctcaattgatcctcccacctcgggctcccaaagtgctaggattacaggtgtgagccaccagtcctgcagttaaaaaaaggacccactcctttaagttaattgattcccttgacttgtaatggaaggccagcgctattaaccaaagagtctgctttcaaataaataacctttgcatgaggattcatatgcaaatttatgagatgttataaccatatccaaccagagtttctactgtaggatctttctaacaactggtgaactgagtatttgaatgtacattaggaatctatgctgtggtatccattcaaggaaataagttctcatcagttcattgaaaaaaattaaataaaatacgttcataggagaagcatgtagatttatctagataaaacattgcaatcagggcagagtgcattggttcgtgtctataatcccagcactttgggaggctgacgcaggagaatcacttgagtccaggagtttgggatcagcctgggcaacatagggcaacaccgtttctacaaaaataaaaatttagccactgtggtggtacttatctgtagtcccagctacttgggaagcttaggtgggaggatcgcttgagcctggtaggttgaggctgcagtgactcatgattgtacctctgcactccagcctgggtgtcagagggagacactgtctcaagaaaaagaaacacaaactttcaaatcctactttgtagttcttaatgaacataaaaactgtttttttgctcaccaaaattctttactatgtgtcatattaaaacaactagctaattatcacatatccttaaattaggcacaagaccgaagaattttttcaatttattttttattttttaaatgtatttttttggctgggcgcagtgtctcatgcctgtaatcccagcactttgggaggccaaggcgggtgaatcacgaggtcaggagatgagacaaccctggccaacatggtgaaaccctgtctctactaaaaatacaaaaattagctgagcatggtggcgcgtgcctgtagtcccagctactcaggaggctgagacaggagaatcgcttgaaacaaggaggcggaggatgcagtgagccgagatcgtgccactgcactccagcctggcgacagagtgagactctgtctcaaaaaaaaagaaaaaaaagtttttgtttgtttgtttgtgtatttatttatttacttttttttgagatgaagtctcactctgtcacccaagttggagtgcagtggcgtgatttcgactcactgcaacttctgctttccaggttcaagtgattctcctgtctcatcctcccgagtagctgggactacaggtgcccaccactaagcctggctaatttttgtatttttgtagagacggggtttcgccatgttggccaggttgctttcaaactcctgacctcaagtgatccgcctgccttggcttcccaaagtgctgggattacaagtgtgagccactgtgcctggcaaattttttttttaattgaaaataattgtacctgttcatgggctacataatggatatttccatatgtatgatgtgattagattagggtaattagcatattcatcatctccaacatgtatttatttatattgggaaggttgaaatcctcctcagctatttgaaactacatattattaactatagtcattctgcagtggcatagaacactagaactttttcctcttatctagctgtaattttgtattctttaacaaatctttccctacccatcccttcccattatctctcccagcctctagtagcctctgttgtactttttactcctatgagatcaacttttttttagcttctatgtatgagtgagaacatgtggtgttaaacttcctgttcctagcttatttaacttaaaataatgtccttagttccatccatgttgctgagaatgacaggatttcattgtctttctttctctctctctcttctttctttctttcgttctttcgtctcaactctgtcaccgaggctggagtgcagtggcgcgatctcggctcactgcaacctccacctcccaggttcaagcaattctcctgcctcagcctcccgagtagctgggactacgggtgcacactgtcatacccagctaattctttttttttttcttgagacagaatcccactctgtcacccaggctggagtacagtgacacaatcatagctcactgcagcttcagcctcctagattcaagcgatcctcccccctcagcctcctaagtagctgggactacaggcacatgccaccacacctggctagttttttttattttttgacgaaacgaggtctcactctctttccctggctggtctcaaactcctggacctggactcaagtgatcttcctgcctcagccttccaaagtgctgggattacagttgtgagctagtacacctggctcattcttttttatggctaaatagtattccattttgtatatataccacattttctttatccattcatctgttgttgaacacctaggttgattccatatcttggctgttgttgagtagtactacagtaaacatggaagtgcagatatctcttcagtataatgatttcctttcctttggatatattcccagtaatggtattgctggatcatatggtagcgctatttgtagtttttctttcttttgaggaccctccatactgttccccatagtggctatactagtttacattcccaccgacagtgtatagtgttccctttactctgtaccctcaccagcactggctactttttgtctttttgataatagcctcctaactggggtgagatgatacctcattgtggttttgatttgcattcacctgatgatttgttatgttgagcatttaaaaaaatatatttggcttttttttttttttttttttttttttttttgagacagagtcttgctctgtcgccaggctggaatgcagtggcgtgagcagtcttggctcactgcaacctccgactccctggttcaggctgttctcctgccccagcctcccgagtagctgggattacaggcacgtgccaccatgaccagctaatttttgtatttttaatacagacagggtttcaccatgttggccaggatggtcttgatctcctgaccttgtgatccgcccacttcagcctcccaaagtactgggactacaggcataagccacagcccttggcctatttgggcatttttatgtcttcttttgagaaatgtctcttcagatcatttggtctttcccatttttatattatttatttttttatttttattattattattttttgagacagagtctcgctgtgttggccaggctggagtgcagtggcgcgatctcggctcactgcaagctccacctcccgggttcacgccattctcctgcctcagcctcccaagtagctaggactacaggcgcctgccaccgcacccagctaattttttttttttttttttgtatttttagtagagacggggtttcaccgtgttagccaggatggtctcgatctcctgacctcgtgatccacttgcctcggcatcccaaagtgctgggattacaggtgtgagccactgcgcccagcctcccatttttatattatttaactatttatttatttattttatttttttgaggcagagtctttctctgttgcccaggcggagtgcagtggcacgatttcagctcactgcaacctccacctctcgggttcaagcaattctctgcctcagcctcctgagtagctgggattacaggcgcctgccagcatgcccgactaatttttgtattttaggtagagacggggtttcaccatcttggccaggctggtcctgaactcctgacctcatgatccacctgcctcagccccccaaagtgctgggattacaggcgtgagccacctcacctggccatatttaattattcttttttaagacagagtctcgctatgttgcccaggctggtcttgaactcctgggctcatgcgatcctcccactttggcctcccaaagtgctaggattacaaacataagtcactgcacccagcccttcctaattctaattagaaggaccaaagatttttaataaattctctccaaccatttggcttggaactttccttctctgtctttccattttacctctctttttttttcctttttgccccttcatttaccctaattcactaattaacttttccccccacttttcttttgcataataatatattgctataaaagatactgtatgttctctttcctacattccttttccataaccatttgatttattttctctgaaacttggagttatggggttctcacccttatgatactggaagcagttttggggaacgtgatttggaaatatatcatcccccatctctacaaaaaaaatgtaacaattagtcaggtgtggtggtgcacacctgcagtcccagctgttcaggaggctgagatgggaggatcacttgagcccaggaggttgaggctgcagtgagccatgatcatgtcactgcactgcagcctggctaacagagcgagactgtgtttgaaaaacaaaaaagaaaggaaaagaaatatattatcacttagaggcaaaatcctaaggagattgcaggatgaataaaatttaacatagctacataacaacaataaaactggagtaaataataggttaatttaaaataaagtacttcatgagattttggagaaaaaggcttagtagtatttggttatcagaattataaagacatttctcatacctgtctgctgtttatctaacagtaaatgctttcttttaaaaaaggagaaacaggcatactttcctcatgtaatccagtgttcaggaggaggtggcaatataggggtctgtcataaactccttaaaagattctctgttatcaaatttggactaccaaccaaaacttattgatccctctctctgctccagtggattttctaaataggccattaataaggtttggatctaggtccccaaccagatcccatgttaaattgtaatccccagtgttggaagtgggacctggtgggaggtgattggggtggatttctcacgaatggtttaacaccatccacttagtactgtcctcaagatagtaagttctcatgagatctggtcatttaaaagtgtgtggaggctgggtgcagtggctcatgcctgtaatcccagcactttgggaggccgaggcaggtggatcatgaggtcgggagttcaagaccagcctggccaacatggtgaaaccctgtctttactaaaactacaaaaattagccgggcatggtggcgtgtgcctgtagtcccagctattcaggaggctgaggcaggagaatcccttgaaccctggaggcggaggttgtcgtgagccaggattgcgccactgtactccagcctgggcaacagagtgaggctccatctcaaaaaaaaagaaaagtgtgtggcacctgcccccttgctctcttgctcctgttctgggccatgtgacgtgtctactcccccttcatcttccaccatgattgtaagttcctgcagcttcccccgaagccaggcagatactagcatcattcttcctatacagactgcagaaacatgagccaattaagcctcttttctttataaattacccagtctcaggtatttctttttatttatttatttatttatttatttagatagagtctcactttgttgcccaggctggagtccagtggtgcgatctcagctcactgcaacctctacctcctgggttcaaagtaattctcctgccttggcctcctgagtagctgggactacaggcgcgtgccaccaagcctggctactttttgtatttttagtagagacggggtttcgccgtattggccaggctggtcttgaactcctgacctcaggtgatcctcctgccttggcctcccaaagtgctgggattacaggtgtgagccactgtacctggcctcaggtaattctttatagcaatgcaagaatggactaatagacctattatcacaacctacatatgtatttcctctttcttttttcttttttttttttttgagacagtctcactctgtcgcccaggctggagtgcagtggcacgatctcgacttactacaacctctgcctcctggattcaggtgattctcctgcctcagcctcccaagtagctggcattacaggtgcccaccaccatgcctggctatgtatttcgtctttctacttgcaagtaaactttggaaagtttgaagttttttttccatgagtgaatagcttatattctggcccttcactataaaaacatacccttaacctggaattttttgtcagaacagtgtgcacattaagttgccagtggtaaagcaacttcacttcttgatacaatcataggcagaaaactatttttccagaggtagaatctcagacataactgtacctgcaagttcagagagagaccttccacctgactatcttctcctgacggctttaccgagttctttctaattcccaagggtcagatctatgcaatatttccacaggaagttgtgggccttctctatacaaagcctgctttgttcattagtggcaggtttattttctgtaattttgccgaagttttctgaaacagttgtttaaagccaataataatcctcttttagaaggcaaaaatgaataagtacagtagtgtaaataccataaatgaatgttctacgtttacaatgttctgatactgtgaaaaggttgtttatagcaaatctgtttccagctaggtgggcttaaaaacagactaaaccattatattatgaagatatttggtacttcttcacagtgaagtatgtataccttgttgaataaaatcatacattaaaattttggacaaataggctgggcacggtggctcatgcctgtaatcctagcactttgggaggtcgaagcggatagatcactgttggccaggctggctggaactcctgacctcaggtgatcacaccattgcactccagcctgggtgacagagcaagactttgtttcaaaaaaaaagaaaagaaaagaaaggaaaggaaaggggaaaggaaaaaggaaaggaaaggaaaggaaaggaaaggaaacctgataaggtggccgggcgctgtgtcttatgcctgtaatcccagcactgtgggaggccgaggagggcggatcatgaggtcaggagatcgagaccatcctggctaacacagtgaaatcccatctctacttaaaaaaaaaaaaaaaaaaaaaaattagctgggcatggtggtgggcgcctgtagtcccagctacttgggaggctgaggcaggagaatggcgtgaacccgggaggtggagcttgcagtgagccgagatcgtgccactgcactccagcctgggcgacagagcgagactccatctcaaaaaaaaaaaaaaaaaaaaaaaacctgataaggtgtaaaacatacagagagttcatacagatccaataactttgttacttattaccaagtcaagtaaagcggggggcgggggtggggggacaaggcatggtagctcacacactttgagaggctgaggcaggaggattgcttgagaccaggagttcgagaccagcctgggcaacatagcgaaacctgatctctactaaaaaaattagccagataaggtggtctgcacctgtagttctatcttctcagaggctgaggcaggaagattgcttgagcccaggagtccaaggttgcagtgagttatgatcatgccattgtattccaagctgggtgaaagagtgagacactgtctcaaaacaaaacaacaacaacaacaacaactggctgtgccaggtgcagtggtgcacccctagagccccagtgacttgagaggctgaagcagcaggattgcttgagaccaggagtttgaggctgcactgtgccatgatcgcgcccattaatagccactgtactctagcctgggtaacataccccatatctaaaaaataaaaatatatatgtataataaaataaataattggttgtaaatctaattctaaaattaacattatctttgacctagggcatattgtttaatcctgttttatctcatatctccatcaagttatgcaggtataatatgtatctatagcaaatagttaatgaatactttatccgaagatgaaaggtgctaagtggtttttataaatatcatacatttatttaaaaatcacagccaatggcccagtgctgtggctcacacctgtaatcccagcactttgggaggccaaagtgggtggatcacctgaggtcaggagtttgagaccagcctggccaacatggtgaaaccctgtctctactaaaaatacaaaagttagccaggcgtggtggtgggcacctgtaatcccagctacttgggaggctgagacaggagaatcccttgaacccaggaggcaggggttgcagtgagctgagatcgtgccattgccctccagccagggtgacagagtgacactctgtataaaaaaaaaaaaaatcacccctgaaattcatatgaaacaactacacttgcacttaaaaacttcaattaaatatttactaggaaaaatatggtggttgaagaaactactagaactctgcataattaatgatgtaagaaacaagcctatgatatgtgaggtgctacaacttgaatgagggagtaagtagtttaaataccaggcctggtttcagggtactactcaaacaggaaactccaaactgtaatttggttagttatcttccactcccagcctccaccccctccaaaaaacaccaagactgtcaactctgtgacgtgctttcctaatggcctgtagctacatgactcaaagaaaaaggtgttttctttggaacacacaattgtaaaactatacccagcatcctacaccctgatttctggcaaacaaaggaaaactacctttttttttttttttcactcatagaaaacagaatggggccataggccatttaaaatgccataactagtttaaacagaaacaacagtctatccaaatgtgactgcatgcctatatgttctctgtcaaattggaaattagagggagcattttataaaatcagatgctgagaacaaagatttatgtgcagaattggcgtatgaacagtttcaggcccatctttcttagtcctttattagtataaaacaaatttgggtgtacttatataattttttaaaaaacagtgatgatttctggatacctgagtatattttttgtttttgttttttttggttgtttgtttgtttgttttgaggcaggttctccctctgtcacccaggttgtagtacagtggtatgatcacagctcactgcaacctcaaccacctgagcttaagcagttccctcgccttagcctaccgagtatctgggactgcaggtgcatgccaccacgcccagccaattgttgtgtgtgtgtgtgtggttttcgttttgttttgtttttgagagggagtcttgctctgtggcccatgctggagtgcagtggagttgtctcagctcactgcagcctctgcctcccgggttcaagagattctcatgcctcagcctccccagtagctggaactacaggcatgtaccaccacacccagcttttttttttttttttttttgtatttttagtagaaacagggtttcatgttggccatgctggtctccaactcctgacctcaagtgacccgcccacctcggcctcccaaaatgctaggattataggcacgagccaccgcacccagcctaatttttgtatttttgtaaagatgatgtctcagtatgttgcccaggctggtcttgaactcctgggtttaagcaatccacccacctggccttccaatgtgctgggattacaggcgtgagccactgcatccagcctactctttgttctgtaatgtattcatctgtcagtttctctttgtttctattacagtttctaagcattgcaattgaatcctcctgtcaaacagaaattcatactaagaagcttgaagcttgaactattgtagcaggattttttttttttttaattttagatacagggtattgctgtgttgcccaggctggagtgcagtggctattcacaggtgcaatgatacatatcacaatacagcctcaactcctagactcaagcaatcttcctgcctcagcctcctgagtaactaggacaacaggtgcgcatcactgtgccctgcccagtgttattgtagcagttttagagataaatggcttaattagatctaatcagccactgctatgaagcacttatgcattaatttttttctttgagacagggtctcacttgttgcccaggctggagtgcagtggcacaatcacagctcactacagcctcaacctcctcagatcaaaggatcctcctgccccagcctcccaagtagctaagactataggcaagcaccacacttggctaattttttttttttgtagaggcagggtctccctatgttgctcaagctgatcttaaactcctgggctcaagtgatccccactacctcgacctcccagagtgctaggattaaaagcatgagccaccatgcctggcaaatttatgcattcttcaaaactctttattatacagctaaaacacttttacctggcatatttagatcttcattaaatttggtttctagctcctttagcacaatattttacttgtggcaaactaggagaatatacttaaaagaactcttagaatccagattacagttgacctttaaacaacacaggtttcaactgtgtgggttcttatgtgtggatgtttttcaataaatgtattgacagattgtttggagatttacaacaatttgaaaaaaaaaactcacaggcagaccagatgtggtggcttttgcctgtaatcccagcactttgggaatctgaggcaagaggattacttgaggccaggagttcaaggtcgacctgggcgacatagtgagaccccatctctacaaaaaattaaaaaattagccaggtgtggtggcacatgcctgttgtcccagctactcagacagctgaggtgggaggatcacttgatcccaccaggagttggaggctgcagtgagctctcatctcaccactgcactctagcctgggcaagagtgagatgctgtctcaaaaattttaaaaagaggctgggcacaatggctcatgcctgtaatcccagcactctgggaggccaaggtgggtagatcactttagatctggagttcaagaccagcctggccaacatgttgaaacctcatctctactaagattagctgggcgtggtggtacacgcctatagtcccagctactcaggaggctaaggcagaagaatcacttgaacctgggaggcggaggttgcagtgagccaagatcacaccactgcactccagcctgggagacagagtgagactccatctcaaaaaataaaaaatacaaacaaataataaaaataaaaataagtccgggcacagtggctcacgcctgtaatcccagcactttgggaggccaaggtgggtggatcacttgaggtcaggagctcgagaccagcctagccaacatggcgaaaccctatctctactaaaaatacaaaagttagccgggtgtggttttgcgtacctgtaatcccggctacttgggaggctgaggcaggagaatcgcttgaacccaggaggcagaggttgtggtgagccgagatcacgccattgcactccagcctgggcaacaagaatgaaactttgtctcaaaaaaataaataaataaaaataaaaatgaattaaattaactagcatatactgtactgctgtaatttcatagccacctcctattactattgaagtgagctcaagtattgccagtatccacttaaaatgctgtatgatgctaattttctagtgagcagttcttcatagcttagtgcaatatcataaatcttgaataacaccacgggacctacaacacgtgccactaatgatactggaattgctcttaagaagcagagaagagtcatgacattataagaaaaagttgaaaacgaaaaaaagagaaaacacaaggaaaagttgaatcgcctgatgtgatgcataccatagattgaggtctgtagctgcagttgcctgccatttttataagtatatatacataggtggtggctgggctggggaaatggcggcttcacgagagagtgggacttgggcagcagaggcagcacagtggatgcatttctgaccttctacagtgaggtgaaacaaatagagaagagagactcggttctaacatccaaaaatcagattgaaagatggacccgtcctggttcctcttacttcaatttgaacccatttgaggttcttcagttagatcctgaagttacagatgaagaaattaaaaaaagaggtttcagcagttatccacattggtgcgtcctgacaaaaatcatgatgctgacagagcacaaaaggcttttgaagctgtggacaaagcataaaagttgctactggatcaggaccaaaagaagaggaccctggatgtaattcaggcaggaaaagaatacatggaacacggccaggcacggtggcacacgcccgtaatcttagcactttggaaggccaaggtgggaggatcccttgagctcaggggtttgagaccagcctgggcaagatagcaagaccttgtctctattaaaaaaaaattttttttttaattagccaggtgtagtggcacacgcttttaatcccagctgctctggagactgaggccagaggattgattgaacccagaaagataaaaaagtccattcaaaaggaagatataataactctaaatttgtatatacctcataacagcttcaaagtatataaagcaaaaattaatagaactaagagagaaatcactttgtcttttttttttttttttttttttttgagacggagtctcgctctgtcgcccaggctggagtacagtggcgtgatctcggctctctgcaagctccacctcccgggttcacgccattctcctgcctcagcctccctagtagctgggactataggcacccgccactgcgcccggctaattttttgtatttttagtagagatggggtttcaccatggtctcgatctcctgacctcgtgatccgcccacctcggcctcccaaagtgctgggattacaggtgtgagccgccgcgcccggccatcactttcataattagagatgttaacatacctctctcagttactgatagagcaaacagacaacaaatcagaagggatcttaatgatttgtatatgattaaccaccttgacctaattggcatatttagaacaccatacccaacaattgcacaatacactttccaataacacataattggagataatgtattataaatttgggaagaaacaactgtaagcttctgttgtttatttgcaacttggaccatatttgagatatataggaaaagcattaaatataaatggcctaaacactccaattatcctaccacgttgggagactgaggtggaaggaccacttgaacccagcagtttgagaccagctcagctcactgtaacctccacctcccgcattcaagccattctcctgcctcagcctcccaagtagctgggattataggtgcctgccaccatactcagctaatttttttttgttgttgtatttttaatagagacagggtttcctcatgttggccaggctggtctcaacctcctgccctcaagtgatccacctgtctcggcctcccaaagtgttgggattacaggcatgagccaccgcatctggcctcatttttctttttctttttctttctttcttttttttttttttttttttgagacagagttttgctttcacccaggctggagtgcagtgatgtgatcttggctcactgcaacctccgcctcccaagttcaagattctcctgcctcagcctcccgagtagctgggattataggcgtgtaccaccacacccagctaatttttgtatttttagtagagacgaggtttcaccatgttggctaggctggtctcaaactcctgatctcaggtggtctgcctgcctcggcttcccaaagtgctgggattacaggcatgagtcaccatgcctggcccctaattcatttttcttcaacaaagaagcagcctatagccagaaaatgtctgcctctgtctcttttaacctccatgaggtttccagataataatctggtattgggtttaacacacctgactgaccttaggaccctaggctgacctggagagattttttaaaacagattctgaaagtcctacctcctggagattctgtattttgaaaaggcaattgggctgattccaagtatttggacagatttcggagtcttggaaataatgtactgtttgtcctggagagtaggaaaaagaggggaaggaaggagggagaatatgaggatatgaatatgtatgtgtgaatttgagataactgagtcagggccaggtgtggctctaccccaacacaggaggtaagaggaaagaaggacatctgcctctaaaagttttgtaaaagtgaaaatcaagcacatttgcatgagaagcaaagaaaatgttgctctgttttttgtattcagtggctttattttttttatacatattttgcttatgtatcaactattttttttttgagacaaggtccctgtattaagccattcttgcattgctataaagagatccctgggactggataatttataaagaaaagagctttatttgactcgtggttctgtaggctgtacaggaaacataatgcttgcaactgccctgcttctggggaggtctcaggaaacttacaatcatgaatcatgacagaaaaccaaccaggaataagcatgtcacgtgaccagagcaggaacaagagagcaaagagggagatgccacatacttttaaacgaccagatctcacgagaactcactcactattgctaaggcagcaccatatggatggtgctaaactattcatgagaaatccacccccatgatccagtcacctccaaccaggccccacttccagtactgaagattacaattcaacctgagatttgagcgggacacatatctaaactatatcagtatggctctgtcgcccaggctggagtgcagtggcacgatcacagctcattgcagcctggacctgctgagctcaagcgatcttcccacctcagcctcgcaagtagctgggactaggcacatggcaccctgcccaactaatttttttttttttttaagagacagggtttcttcatgttccccaggctggtctttctttacctaaaaaagaagagaagccagatgctgtagccagtgtctgtaatctgagacattctcataatttcaactatttgcctgtaatctcagctactcaggaggctgaggcagaggattgcttgagtcctggagttgaaggctcagtgagctgtgattgtgccactgcactccatgctgggcaacagaacgaaaccctgtctctaaaataactagataaatagatagagagacagatagatagatagatagatagatagatagataatcagattctagtgtatttcatgtaaagtgttaaagtaattgagacccagaatgtccttgtataagtcatgcaactaggaagagtcactgtcctcttgtcatttccatcttttgcactttagtaatgaggatgctattttgcctaagtcttctgggcatagcaaactaatgcatcagtagtcaccattgcatttactgtgataattacgattgtataaatctaacctttattgaaaaacttccctaaacctccatcaatcaagtgaaaaaaagattgaatttggcagttgtttcttttaaaaatttaatgctgttggttgtatattttctcttttgaaaatacctagttttaaaagagagagaggccaggtgtggtggtacacacctttaatcccagtgcttttgggaggccaagcagggaggatctcttgagaccaggcatttgagaccaccctgagcaatttggtgagaccctatctctacaaaacaaaattgtttttgtaattagccaggagtgatggtacatgcttatagtcctggctactcaggaggctgaggcaggaggatcatttgagatcgggaatttgaggctgcagtgagctgtgattacactactgcacttcatcctgggcaacagagtgagaccctgtttctaaaataataataataataataataaatttttttaaaaaagatgttttagtgactattatgacctttttaccctcctccaaaagtgttacttgcttcagatgtgaaattgtttacagtcaacatgttagcttatcatatgctgttccttgatgtatttctacaaagtagaggttccactttaatttcaggatggtttttccacatgactctttttttcttcctctctagacttctccagagaaccttggaacagtaggtggagtgcaaagctgcattgtgtaccttcctgcttttttttggttgccttcctgctggtttttttttttttcctttctttaaattcttggccccgccttggctctcctttctctgccattaaaactaactaactaaaccctgcatgcatggtcattatgaggggttcatggccttttatttcagttctgcacatgtatcatgtcagttatgttttatgtcaaatccttaatattatggtgtgtgtgtttgtgtgtgtgtgtgtgtgtgtgtgtgtgtgtgtgtgtgtgtgtgtgtgtttgagacaggctctcactctgttgcccaggctggagtgcagtatcttaatcacagccaactgcagcattgacctcccaggctcaagccatcttcccaactcagcctcctgagtagttgggactacaggtgcacaccaccatgcccagctaatttttgtttttgtattatttgtagagacagggtttcaccttactgccctggttgatctcaagctcctgagcttaagcgatctgcctgcctcagcctcccacagtgctgggattacagaaatgagccactgtgctcagcctatgattgtctctaaggcactactatggtaaacaaattggaatctcacctctactttctgaaaacatttccctccaatttaatgtacccgctttctaatgcttctgccccgcaaccctgagcactttccaatacctagggtccttttgtgaagggagaaaataatttgatgagcagatataagtaaggtactaacaatgtgttacctctccctgaactatttatatcctgaaaagggcagggaaagggcaatgtttaatagagaaaatgattcactcactaatgaggcaggaattccctgcctcagtaaggcaagatctcatgcatttgttaagatatccacattttgtatacatgcgcctttaaaagattttgagccggctctgatcatttcaccagattttgtcctaaaatgatgtcagcttggtttggttcctttttctccttagtagtttatctgttaatggattttgatgtttggtgtccatgtgatgtccaggagtctccctgtctgcatgattgtttatcgttgctccgatcctttccaactaccacaggaagagaggggaagggacattttagagattatgctgaaataatacatttgcttccttccctctcttcttttcatgtaacagaggaagcagaccagcccactacagagccaggcatggtcctggacagtgtggaagcaggagacacaacacctcctaccaaaaggaagagcaagttctcaggctttggcaagatcttcaagccctggaaatggaggaaaaaaaaaagtagtgataaatttaaagagacttcagaaggtgagatattaagggttaaatgtgtgttctgagttagaattctctatgttagatgtatttaatttttccttatcttcccaagtttctgtagtcctctatttgaagagggtatttaatgttttattctttccttcttctttttttttttttttttttttggtgagacaggatctccctctgttgcccaggctagagtacagtggcgcaatcacagttcactgcagattcaacctcctgggctcatgtaatcctcctgcctcagcctcccaagtagctggaagtacaagcatgagctactgtgcccagttaatttttaaattctttgtagagatggggtctccttatgtttcccaggctggtcttgaactcctgggctcaagcgatcctcccacctcagcctcccaaagtgctgggattacaagcatgagccactgtggctggccagagtttaatcttttagaattaaacatcaaaatggtcatgtactaaacctaatattgtataccctcattcccaggtttgtattttgatggcatataagtatctattgagtggtgaatggagttcctgaactgtcgcaaatctaagatgcttctttccatcagaacttggtgaagaaaatgactgaatgagttgatacatacataaataaaatgcttattttctactctgcccatccacacaaagttcatccgtaaataacttactaatgaaattttctcttaagttacaattatgtaaggctagttttttggaagtgatgctttcctgacagcacaggttataaaagaaatttaagagttttaatttgaagttagtctgctagttattttctttcctgagaatataaacttaaactactttattcttttacctgtagaattagaatgctaagtgtaaggttgactttcaactgtcacatttctgagtgccattttccaatttaatgttagttttagaacggaaaatatctatgcgaaagccaagagaagagctggttaaaagaggggttctgttggaagaccctgagcaaggtgagtttacaaataaatagcatatgcctgtctctgtgcacttggtctttgattgggtctgacgagatatttgaattttctttctttcttttatattgctatttttgggttggagggtggcctttaaaaaaaaaagttcacccttccttccttggggcaaacattcctttcctctgtgtacatcctcaactttgtgccagctacaatattgcgtgtcttttttttcccccccttgagacagagtcttgctctgttgcccaggctggagtgcagtggcacaatcttggctcactgcaacctctgcctcctgggttcaagcaattctcgtgcctcagcctcccaagtagctgggattacaggcacctgtcaccacccccagctaacttttgactttttagtagagatggggtttcaccatgttggtcaggctggtcttgaacttctaacctcaggtgatccgcccgccttggcctcccaaagttctgggactacaggtgtgagccactgtgcctggctaattttttcatttttagtagagatgaggtttcaccaagttggccaggctggtctcgaactcctgacctcaggtgttctgcccacctcggcctcccaaagtgctgggattacaggcttgagccaccgcgcccagctcattttcttttttgaacacatttgtccccatgcccatatcactgcaccagtctaccagtcattgtttgtttaataatgtcaagactttcttcaatgtgtgactctatgaagcaagttattgcaaatgtgaaagtatagtacattggttgcatctcatttctcttcatctgagttatgttgcatgaggcaaaatctgaaagccatattgtatactggccaggcatggtggctcacgcctgtaatcccagtattttaggaggccgagacgggcagaacacttaaggtcaggagtttgagaccagcctggccaaaatggtgaaaccccatctctactaaaaatacaaaaaattaggagggcatagtagcaggcacctgtagtaccagctacttgggaggctgaggcaggagaatcacttgaactcaggaggcagaggttgcagtgagctgagatggcgccactgcactccagcctgggcaacagagcaagactccttctcaaaaaaatttaaaaaatcatatcctttgaagaataggggaaaggaaccaaatagatggagtattactgtatactttttgggctttaaaccatgcgaatatattgcctattcaaaaaattaaattgtatgtattgaagatttattatctcaactgtataaaaactaaccagagacaacaagcttgaaggagcaatttgaaatattattacaattggttacctctgaagttgaggtgggaacatgggtgggctttttttttgttttttaattgagacagggtctccctatgttgcccaggctagtctcaaactcatgggcagcacaagcagtcttcctgcctcagcctcccaaagtgctgggattacaggcgtgagctgctgtgcccaggtgctatgcgatgttttctttctttctttttttttttttgtatgtgactagttatgagcatatataacttttgttttatataactctatttgtttttttacattaggacacaaaatcttctcagtatttaggtagttacgtactactttaatggtttcactgtagcacctctttggcccttgctttgctttcttttttgagacagagtctcactctctctcccaggctggagtgcagtggtgtgatcttggctcactgcaacctccatctgctgggttcaagcaattttccagcctcagcctcccgaggagctgtgattacaggcatccgccaccacacctggctaatttttgtatttttagtagagttggggttttcaccatgttggccagactggtctcgaactcctgacctcaagtgatccagccacctcagcctcccaaagtgctgggattacaggcgtgagccaccatgcctggcctggcccttgcttttttgatacagctgttccactttccatggcctttcttttcacctttcttgctcacttatcataaaccacatacattactcatttcttgtttttcaccttcagtctcttttgccctacactcacggcaacctctgcctcctgggttcaagcaattctccttcctcagcctcccgagtagctggaattataggcatgcatcaccacacccagctaatttttgtatttttaatagacagggtttcaccgttttggccaggctggtctcaaactcctgagctcaagtgatccacctgcctcggccttccaaagttctgggattataggcatgagccaccacgcctgatgatcttttgccctatactttctattagcccctaatccaagttgtttttagcctacaagttcacaggcccaattaataaacgagttgcagccattggacaagatgccattctgccaaccagataaatgacctaagctttattctgtatctaaaaacagggatgggcctcatgctggcttatagatctgcattttaggccaaaagtagtgtttgaaccttgaagtcctctgcatacttaaagggaacttttggctggcctggcgcggtggctcatgctgtaatcccagcactttgggaggccagtgtgggaggatcccttgaactcagtagttccagaccagcctgagcaacatagtgagacctcatctctataaaagattttttaaattagccaggtatggtagtgcaggcctgtagtcctagctacttgagcccaaaagatggaggatggcttgagcccagaagattgaaggctgcagtaagtattaattgcaccactgcactccagcctgggcgacagagtgagaccctgtttttttttttaaaaaaaggtggcttttggcttgattatagtgctaacttgactgtactgtaaaatatttaattgattttaattgattttctgggtttagggagaacattcagtgatgttaaagccccatagtactactccacttcattaacattgcagaaccctctatatttaatataagaaatgatactgcaaagtagacatccctgattaagtaacttgagataactgatcacttttgcatgtatttcactagtgtgtgctgagtagaaactaattaacactgtcttaaactttattatgttgttttcacaaagagcagcctttgttgactttgaaatcattgcttcagtattctagaaaatcttgtttttgttaaacatgggcagtaacttactatttttgtatagttgttgtcatcttacccccaccctgttttaaaaataaaaagtagttgtcagattactttggctttagaagtaccttttcacttgccttagaatcttcattactttgagcctacactccacctcttattggaacttcatgaagaatgatgttggatttcactctgtcacccaggctagagcacagtggtctgatcatggcttactgtacccttgacctcctgggttcaaacagtcctcccacctcagcctcccaggtagctgggactaggcatgtgccaccacacccagctagtttttttacttttttgtagagacagggtcttactatgtttcgcaggctgatctcaaactcttgggctcaacgatcctcccgcctcagcctcccaaattgttgggattacaggcatgagcaccactgtgcccagcccataaccatttcttttttttttttttttttgagatggagtctgttgcctcagcctcccgagtagctgggattacaggcacctgccaccacacccgaataatttttgtattgttagtaaagacggggtttcaccatgttggccaggctggtctcaaactcctgacctcagatgatccacccgcctcggcctcccagagtgttgggattacaggcgtgagccactacacccggccccccataaccatttcttatgtgaatctattctcctgccagaccaaactagttgccagtgccccaaacacgttgaataacttcacacctttatacatgctgtccttcttccaaacagactgtctttattcagtgtggtaggctcctactccttcaagatccagttcaaagcaaggcatggtggtgtgtgctatagtcccatctactagggagtctgagagaggaggactgtttgagcccaggagttcaaggcccattctggtaacatagcaagaccatctcaactccagctcagatactttctgtgatgccttcctaactctattctcactccaggaaaatgatttcttcttcattcctaccacagtacttcactaattagagctcttgacatttaacattgtagttacttatatataagtttgccctattcgtttgtctttttttttctttctttgagttggaagttttgctctgctgcccaggctggagtgcaatgacacaatcttggcttactgcaacctctgcctcctgggttcagttgattctcctgcctcagcctcctgaatagctgggattacaggcgcttgctaccatgcctggataatttttgtatttttagtagagacaaggttttaccatgttagacaggctggtctcgaactcttgacctcaggtgatccacctgcctcagcctcccaaagtgctgagattacaggtgtgagacactgcgcccggcttttatttgtcttattcatataacaacgtacttggcacatagtaggctatcaaacatgtattggaaaaagaaatcacttgtttctgtttaagcatccagataatctagatctcaataataaactaaaacaggaagacgagggaaagaagataagaaaggttagaaatcaccaaccctgggccgggcacggtggctcacgcctgtaatcccagcactttgggggctgaggcgggcagatcacgaggtcaggagatcgagaccatcctggctaacacggtgaaaccccgtctccactaaaaaatacaaaaaattagtcgggcgtggtggcaggcgtctagtcccagatactcaggaggctgaggcaggagaatggcgtgaacccgggaggcagaggctgcagcgagccaagatcatgccactgcactccagcctggtctgtgagaccctgtctcaaatcaccaactctggccaggcgcagtgattcatgccatttatcctagcacttcgggagaccaaggcgggctgattgcttgagcccaggagttcaagaccagcctgggcaacatagtgagaccctgtctcaatttaaaaaagagagagaaagaaaaaaagaaattactaactcttctttctatctgttcatgccaacttcatcactttgtactcttctttcaccttgcaggtggtgaggatccaggaaagccaagcgatgccatgttaaagaatggccataccacccccatagggaatgccagatcatctagtccagtccaagtagaggaagagccagtaagattagcaagtcttaggaaagctattccagaagaggacctaaagaaacgactaggtaagaaactctggatttttgagtttaagagccacgggccagttattctccttacataaggggtttgcaagagaacagggaaaagtgaaatctagagagaattacattctcctttaacaataccttaactagcaacttcaaggggaatttcctcccccaccccgcttttattcactaaatacctaaatttgtgatcctcaagaagggaagaggatgttaagtatcagatacctataggattttttccagctacacattccacttctttcacccaaggaattttgttgtggctctcctccagtagcctggcccttgtgtgaagaatcactaccacaatgagcatctcttagtgagcctttcttactgacatttcttaagtatggggaggttgggaggcattgagaatggtaacctataagctaatctataaattaattggtgaaattggccacaaattcatagatgtgttagctttttcagtttctcttgttactctctcttccctttttataccatacatgttattacacaggctcaactggaagccagcctaattctgaagcagagtctgttcctgagaatgtacccaaaccacctttacttcctcccaaaagacccttgtcctcttctcatgaagcaagtgaagggcaagcaaaggatgccacttcctctggcggcacggcaaggttcatcatctccacctccatcaccacagcacccgctgccaccactgctgccacaagccttgcaaagactgttaatctctctgtcaccccttccccagcacccaggactctgcctgctgctcctgccagcactaacactactgctaccccaagcctcactcatatggtccctgccaagcagccccctatccctccccctaaaccagctcacagaaatagcaaccctgtcattggtaagtaagtctttaggcttccagtgttttgggtttggtttgatgttggatggttattttatttgataactggtacaacattgatttggtctgtgagaattttccatatcttgtccctttgaatgacctcaatatggagaaaagtcttaggttaagaaaaaataggccaggtgcggtggctcacgcctgtaatcccagcactttgggaggccgaggtgggtggatcacaaggtcaggagattgagaccatcctggcaacatggtgaaaccccatctctactaaaaatacaaaaaattagccaggcgtggtggcacgtgcctgtagtcccagctacttgggaggctgaggcaagagaattgcttgaacccaggaggcggaggttgcagtgagccaagattgtgccaatgcaccccagcctaggcgacagagagagactccgtctcaaaaaaacaaaaacaaacaaacaaaaaaagtcatgaaactgaggcagatggccataaatgtaaacatcactaagattagatttaagttttgggggttttaacctattttttaatctaatatttaatctgtttttctaaaacaatgattccaaaacactatacatatttgtgtgtgtgtgtgtgtgtgtgtgtgtgtgtgtgtgtgtaattggactggatatgtgaaaaccataacagattccacctgcatggaattatctgtggcacttgctgaaaaattagaataatgcctcagctcacaaggggcaaggcaaacttttcaaatgaaaatttttaaatctacttaaaactacctatgccttccataagcattaatgagtctagtagataaaaggatgattctgtagatgccagtggaatttgggattcagtgtctggcatagttatcttcacagggaactgcagaagctattacttaaattgttctgataaaatcatgttttatcttgggagaattaagaatgctattcttatgttaaaataagtgatggtagagaaagcagggaatataatcagtaaaatttgtatgggtttagtaaattttttgcatttacccaaagttctatttaagtctactttctttatataaatgcacaatttcttagaagaattttcaagaaagggagaggaaagctaatgagtgcttcaaagctaataaaaatatagttttttcaggaaaaatgatactaggcttagtattgcttaaagttcttgttcacgattgaacgaatgaataaaaactatactcattaaatatttaatatcaccatgttgggtggagtgattcaaaccttgaaaaacaggcttagaatattttatgagtatgacagtttggagtagcttgatgaaaacaggatgaagttgttattaccaccactttggatggatagtgtcatgttgacttatctgtgaggaacttggggagctttcacatacttattttcaaaactaccttgtgctgcaggaaaccaattttatcttttccataggtagggcaattagaacatgaagacattgtgactcattcaaggttgtaggccaggcgcagtggctcatgcctgtaatcccagcactttgggaggcagaggcgggtggatcacctgaggtcaggagttcaagaccagcctggccaacatggtgaaacgccatctctactaaaaatacaaaaaattagccgggcatggtggtaggcacctgtaatcccagctactcgggaggctgaagcaggagaattgcttgcacgtgggaagcagacgttgcagtgagctgagattgtgccactgcattgcagcctgagcaacaagagcaaaactccatctcaaaaaaaaagaagaaggttgtagttagtgaaagatagaaactgaacataggcttttcaactctcaggtccagacctctgttccttacagtagtgtttgcaaactggtgttctcctcaggatcacctagaaagcttatgataacagactgctggacactacccgtagagtttctgattttagtaagcctgggatgggcttgagaatttgcctttctaataggttcccagatgacactgatgctgctctccagggagcacacattaagagcctctgctctacaccagtggcataccacccttttcaagttaaggcaacatataaaatgataatttgtgtatgataccctggactaaactgcagagctcattcttagcttgaggtaaatagcccaaaacaatagaccttgtaactgaggaatcagtattagtccatgaggggtcctcaacaaaagaagaaaaatagaacagttcacagagcatttcttagagctaaatagatttaatttaaaggactctcttttattctaaaattacaaccttcctaatcctttggtgttaaaatgccatttctttcacaaaaggattatgatcataaatggtttacttaatatcaagccttatttggaaatcttagaaaatgacaacctcaaaaaaacactagaaaaaaaaccaacaatctgaggttgatcaagatttttgttattgttttggtcactgaaatccaaaagtttggaaatcattgcttcagaagtactactgtcttctcatccatataacatggagtattacgactaaggaaaaaccaccagcaatagctgaacgggtgaaagggaattattacccatcccagaaacactctgaaatttttccacagaactacagccagatgctgttgtcagggtatatataccagaatttacttccttaacatatatgccttcctcaaattaccaaatagaatttattttattaattcaaaagtaaaaatattcatttatggtctcatcaggaatgagttttgttgtagatggaatagctaacagctatttttagagaatcagcaaaaatccaatctttccaaaaatatctctttcactgctcctaaaattcacatttttagaatctttttgtgtgtgtatgcagtgtttttctagaaagccttttttaaaatttatttatggggccaggcatggtggctcatgcctgtaatcccagcacttcgggaggccgaggtgggcagatcgcttgaggcccagagtttgagaccagcctgggcaacatggtgaaaccccatctctactaaaaatacaaaaaatgatctgggtatgatggtgcatgcctataatcccagctactcaggaggctgaggcaggagagaatcacttgaacccgggaagtggcggttgcagtgagccaaaattgcaccactgtactccaacctaggcaacagagcgagactctgtctcaaaaaaaaaaaaattatttatgatgagagacattaaaacattacaaaattaggccaggcacagtggctcaatgcctataatcccagcatttggggaggccgaggtgggaagatcacttgaggccaggagttcaagaccagcctgagcaacgtagcaagaccccatctctataaaatatttaaaaattagctgggcatggtgacatgtgcctgtaattctagctacttgggagattgaggtaagaggattgggtaagcacaggagttcaaggctgcagtgagttatgattgcaccactgcactctagcctgggtaacagagcaacatcctgtctctaaaaaaaaagaaaaggctaggtacagtggctcacacctgtagtaccaacactttgggaggctgaggcaggtagattacctgagcccaggagtttgagaccagcctaggcaacatggagaaacccatctctacaaaaaataccccccccaaaaattagccgggcatggtggcacatgcctatggtcccagctacttgggaggctgaggtgggaggatcacctgagcccagggaggtcaaaattgcagtgagccgtgactgcgccactgcactccagtgacacagtgtgagaccctgtctaaaataaattaatttaatttaaaaataaaaataaatttaaaaagaaaagaggctgggtgtggtggctcacatccataatcccagcactttgggaggctgagataggtgtatcactggagcccaggacctcaagaccagcctgggcagcatagtgagaccttgtctctactaaaaattaaaaaaattagtcaggcatgggggcatgggcctgtagtcctagctacttgggaggctgtagcaagaggatcacttgaacccaggagatcgaggctgcagtgagctattgttcatgccactgcactccagtctgggcaacagagggagaccttgtctcaaaagaaaaaaaaaaaaagaattataaaattagctagccttggccgggcaaagcggacatgcctgtaatcccagcactttgggaggccgaggcgggtggatcacctgaggtcgggagttcaagaccagcctgaccaacatggagaaaccccatctctactaaaaatacaaaaaattagccgggcgtggtggcacatgcctgtaatcccagctactcaggaggctgaggtaggagaatcacttgaacccaggaggtggaggttgcagttagccgagatggcgccattgcactccagcctgggcaacgagtgaaactccatctcaaaaaagaaaaaaataattagctagccttttactttgaacatctccaattttggagatttaggacaaatacagttttatttaagggaagtttttgagagtgtttgagaatactgagtgggatgaaactaaagggtttgagtagaaggttagaggttggtgatcaaaagaactactttttttttttttttcctgtcagcagggaaaaaataactaccctttaattactttaccagttttactcctgtgtgatctgatgatccacttcttacaggtcatctggagccctccaaagggactttgctgaaacaacaccaacacctttgctgagtcattgtgggctttggtgaaactataggaatatatactgtcatgatacagggtgaaggcttctcatctaataaacatatattgagggtccactagatgccaggtactgtgcacagccctgtggatgatatgttgatggagacaaggttgccctgccatcaaggagcccatgatatagtggagagtgaacatgggaagctgaggtgcaaagggaacataagaggtgtgcataccaataaaaattagagacagtaggccgggcgcggtggctcacgactgtaatcccagcactttgggaggccgaggcgggcggatcacgaggtcaggagattgagaccatcctggctaacatgatgaaaccccgtctttactaaaaatacacaaaaaattagccgggagtggtggtgggcgcctgtagtcccagctacttgggaggctgaggcaggcgaatggtgtgaacccgggaggcagagcttgcagtgagccgagatggcaccactgcactccagcctgggcgacaagactccgtctcaaaaaaaaaaaaaaattagagacagtaggatgcagtcaaatagtcagagacttggataccagctgagtccatgccagtttgtagtatgatcttgggcaaagtcacctagcttctgtggccttgccttttccttctgaaaaatggtaaagatgctatattttttcccctgtcacctcaggtggtataaggagaatatgacttcaaggacaaaaaacactttgatttcttcaaaggactttgcaattgctataaaaattcaagatgtcagtattgacagttttataacacagagctaagatatctagataccattatcaggatatggtaacaatacccactaatacttattttatgctatctgaatgtttaaattttttaatggagtactgttatacaaaataacttttttttttttgagtcagagtcttgtgctgtccagcctggagtgcagtggcatgaccttgactcactgcagcctccgcctcccaggttcaagagattctcgtgcctcagcctctcctgagtagctgggattataggtgcccaccaccacacctagctaatttttgtaattttttttttttttttttagtagagacggggtttcaccatgttggccaggctggtctcgaactcctgacctcaagtaatctgcccacctcggcctcccaaagtattgggattacaggtgtgagccaccgtgccagccacaagataactttttatcagattttttttgtctctattcatattaactacaccaagatcaagttacaaaaagttgtcagccgggtgccatggctcacgcctgtaatcccaacactttgagaggccaaggcaggtggatcatttgaggtcaggagttcgagaccagcctggccaacatggtgaaagcccgcctctactaaaaatacaaaaattagccgggccgtagtggcgtgcgcctgtaatctcagctacttggtagactgaggcaggagtatcgcttgagcccgggaggcagaggttgcggtaagccaagatcgcgccactgcactccagtctgggcgagagagtgagaccctgtctcaaaaaaaaaaaaaaaaaaaaaattgtcatatctgttgccatagcaatgaagtaagctactcatcagtcttcctacacctctgtacatttattaagccttctatttgaataaatataaacttcatttcaggataaaatatatagggaatggcaaaactatgaaattatttaacttgcttaaaagattaaaactgaactcaactttaattctaggccctgggccggcccttcaaagcattggaaagtcgtgaaattgatgtgttgctctctcttttccagctgaactgtcccaagcaataaacagtggtacattgttatcaaaaccgtccccacccttaccacctaagagaggcattccatcaacctcagtacccaccttggagtctgctgctgccatcaccacaaaaacaccaagtgatgaaagagagaagagcacgtgttctatgggctcggaactactaccaatgatctcacctcgctctccgtcccccccactgcctactcatatacctccagagcctccacgcacccctccattccctgctaagacttttcaagttgtgccagaaattgagtttccaccatccttagatctacaccaggagattccccagcaggaagatcagaaaaaggaagtccccaagaggatactggaccagaactttggggagccccatataccctctaggctgcctccactcccactgcatattcgaatccagcaggccctcaccagcccacttcccatgactcctattctggagggttctcacagagctcattcgttgctttttgaaaacagtgacagcttttctgaggacagcagtacgctgggtcggaccaggtctcttcccatcactattgaaatgctaaaagtgtaagtgcctttaaagcttgcctcttatttctcctttactctagatagccctgcttggaaaaaattacttataaaaagaaaatgtgggccgggcctagtggcccacacctgtaagcccagcactttgggaagctgaggcaaatggaccgatcacctgaggtcaggagttcaagaccagcctggccaatacagtaaaaccctgtctcgatgaaaataacaaaaattggccaggcgtggtggcacatacctgtaatcccagctactcgggaggctgaggcaggagaatcgctttaacagggaggtggaggttgcagtgagccaagactgtgccactgtactccagcctgggcgacaaagcgagtctctgtctcacagaaaaaaagaaaatgtgaataatttttttttttccgagatggagtcctgctctgtcacccgggctggagtgcagtggcacgatctccgctcactgtaacctctgccgcccaggttcaagcgattctcctgcctcagcctcccgagtagctgagactacaggcatgtgccaccacattcggctgatttttgtatttttagtggagatggggtttcaacatgttggccaggctggtctcgaactcctgacctcaggtgatccacctgcatcggtctcacaaagtgctgggattgcaagtgtgagccaccgcgcccagcattgtgaataaatttaaagtacaaagaatactctgccaaaagaataagttatagaatttggactctttctttttttaatcttaccttaaaactttatttttatttatttatttatttatttatgtttgagacaggttctcactctctcactcaagctggagtcagtggtgcagtcttggctcactgcaacctccatctcctgggctcaagcaattctccctcctcagcctcccgagtaactgtgactacaggcgcatgccatcacacccagctaatttttatattttttgttagagatgggattttgccatgttgcccaggctcaccctgaactcctgggctcaagcagtctgcctgcctcaacctcccagaatgctgggatcatgggtgtgagccactgcgcctggccaaattttgattttttactcttgtgattttttttttttcatggagatttttgtgatgacacaaaatttacaaaattatgtacatgaaaaattacaaccgctagttttatatactacagggaaggcattgtataatgttgtgcttaagagcattcaccttggagtgagatagccctgggttcaaattgcagcactaccactcttagcttatagtagtgttaagttactgaagccttctgctctttagttatatcatctctaaatgggaataatatttactctgtaggcttgtgagaatgacattagacaaattctggaaagcaccagtgcctaataagtggtaaagctgggatctgaacccttagattaatacctgctaaaaagtttcttagtaagattgttaaagttaagggagagaattaattataagttacttcatccatagatttttttgtatttatggttatttcagtcctttgtcttttttttttttttgagatagaatctcactcttgtcacccaggctggaatgtagtggcacaatctcggttcacttcaacctctgcctcctgggttcaagagattctcctgcctcagcctctcaagtagctgggattacaggcacctgccaccatgccaggctaatttttgtatttttagtagacacagggtttcaccatgttggccaggctggtctcaaactcctgacctcaggtgaatttgcccacctccatctcccaaagtgctgggattacagccatgagccaccacgcccagtctttatttcagtcctttgtcttaaaagtcagttatcctcttcatttctaaaaggaaaatataattatgttaatttgttagtccagacgatgaagaagaagaggagcaaacctgtccatccacattcagtgaagaaatgacacctacctcagtcattcctaaattaccacagtgtctacgggaggaagaagagaaggagagcgactctgattcagaaggtcccattcagtaccgagatgaagaagatgaagatgaaagctatcagagtaagaaagggagggaaaagcaaaacagagaattcttttccagataaaactatttgctgatcttagcaagtgtcaaaagagatatggaaacaggtaccttctcccattaagtcatctggctaactgatgttggaagccactgtgaaggactccttgtccctattatcacccctctgttaaaacaagccaagacagggatccaagtagattgagtcactcaggttttaggttttttgtttttttttgttttaatttttttttttttttttggacaaggttttgatctgtcacccagctggagtacagtggtgcaatcgtcgctcactgtagcctccaactcctggacttaagtgatccttacgcctcaacctcccaaatagctaggacagatgtgtgccacaactggttaggtttctttgattttttgttttgttttttgtttttgtagagacagggtctcgttaggttgcctagcctgttctttttttttttttttgagacggagttttgctcttgttgcccaggctggagtgcaatggtgcgatctcggctcagtttaacctccacctcccaggttcaagcaattctcctgtctcagcctcccaagtagctgggattacaggcatgtgccaccacacctggctaattttgtatttttagtagagatggggcttcaccatgttggtcagactggtctcaaactcccgacctcaggtgatctgcctgcctcggcctcccaaagtgctgggattataggtgtcagccaccgtgcctggccataaaagatatatatataattttttttttttttttagacagagtcttgctctgtcatccagactggagtgcaggggcacgatctcaactcactgcaacctccacctcccgggttcaagcaattctcctgcctcagcctcccaagtagctgggattacaggcgtctgccactaggcccagctaatttttttttatttttagtagaggcggcgcttcactgtgttggccaggctggtctcgaactcgacctcgtgatccgcccacctcccacagtgctgagattataggtgtgagccactgtgcccagctgcccaggctgttattgaactcctgacctcatgtgatccccctgccttgacctcccaaagctctaggattacaggcatgagccaccgtgcctagcctatttttaatttttatagatatataatagtaatatatatttatggggtacatgagatattttgatataagcatgtgtgtatgggtaattaggctatccatctcaagcacttatcatttgtttgtattgggattattccaaatctacctttctggttatcttgaaatatacaatgaattattgttaactatagtcaccctattgtgccaccgaacactagatcttattcctttttttttgagacagtgtctcactctgcaggctagagtgcagtggcacaatctcagctcaatggaacctccacttcctggctcaagcaatgctccaacctcagcctcccaagtagctgagaacacaggtgtgagccaccacgcccagctcatttttgtatttttttatagagacagcgtttcaccatgttgcccaggctggtctcgaacttgtgagctcaaagtgatctgcccacctcagctcccaaagtgctgcgattacaggcatgagccaccacgcccggcctagatcttatttcttctatctaattctgtttttatacccattaaccagtctctctctcccccatcccctctacccttccctgcctctggtaaccaccattttatttattacctccatgagatcaacttttttagctcccacgtaagagtgagaacatacaacatttatctttctgtgcctggcttatttcacttaacgtaattgtcctccagttccatccattttgttgcacataacaggatttctttctttttcatggcagaataatcttcaattgtgtatatacaccacgttttctttatcccttcatttattgatggacatttagtctgattccatatcttggggattataaatagtactgcaataagcatgactgattgatttgctgatttcctttcttttggatatgtacccaacagtgggattgctggatcgtatggtagttctattttttttttaatagacggaggctcactctgtcaccaggcaggagtgcagaggcacgatctcagctcactgtaacctccgcctcccaggttcaagcgattctcctgcctcagcctcccaagtagctgggattacaggtgtgtatcaccatgcccagctcattttagtttttgtttttgtttttgtttttgtttttttagtggagacagggtttcaccatattggctgggatggtcttgatctcttgacctcatgatccacctgccttggcctcccaaagtgctgggattacaggcatgagccaccgtgactggcccggtagttctatttttaagggtgttttgtttgttttgttttgttttttaagtagagacacagtcttgctgtgttgctcagactgatctgaaactcccagcctcaagcaatcctcctgccttggcctcccaatgtgctgcattacaagcatgagccacctcatttggcctattttcagttttttaaggaacctccatagtgttttccacaatggctgtactaatttcaggtttttgtttgcccccaattttaaaactattcacctaagtgcctctaatcccagcactttgggaggccgaggccggtgaggtcaggagcttgagaccagcctggccaacatggtgaaaccccatctcttctaaagatagaaaaaattagccaggcatggctggccacggtggctcacacctataatcccaacactttgggaggccgaggcaggcggatcacctgaggtcaggagttcgagatcagcctggccaatgtggtgaaaccccatctctactaaaaataaaaaattggctgagcatggtagcaggcgcctgtaatcccagctactcaggaggctgaggcaggagaattgcttgaacccaggagacggaagtcgcagtgagccaagactgtgccactacactccagccggggtcacagagcgagactctgtcgcaaaaaaaaaaaaaaaaagccaggcatggtgacaggcacctgtaaccccagctactcaggaggctgaggcaggagaattgcttgagcctgggaggcggaggttgcagtgagccgagatcttgccactgcactgcaacctgggcaacagagcaagactccgcctcagaaaaaaaaaaaaaaaaagaggccaggcgtggtggctcacgcctataatccctgcactttgggaggccgaggtgggtggatcacctgaggtcaggagttcaaaccagcctggccaacataacgaaacccgaaacccggtgtctactaaaaatacaaaaaattagctgggcgtggtgacccacgcctataatctcagctactcaggaggctaaggcaggagaatcacttgaacctgggaggcggaggttgcaatgagctgaaatcgtgacactgcactccagcctgggcaacaagagcaaaagctctgtctcaaacaaacaaacaaacaaaaaaaccaacaacaatatggagtagaggaaaggtggcacatgggctaaggtgaaaagataaaagtgatgttttccctttggtctaatgaacttattgccacagggcagagaaaaataaacattttcataccctcacatctttgcaaataattgagtcctgattaattgaagtagaaaggcagctttaaaaacagatagactatgaggtgttagtatgaaagcctttatgttttaattcagagggctgtcccatgcttagattctctctcctgtagcaactcttaccaaggaggaaaaatgtagaggcctgatagaagagaaaagataccttttaaccatcttagtccacctggctaaaaagatttttaggtgtctttagctttacccccacctcagtgttcagctggatcatttgaggccaggtgggaactgggaattaaatattgtatttgttcagactcttgactagctccaggtaaggttgaacctttggctttaagcctcaagttctacatttttttcttccccgtgtgcaaaggtgctctcgccaacaaagtgaagaggaaagacacactggcaatgaagttgaaccacagacccagtgaaccagagttgaacctgaattcttggccttgtaaaagcaaggaggagtggaatgaaatacggcaccagattggaaacacactgatccggtaggcctttgcttagatttgcttgattgatttggttatgccagtatttgtgttagatgttgttagatgtgttgtttttttgtgtgtgttttgtttcgttttctgagacagggtcttgctctgtcacccaggctggagtagtggcgcgatctcggctcactgtaacctccacctcccaggttcgagcaattctcctgcatcagtctcctgagtagctggcgttataggcacctgccaccacgccaggctaatttttgtattcttagcaaagacagcgtttcgccatgttggccgggctggtctcgaactgctggcctcaagtgatcacccaccttggcctccacaagtgctgggattacaggcatgagcccctatacctagtctatatgtttactttgttgtggagtattcatttatcttttttagtgtgatttttttttcttttcagacagagtcttgatctgtcacccaggctggagtgcagtggttcaatcatggctcaccacctccaactcttgggttcaaggcaccctcccacctcagcctcttgactagctgggtcctcaggcatgcgccaccatgcactgctaatttttgtaattttttgtagagacagggtctctctgtgtttcccaggctggtctcaaactcatggcctcaaacattcctcccacgttgccctccgaaagtcctgggattataggtgtaagccaccacacccatcactttgagtataattttaaaaaatacatattgggttttgcatgaaaggagagaaggttagcactccacttgacaaggatggaagaggccctttgggcctgacaacacacatacaaggcattgccacctactacgtggcatctaactatctttacaaaaaaagaaaaagaaaagaaaagaggctgggtgcagtggctcatgcctgtaatcctagaacttcgggaggctgaggtaggcagatcatctgaggtcaggagttcaagaccagcctgaccaatatgatgaaaccccatctctactaaaaatacaaaaattagccaggcatggtggcatgcgcctatagtcccagctactcgggaggctgagatcggagaattgcttgaacccaagaggcagaggctgcagtgagctgagatcgcgccactgtactgcagcctgggcaacagagtgagactccatctaaaaaaaaaaaaaagaaaagaaaagaaacaaaaaaatatatattggacacagttgggtatcctctaagaatttggaaattgaagatgtagctgcctgtgagagttttattttatttattttatttttgagatggagcctcgctctgtcacccaggctggagtgcaatggtgcaatctcggcttactgcaacctctgcctcccgggttcaagtgcttctcctgcctcagcctcctgagtagctgggactacaagctcataccaccacacctggctaatttttgtatttttagtaaagatggggtttcaccatgttggccaggctggtctcgatctcctgactcaggtgatctgcccgccttcgactcacaaagtgctgggattacaggtgtgagccaccacacctggccagcctgtgagagctttaaaccatgagatagacatatggttttgcaaaagtttctacataaatcagaatggttcccagaacagaaaggctcctctgtcactttttttatctggttgcttaaccataagatgccaacccaattaacagtcacacccatatttgcattatatctgtttcatatgttccgtgtaactgcctcctttcaaagtgttggtatatttttcaagtcaactggaaccaaaagtatagagaaactgaatgcaagccagctttctgcatatgtaacagtgtaagaatccaggttgtatagatgggtttttgtttgacacagatgtttctcccagtaaagagaggataaggagctggaactcgtggcacagttccctacaaaataattaattgatcatgtctactaattaaaatttctttttctgtactattgcagatacctggttttggctgggcaaggtggctcacacctataatcccaacattttgggaggctcacttgaggtgggaggctcacttgagcccaggagtttcagagcaacccgggcaacaaagtgagatcccatctgtacaaaaaattaaaaaattagctgggcatggtggcacatacctctagtccagctattctggaagcttaggtagaaggatcacttgagcctgagagatcaaggccgcagtatgctgtaattgcaccactgcactccaccctgggtgacagagcaaaaccctgtctcaaaaaaaaaaaaaaagagacacctggctttactgtgtatgctgtacctcagggcaagttttccctttgtcttctaatagacactttttggatccagaaattgttctctgcaatttctttacttaaacataattatcagcctgtatgacctctgtggtctgactactttgaaattaagggagaaggctgggcacggtggctcactcctgtaatcccagcactttgggaggctgaggtgggcggatcacttgagcccaggagttcgaggcaacatgacaagaccctgtctcgacaaaaaaacaaaaaacttagccagacatggtgacacacgtttatggtcccagctactcaagaggctgaggcagggggattgcttgagcccaggaggggctcaaggtcggcccaggaggtcaagacccaggcgatcaaggcccaggaggtcaagactgcagtgagctgtgctcatgccccactgcactccagcccagtcatcagagcaaaaccttgtctcaaaaaaaagtaaagaaagacatgtttattatatggtagtttgaaaaattacaaaaaaaagagataaatcatggccggacgcggtggctcacgcctgtaatctcagcactttgggaggccgaggcgggtggatcatgaggtcaggagatcaaggccatcctggctaacacgatgaaaccccgtctctactaaaaatacaaaaaaattagctgggtgtggtgctgggcctgtagcccagctactcgggaggctgaggcaggagaatggcatgaacctgggaggtggagcttgcagtgagctgacatcgtgccactgcactccagcctgggtgacagagcaagactccgtctcaaaaaaaaaaaaaaaaaaaaagagagagataaatcagccataatcctataccctataagccaggatttggcaaacttcttctgtaaagaaccaaatagtaaatattttaggatagggtgcagtggctcatgcctataatctccgtactttgggaggccagtgtggaagaattgcttgaggccaggagtttgagaccagcctgggtaacatagtaagactctatcactacaaaaataaaaataggtcaggcacagtggctcacacctgtaatcccagcacgtttgaaggccgaggcaggtggatcacatgagatcaggagttccagaccagcctggccaacatggtgaaaccccatctactaaaaatacaaaaattagccaggcgtggtggcgcccacctgtaatcccagctactcaggacactgaggcaagagaatcacttgaacccaggaggcagaggtttcagtgagctgagatcacaccatggcactccagtctggacgacagagtaagactccatctcaaaaaataataaataaaatagccaggcatggtagcatgcccctgtagtcctagctacgtgggaggctgtggcagcagaactacttaagcccagtagtctatatactagacagggcataaatatagttatatttaatatatttaatatatgtgtgtatgtgtatatatatgtgtgtatgtgtatatatatgtgtgtatgtgtatatatgtgtgtatgtgtatatatatgtgtgtatgtaatatatatgtgtgtatgtaatatatatgtgtacgtgtgtgtatatatgtccatatatatatatggatttgatggccatataaactctctctttttttttttcctacctttaaaaatataaaaacatgggtcgggcgcagtggctcatgcctgtaatcccagcactttgggaggccgaggcgggtggatcacgaggtcaggagacagagaccatcctggctaacacggtgaaaccccatctctactaaaattacaaaaaatttagccgggtggtggcaggcacctgtagtcccagctactcgggaggctgaggcaggagaatcgcttgaacccaggggacagaggttgcagtgagctgagttcacaccactgcactccagcctgggcaacaagagcaaaagaaactccgtttcaaaagaaaatatagtttatacatacagtggaatattatttaatcttaaaaaagaaggaaatcctccaatatgctaacaacatagtcaaaccttgaggacattaatatgagtaagccagtcacagaacaataaatactgcatgattccacttctgcgaggtatctgaaatagtcacatttatagaagcagagagtagaaagatagttgtcaggggctcgggattgaaggcaggggtgatagggagttgctaataaataagtataaagttttagttatgcatgatgagtaagttctagagatccactgtacaacattgtgtttatagttaatactgtagactgggcgcggtggctcacgcctgtaatcccaacactttgggacaccgaggcaggcagatcacgaggtcaggaggtcaagaccagcctggccaacgtgatgaaaccccatctctactaaaaatacaaaaattagccgggtgttgtggcaggcacctgtaatcccagctagtcaggaggctgaggcaggagaattgcttgaacccgggaggcagaggtttcagtgagccgggatcccgtgccactgcactccagcctgggcaacagagtgagactctgtctcaatcaatcagtcaatagttaatactgtattggccaggtgtggtggctcatgcctataatcccaatactttgggaggccgaggcaggcgtatcacgaggtcaggagttccagaccagcctgaccaacatggtgaaaccccatctctactaaaaatacaaaaattagccgggtgtggtggcgcatgcctgtaatcccagctactcaggaggctgaggcaggagaatcgcttgaacctgggaggcagaggttgcaatgagccaagatcacgccactgcactccagcctgggcaacagagtgagactctccatctcaaaaaaaataataataatactgtattgtacacttaaaagtctgttcaaaaggtagatctcatagtaagtgttatcactataaaataagattgaaatttaaaaaaacacacacaataagagaccaccacgagtacactaggatggctaaagttatgcaatttaaaagactgacaaggccgggtgtggtggctcacccctgtaatcccagcactttgggaggccgaggcaggcagatcacctgaggttgggagttcgagaccagcctgatcaacatggagaaacttcatctctactaaaaatacaaaattagctgggcgtggtagcacatgcctgtaatcccagctacttgggaggctgaggcaggagaatcacttgaaccggggaggcagaggttacagtgagccaagatcgggccactgcactccagcttgggcaacagtgcaaaactctgtctcaaaaagaaaggaaaggaaataaatacaggagtgatatgttcattcttgcaattgtgatgatgatttcacaggtgatatatggcaaaagtggccaaattgtacatgttaagtatgtacacagttgtacatatttacagtattattgtgtcagttatatcgtattaaagctggtttgttttttgttttttgttttttgtttttccgaagaacatttaaaaaggaaggcccaggccaggcatggtggctcatgcctgtaatcccaacactttgggaggctgaggtaggaagatcacttaacgtctggagttcaagaccagcctgaccaacatgctgaaaccccatctctattaaaagttagctgggcctagtggtgcatgcctgtagtctcagctactcaggaggctgaggcagggcaatcacttgaacccaggaggctgaggttgcagtgagccaaggtggcgccagtgcactccagcctgggcgacagagtgagactctgtctcaaaaaaaaaaacaggaaggtccagctgggtgtggtggctaacatctctaattccagccctttgggaggctgagctgggggaatcacttgagcccaggaatttgagaccagcctgggcaatatggcaaaactccatcactaccaaaaataaaaaaattagccagcccagtctctaaataaataaatacatacatacatacatacgtactttttaaaaaataaaatggggcggggcacagtggctcacgcctgtaatcccagcactttgggaggccgaggcaggcggatcacaaggtcaggagattgagaccatcctggctaacacggtgaaacgccatctctactaaaactacaaaaacttagccgggcatggtggcacgcgcctatagtcccagctactcgggaggctgcggcaggagaatctcttgaacctgggaggcggaggttgcagtgagccgagatcaagccactgtattccagcctgggcggcagagcaagattctgcctaaaaaaaaataaaaataaaataaaaataaataaataaaatggaagatccttgaggtaggaggatcatttgagcctaggaggtggagctgcagtgagctgtgatcgcaccactgcactctagcctgggtacagagtgagaccctgacacacacacaaaaaaaaaaaaaaaaaaaggaaggtcttgttcagaaagaaaagttgtatatagaatgggactggaagttccttatgcaagcaacagaagagttgaaaattttgcaagtactagctaattagcccaaatactgtctgagaagtataaattaaaagtaagaaatgaataactttctgatttcaaaaatgacaaattgtagttttttgttgttttttttttttttttttttttttttgagatggaatctcactctgtcgcccaagcaggagtgcagtagcatgagcttcagctcactgcaacctccatctcccaggttcaagcattctcctgcctcagcctcccgagtagctgggactacaggagcacgccacaacatccggctaatttttgtatttttcagtagagacagggtttcaccatgttggccaggctggttttgagttcctgacctcaggtgatccacctgcttcagcttcccaaagtgctggggattacatgcatgagccaccacacctggccaacaaattgttattggtgaataacatctcagaactgtgatgaggtgagataactttatcaaatgcttcacagagaagactgagatttaaatcatagaattatagaatatcacacagaaagagacaaacttaaattccagtggttcctaaaccactgatttaaaaacctagctgggcatggccaggcgtggtggctcacgcctgtaatcccagcactttgggaggccgaggcaggcggatcacaaggtcaggagatcgagaccatcctggctaacacggtgaaaccccgtctctactaaaaatacaaaaaattagccaggcgtggtggcaggcgcctgtagtcccagctacttggaaggctgaggcaggagaatgtcatgaacccgggaggcggagcttgtagtgagccgagattgcaccactgcactccagcctaggtgacagagcaagactccatctcaaaaataacctagctggacataatggcttgcgcctataatcccagcagtttggggggccaaggcgggaagatagcttgagcccaggaggagttcaagactatcctgggcaacagagtgagaccctcatctctattttcaaaaaattgtaaaaaaaaaaaatctaaagaggggcatctgagtcatagaagaagttttgtgaaaaaaaaaatctatatatagatatatgtaatttcatttttcatcctgattttctgaatcagaatttctgttaacgtttcttgggaatctgtgttttctaaaaagtctctaatgcttctgaaggagcaaatttgtttaggagccaccagttcggtccaaaccttcgcttcacggatgaggacactcaaggtctaactgaacttttttgtgctaatagctcttatcaaggtctagaactagaatcctggccacttgtttgcatatacagttcctttttataatgtgatatctgtgttaacacttttaatgtgaaattgttttataaacaatcataaataaatgaaatatatcagtttgaaaatttgttgatttcttacttatataggggctaatatatactgtgaccaaaaaaatctttataaacaagattgggaggtttaacataaacattacctttatttatctcatttttaggcgactgagtcaaagaccaacaccagaagaactagaacaacgcaatatattgcaacgtgagtccagttatggaaataaagttgtatagattttctttgtatgtttctgactttaatatacataaaagaaaaaagaagcgtttgctacaagggctaagggagagtgttccagccaggcaaggactatttatttccccatgaaggaacagagcttaccaagcttcctttggaagatgctattatggtattgtttagtgtgctgtgatactctagaaagctttgtttcagtgttctcactgtatcctggaactgccttgggcatttgggaggctttgacagtatatgggagatgtgcccaatttttctgttttcagggagctaaggaggtagctgtgcatatggagaccttcctattcctagaatgtgagggctggggcccaaagcaagtcccaaatgcagcagcttttctcttggtttaatcccttaagactttcttacctctgtagttaccaaatgggaccatatatttaatttgctgtctgtgtacataattaatttcctgaaatagcattctaatctagtacatatttcatttgtttttccagaatatagagtgaaatttggccttaaaagtctcctcactgagaaggtttgggcttccttggggctatttgtgagcatgttcagtctgaccaatccatcccctgttctctcagcactacttgggtatacacaacttaataacttagtacattttctagtgtgggagcccttataacgtatcacacaaaactcagtgtgatcaccattgtccattcttagcagttactcttgagcaagaatctgcaggcttttccttaaagcatacatagtaaacattttgggttttgcaggccaaaaagcaaatgaacaactatacgtaataggtccttacaaaaccatttaaaaatgtgaagactattcttagttcatgggcaggaaaaatacaggcaactggcgagatgtggtgccatagtttgctgactcttgcttttaagtatttgtatcgttgacaagaaaattgttttgtttagccatccccaaagttagtattttattctgatttgggcctataagaaatatctgggccgaggcgagtggatcacaaggtcaggagatcgagaccatcctggctaacatggtgaaaccccgtctctactaaaaatacaaaaaaattagccgggcatggtggcgggcgcctgtagtcccagctactcgggaggctgaggcaggagaatggcgtgaacccgggaagcggagcttgcagtgagccgagattgcgccactgcactccagcatgggcgacaaagcaagactccatctcaaaaaaaaaaaagaaaaaaaaagaaatatctgggctgggcacggtggctcacgcctgtaatcccagcactttggaaggccgaggcgggtggatcacctgaggtcaggagtttgagaccagcctgaccaatatgatgaaactctgtctctactaaaaatacaaaaatcagctgtgcatggcatgtgcctgtaatcccagctactcgggaggctgagacaggagaatcgcttgaactcgggaggccgaggttgcagtgagccaagattgtaccattgcactccagcctgggcaacaagagcaaaactccgtctcaaaaaaaaaaaacaaaaaagaaatatctgtaatgtaattactaaaacgtttgatatgcaaattgtcatttgtgagtaatattccttccttctgattgtcaactgtagctaaaaatgaagctgatcgtcaggcagaaaaacgagaaattaaacgtcggctcactagaaaggtactactgcctgtgtgttcagttaactatatgtgttatatttggatggcctatttgattggaaatgaattcacagctgggcacagtggcttgcgcctgtaatcccagcactttggaaggccatggcaggaggattgcttgagcccaggagttcaagaccagcctggggaaaacagtgaaaccttgtgtctacattaaaaaaaaaaaaaagaagaagaaagaaaagaaaaagaaaaaaatgaatttgcagcctgggcaacatggcaagaccccacctctacaaaaaaaaatatatattagccaggcatggtggtatgcgcctgtaatatcagctacttgggaggctgaggtaggaggatcatttgagcttgggaggttgaggctgcagtgagctgtgattgtgccactgcactccagcctgggtgacagggcaagaccctgtctcaaaaaaaaaaacaaaacaaaaaaccacctgataaccataatcactgggggtgggacctccagggatcaatagtgtctaaagctcccccaggtgattccaatgaagattgaagcactgggttagaggcaatttgaatgcatgattgatgcctaattattggcttggtgaactaagaggctccgtttccttcagctcagtcaaaggccaactgtcgctgaactccttgccaggaagattctgaggtttaatgaatatgtagaggtaacagatgctcaagattatgaccggcgagccgacaaaccttggaccaaactgacccctgctgacaaggtacctggaaagcactctcttgctttttttctctttctctttttctctttatttggaggatccaagatactaactagaagggagaaccataaacaaaacttctagttttaatataatattaaatttcaaatcaagatacaaaatgccaagttgaacaagtcaaaatgttatactaactcagtatgttttggtaactccaccaccaatactgaaagaaagaaaatccctgctatctcacagagtaaaaatactggaaggaataaatacatttcaaacagtggttgtttggttagagggagtttgggctatatattttagtaattaccaatatttcatttttataatgctgtgaaaaactataaaagctggccaggcgtggtggcttatgcctgtaatcctagcactttgggaggccaatgcagagggatcactcgaggtaaggagttcgagaccagcctggccaacatggtgaaaccccatctctactaaaaatacaaaaattagctgggtgtgatggcatgcacctgtaataccagctacttggaaggctgaagcaggagaattgcttgaacctaggaggtggaggttgcagtgagccaagatcatgccaatgcactccagcctgggcagcagagtgagactccacctcaaaaataaaaataaaaaattaaaattaaaaaaaaaacaaaactagccaggtgcagtggctcacacctgtaatcccagcactttgggaggccgaagcaggtagatctcttgaggtcaggagttcaagaccagcctggccaacatggtgaaaccctgtctgtactaaaaatacaaaatagccggacgtggtagtgcgcacctgtaatcccagctattcgggaggctgaggcaggagaatcgcctgaacccaggagctgaaggttgcagtgagctgagattgcaccactgcactccagccccagcaacggagcgagattccatctcagggaaaaacaaaaataaaaacaaaactataaaagctacaatatatctttcaagattttcaagtattttgattaaactaaaaattttaggtttattatgagacagatgggtatcattgtgttgacctggtgtctgggttgcctgtgaggggttgcagtgacttacaaagttaaacacagtacagaaaaatgacaagttacactgctgtgcaaagcagccagaagaagctgaaacatttttgtctctactccacaggctgccataagaaaagaattaaatgaatttaaaagctccgagatggaggttcatgaagagagcaaacattttacacggtaagacccaaaagacccaatcatatatgtgctaggtagagttttccaaaaaattgttcagatatgaagggctctaatgacatcagtaaaaaggaaaacactcagtgttgattgcaagactgcattcaaagggatgaaaagtaagaagcaatagtaaatgcctaggccaggtgcggtggctcacgcctgtaatcccagtactttgggaggctgaggcaggtggatcacctgaggtcaggagtttgagaccagccggaccaacatggcaaaaccccatctctactaaaaatacaaaaattagctgggcctggtagcaggcgcctgtaatcccaactattagggaggatgatgcgggagaatcacttgaacccgggagatggaggttgtagtgagctgagatcatgccattgcactccagcctgggtgacaagagcaaaactccatctcaaaaaaaaaaaaaaaataagtaaatgtgtattctgattatggcatttcatgtatattatttaatccttgtaataaacatgcaagatgtgttaacatccccattttatcactgaggaaatggaggctcacaatggttaagtaacttggttgacttgctagtaaattgcagaaccaggattcggagaaagaaatcaatgacttcaaggatgtgaggtgctctcttccttgtaccttactctctcaggttataaatgaggagactgtgctaagttagacaagatcttgccctctctggttcagttctgtctagcacagttgatcttaccaacttaatgtataaacaacattttaattagctgtcttcatgaaacaagccaagaaatccaacaaagccaacaagccaacaaatcaagtgttttgatttggaattacggttgtgattaaggacccacccatatccaaagaatcagctagccacaaatggaatcagtgaaagtatctttacatgattcttagaacatttacaaaaagaggcaaatgaggctgagtgcagtggttcatgcctgtaatctcgacactttgagtggctgaggcgggaggatcgcttgagcacaggagtttgacaccagcctgagcaacatagtaagactccatccctacaaaaaaaaaaaaaatctattttttgatttaggcaggggcctggtgcagtggtacacacctgtaatcctagcactttgggaggccgaggtgggaggatcactttgagaccagcctgggaaacacggtgagccccatctctacaaaaaataaacttaaaaaaaaaataagcaaggtgcagccaggcgcagtggctcacacctgtaatcccagcactttgggaggctgaggcaggtggatcacttgaggccagttggagaccagcctggtcaacatggtgaaaccctgtctctactaaaaatacaaaaattagccgggcatggtggcatgcctgtagtcccagatacttgggaggctgaagcaggagaatcacttgaaccccggaagcagaggttgcagtgagccgagatcgcgcaactgcgctccaacctgggcaacagagcaagactgtctctcaaaaaaagaaaaagaaggaccagcttaagcaagacgatgggagagaggaaaacacatggtgtttctgggtaacagaaaatgtagctggatcagaggatgtttggggcagtgtggtgaaaataaactagaaaatgggttgcagtccctcgcaatgctttgactgttatgctaggatgttggaaccattggcagttcataagcaggaaattctgtgtatttcagaacaagctctgatgcaaacaacaaagatgatatggaaggatgaagagactagcagcaaggaaaacaggaagtatctgaaataatcttagtgagcatagtggtagctcacaccagagatagtgagaatgcaaaggtgatagatttgtaagacatttcaagcatagaatcaacaagatgtggcaatttgttggattccagagatgaaataaaggagtagtcaaaatgactctgatatttttaacttgtattttttgaggtctttgaaggtgataagtttagctgaacagtttagtttattcaacaaatactgagcacctaccacgataggtatagtgctaggtccttgggctacagcaggaaataagataaagtctctgtcctcaatgaggctttattctttttttttctttttttaatagagatggggtctcactatgtttcccaggctggtcttgaattcctggcctcaagtgatcctcccatcttggcctcccgaagtgttgggattacaagtgtgagccactatgcctggccaagcttttattctaaaagaagaaggcagacaatgaacaagctagaaaataaattgcatgtgtttagtttgaggagcctatgacacatggagatacctagaagaccattagatatgcagcctagaatccagaaagaaagcaaagtctcaagatacaaatgaaagaagatagtggacctttaggggggattttatttttatttatttattttttttttttttattttttgagacaaggtctcactctgtcacccaggctggagtgcagtggcatgatcgtggctcactgcagcctcaacctctcatgttcaagccatcctcccacctcagcctcctcagtagctgtgactacaggcacaggccaccacacctggctaactttttgatcatttgtagagacagggtctccgtatgttgcccaggctgctctcaaactcctggtctcaaatgatcttctcaccttggcctcccaaagtgttgggattgattacaggcatgagccaccgtgactggccaaggaaagttgttttttatttaaagggtagacagaggaaaatgaaccaggacagcatactgagaaagatcaattgaagaagagagaaaattatggaaaagatagtgttacagaagccaagagaagagttcttttttttttttttttttttttttgagacggagtctcgctgtgtcacccaggctggagtgcagtggcgcgatctcggctcactgcaaactccacctcccaggttcacgccattctcctgcctcagcctcgcgagtagctgggactacaggtgcgcgccaccacgcccagctaattttttgtatttttagtagagacagggtttcaccgtgttagccaggatggtctcaatctcctgacctcttgatccgcccgcctcggcctcccaaagtgctgggattacaggtgtgaaccattgcgcccagccgagaagagttttaagaaggaagcagatgaggagtatcagatgcaacagaaaggtcaggtcgaattagagcagaggaaaggcagtgttaattaggtataacatttcattactactgatacattaatagcaaagcaatgtacatcatgtggtaacttgtctcttttttaatctcttttagctaccatcgtccatgatgccaaaggttgagagaggaatcaacatggctgctttgctgcttccttctccaaagtgacatatggagggaactttagcacttcccagcacagccagaattgcatcctctgggatcttctgaggtggacagcactttgaatgtagcatttcactggaacagagtcttatgtgctgcaccgggggcaaaacaacactttgtcagtgcttttgaacctttcaatattgtagcatgcttgaggagtttttcccttactggccaccaaagttctgaaccacttgcaggttccaggttttactggctgcaccacaccccttcccctagatgactgcctgtgcagagacacagtttgcaccattagccttacctgccctgccctgattgtgagacccaaatgtgtaggctctaaattccagccatcaaatccaattcctggtggggaaaaccttctggagacccccaaccttctgataaaagagtctctacctccagggaaagccttcttaccacactggcatatcagatgaaagcattgcactgtacctctcgtaacacagcaatacagtcctcttgaggcactcaagcctgagaggaagctcaggatctgacatgttcttccttttcctcacaagtcatcatgattttttattttaaaataatctggaagtaatgggaacttagtttttcctgaactccaaccagaatccaaattggttagatgaggccaggcgcggtggctcacgcctgtaatcccagcactttgggaggccgaggtgggtggatcacctgaggtcaggagttcaagaccagcctggccaacatggtgaaaccccatctctactaaaaatacaaaaattagccaggtgtggtggcgcctggttgaggcatgagaatcgcttgaacccaggaggtggaggttgcagtgagccaagatcatgcctactgcactccagcctgggcaacaaagtgggactctgtcttaaaaaaaaaaaaaaaaaaaaaatcggttagatgagaaagcatgtatattttctatatacaaaaacaagaaaggcgttttgagcccctgtgctcaggcccactcccacactgtggagtgtactttcattttcaataaatccccttattccttccttgcaaaaaaaaaaaaaaaaaaagccttagccagattcagtggctcacgcctgtaatcccaacactttgggaggctgaggcgggtggatcacctgagttcaggagttcaagaccagcctggccaacatggcaaaaccctgtctctactaaaaagtaaaaaaaattagccgggcatggtggcttgtgccttgtagtcccagccactggggaggctgaggcgggagaattgcttgaacctgggaggtggagattgcagtgagccgagatcgcgccactgcactccagcctgggtgacagagcgagactccgtctcaaaaaaaaaaaaaaagccttaatattaatgctaacgtggcagaaaactagcaggttacattttataggctattgtagttttatttaccaaatgatattctctaaatcacttcgaccaataaatgtattctcctccttaaagcagagttgtatcaactctgtgggagcatttatgagctgtcagtccccacacttctagccagaatcacaataaggtctggctgggtgtggggtgctgcataggaaagggtctctggagaagcaagaagggcacaatcatggcccactgctcccctcttcttctcagtgctctttgccctctcctgctgcgtgcttcctcttcactccagtgctgatcctcctgctctctctggcagcttccacctcacccgcccctcttccacactataaccagtatggttggtgctggggcattgactcagcccccctgctttctgcatttgtaatagatattaatatgatttcctaaaacagaagattttgttgctttctttgaacttgtattgaaaaccatacagtctcactgttttgctttaattcctatccacactataaatggaagaaaaaaattaatagcttctgtttaatctgatgaatgtggctttttttcccttcactttaatgttcaagaagttgtggctatttcatagatttcttctgatttattctgtgggtccctgttatctgttctttatgtaatctttcagtagattttcatcctttcatatccacattcttatgtggacttgctgaagaaacagaatatcagttcaaaacaaaacctaggccaggcatggtggttcacgcctataatctcagcactttgggaagccaaggcggtcaggagtttgagaccagcctgaccaacatgatgaaaccctgtctctactaaaaatacaaaaattagcctggcgtggtggcacgcatctgtaatcccaactactcaggacgctgaggcaggagagtcgcttgaacccaggaggcggagattgcagtgagccaagattgcaccactgcactccagcctgggcaacagagcgagactccatcaaaaaaaaaaaaaaaaaagaaggaaggaaggaaagcaagccctgaatccacatctccttgaagttttttttgttttattttgtttttgagacagaattttgctcttgttgcccaggccggagtgcaatggtgcaatctcagctcactgcaacctccgcctcccgggttgaggcgattctcctacctcagcctcccaagtagctaggattacaggcatgagccaccacgcctggctaattttatatttctagtagagatgaggtttctccatgttggtcaggctggtctcaaactcccgacctcaggtgatccacccacctcagcctcccaaagtggtgggattacaggcatgagccaccgtgccgagccttccttgaagttttttgtttggttttgatttgttttgttttgttttgttttgttttgtttttggagatagggtctcactctgttacccatgctggagtgcagtggcacaatcttggctcagagcaacctctgcctcccaggctcaagcaatcctcccacttcagtctaagtagctgggactacaggcacgtgccaccaggcccagctaatttttgtgttttgttagagatgaggttttgccatattgcccaggctcgtcttgaacaccggggctcaaggaatctgcccatcttcgcctcccaaagttctgagatagcaggtgtgagtcatcatgcccagcctccttgaagtttactaacaattgggataactgagggaagagaagtgacaattccactcagtctattagaggtctggatataaggtagccacacaataactctaacttgacttctaaccattctatcttattgatttggaggctgtcttctgccagattttttgtggcttgagatgatattttcgaacccttctttcactacctttcttacccttaatgtgccaagcttgaaacaggatttgatttcctgagctacttgttcgccttctgtgcgtcaccaagtaatctggttcatctttcgtctcattcatgttattttcaagtgaaacaagacattttgggggtcaagtctctttgggtgttttgtttttatgtatataaaaatggattttgtgttccctttccatgtaagtaccaacttatatggaaactcacaatcataatgtaaagaagaaatgaaagcctggtgtattgtacttcaagatgcctccctgatgtatagaatctccttgtaaaataaataattgcattgtatatcagtcttcccatcaatattaattattaaatattttagaatttttaaataccaactata

SEQ ID NO: 190 - DNA, 4950 bp, Homo sapiens
  source 1..4950: mol_type = genomic DNA
gattctctaactgcgcatgcttctgcgcacgcgcaatagacattccaggacttccgggcacttcgtaaggtttaaaaaggatgcttcgcgttttctctctcctttttggagacagattcgcagtggtcgcttcttctccttggtaagtgtgatccttggtaagtgtgatcagatgcttgccaccggagttgtgggtctaatgctatagatcagtagccgagcttccctaggaagatcatatagtattttatttatttactttttttttttttttgagacggagtcggtttgtcactcaggctggactgcagtgctcgttgcaacctccgcctgccgggttcaagcgattctcgtgcctcagcctctccagcagctgggattacaggcacgtgccaccacgcccggccaatttttgtattcttagtggagacggggtttcgctatgttggtcaggctggttttgaactcctgatttccggtgatccaccaccctcggccttccaaagtgctgggattacaggcgtgagccaccgcgcctggccggaaatcatgtaatttaaaactatatatgggtgtcttaggcggcatcggtcccaactctaaagtacgcgttagacgggcctgggccagaagtgggccatggagacctcgggacccgcagggctgccgcccgacccagcgagcctctgaaggtgcaccgccacccccactgtttatcttactgcctcatagtaggcacattgtcgttctcaatataattgcacacagttttattctggatcctcatttgcctttaagaattttctcaatttttctttttatttgatcgcaccactgcaacctccgcctgctgggctcaagcaattctcctgccgcagcctcccgagtagctgggactacaggcgtgtaccaccgcgcctggcttatttttgtatttttagtagagacgggatttcaccatgttggccaggctggtctccaacgcctgaccttgtggtccgccacgccaggccgaagattttcataatttggaagcattgcgtttcgtaattatgctttctcgtatttttgtgatttgggtcatttttatttttatatttttaggattacaggcgtgagccatcgtgcctggccgatttgggggtaattaacaagtccacgtgtttcatttgaatttaggatagctgggcctaattgttgtctttgcttctgcggtaccttccacatagtactaaccgcctattgtaaagtaattagaatagctgaatatgcatgttaccagtctagaaaccgatttttttttaacaccccactgtggacagggtggaaactcgtttgctttcttgtttaagatctgtagtaacatgaatggatgaaattgtttcctattggattctgtaaatttatgcgttacactgattgtccaacgtggatacacccgggaggtcactctccccgggctctgtccaagtggcgtaggggagcatagggctctgccccatgatgtacaagtccctttccacaacgttggaaataaagctgggcctcgtgtctgcgcctgcatattcctacagcttcccagagtcctgtcgacaattactggggagacaaaccatgcaggaaacagccttctagagcactgaatctggattgaagtctttttttttttttttttttttggagatggagtcgctctgttgcccaggctggagtgcagtggcgcactccattgcctctgcctcccgggttcaagtgattatgctaagtgattctcctgccttggcctcctgagtagctgggattacaggcccccgccaccacgccaggctaatttttgtatttttagtaaagacagggtttcaccatgttggtcaggctggtctcaaactcctgaccttgtgatccgccagcctctggcctcccaaaatgttgggattacaggcgtgagccaccacacctggctggattgaagtcttaatacatgtttaagaaaaattggctaaaaagtagccaggcatgatgataggtagctggaggaaggagaatcgctggagcccaggagtgacctatactcaaacctatactccagtgccactgtactccaaccccaggcgatagcatgaggcccctcgttgaaaaagtttagggttttgctgtactaatagattaatatcttgttttgcaggatttgttaaggattccaagtaactcttatttggtgagtaaatctgctaattgttttttgcttatcagctctttgtcaatgatttctgtaatggaaataggattgaagagacttttattctagttggtcaggatttacctctgaggcatttaatcattctcagagcaatagccaaatatcgactttgctgcatttttgtaggcatgttgacataacttcaacatatgctctgttctgtaaaaattgctttttttagtcagctcattaaaagtgcaaagtagtaaaagctgccctagtgaactgtaggaagcctaattggctttatctacatgtgtagcctgagctgagaaagatactagcccttgaaaatactgtgggtgattagcaatattggatttgtcggttactccaattcctcactaatgagcattccaacgtggataccctgggaggtcactctccccaggctctgtccaagtggcataggggagcttagggctctgccccatgatgtacagtccctttccacaacgttgaagatgaagctgggcctcgtgtctgcgcctgcatattcctacagcttcccagagtcctgtggacaatgactggggagacaaaccatgcaggaaacatatctagtatactagattttaagttgaagtaggatcttcaggagtctaatcattatttcttttcttttaggagagaagacgatctgcacttcgcattttggcattgacatttaattttagggtcctttatatagaagggagagtaggtaaactgatttttttttttaacagggagggtttgacaatctttggcagacttggagcaaaagattgaggtgcatttcatgcctccttttgagagtcttgctctgtcgcccaggctgtagtgcagtggcgcaatcttggctgcaacctcagcctcccaagtagctgggattacaaacataagccaccacgcccagccctcatacctcttttaaaagtcgacctgttttgcagaaagtctgctgtttttgtactaaaggctttggaatttggcatttagctaggaatgcacattctttcacctcattcatactttaagaaccacagaagtgactctgcttggccagaaggcacactgtgttggtggttatattaaaagtccttgagtattttgcttttcatgatcttgctcactgcaacttccgcctcccaggttcaggcgattctcctgcctcagcctcccaagtagctgcgactacaggcgtgtagcaccacacctggctaatttttgtatttttagtagagatgaggtttcaccatattggccaggctgttctcaactcctgacctcgtgatccgcccacctcagcctcctaaagtgctgggattacagctgtgagccaccctgcccggccacttttgtatgatttctaatgtatttgtaatttacctaacaaattgcctaatctgctatgttaatgtatttatgaattaaaataaatacgactgcatgtttgtggttcatttttgtggaggtggctgtggtgacatcagccaagaatctgaatggtactgttgaaggaaactagcatgatagcttcagttctaaaggccctgaaacctagtctcaggtgggtcccccttgggttcactttatattggcagtttattgggaaaatggatattaggtcctgaccaataggaccgtaagtctgggttgagtgcaagatgagttagaccgattctttagcttcctgcagtgtagtggaggaaaaatcgatggtagcaacgggaggttgtatccctagctgatgagttgtatgagcctctactacctggcgcacctccgcctgaagattgccagaattgcttgcctcatgacgtgagtcacaatggaaactttgtcaagccccctgcactggctgccaacataaatgttcagtaccctgaaggatgggactgaagggggatcatctagaaggtaaagttacctactggcataggggaggtgggacagccgttaagccatttggaacttgatggagacaggtttgagggaggtgggtgagattggagtttggtggactgtagagcttgcttgccaaggtgttgaggtcagggttggtttgagaatggaagctagttactagctatgattgtgggggaacacagcttgatttttcttacaagctaagaggagtgaggcagtgtttaagagggcatgttaaatgcagccaggcttggtggctcacacccgtaatcccagcacttaggctaaggcaggcggatcacaacatctagagatcctggccaacgcggtgaaaccctgtctgtactaaaaatacaaaataactgggcatggtggtgtgcacctgtgggaggctgaggcagaattgctggaacccgggagatggaggttgtactgagctgagaccttgccactgcgctccagcctggtgacagagttaagtctcaaaaaaaaggcatcttcctaaagcaattgtatttgtgcttacctgtgccaggcactgttctaggtaagcactaagtgggctttaatacagcatattccaatggggaatcccaggaaccaaaagactaattgtccaagtccacaactagaagtggcacctctgcagaaacaagcatcaaattccctgctcaggaagaagccagatgagtcagccccattcgtctgtatgcccagtcccatccgtgtcctgctgtaactacatagatctcacctgagtaaagtgatttttttctgaa

SEQ ID NO: 191 - DNA, 4950 bp, Homo sapiens; identical to SEQ ID NO: 190
  source 1..4950: mol_type = genomic DNA

SEQ ID NO: 192 - DNA, 33254 bp, Homo sapiens
  source 1..33254: mol_type = genomic DNA
gattctctaactgcgcatgcttctgcgcacgcgcaatagacattccaggacttccgggcacttcgtaaggtttaaaaaggatgcttcgcgttttctctctcctttttggagacagattcgcagtggtcgcttcttctccttggtaagtgtgatccttggtaagtgtgatcagatgcttgccaccggagttgtgggtctaatgctatagatcagtagccgagcttccctaggaagatcatatagtattttatttatttactttttttttttttttgagacggagtcggtttgtcactcaggctggactgcagtgctcgttgcaacctccgcctgccgggttcaagcgattctcgtgcctcagcctctccagcagctgggattacaggcacgtgccaccacgcccggccaatttttgtattcttagtggagacggggtttcgctatgttggtcaggctggttttgaactcctgatttccggtgatccaccaccctcggccttccaaagtgctgggattacaggcgtgagccaccgcgcctggccggaaatcatgtaatttaaaactatatatgggtgtcttaggcggcatcggtcccaactctaaagtacgcgttagacgggcctgggccagaagtgggccatggagacctcgggacccgcagggctgccgcccgacccagcgagcctctgaaggtgcaccgccacccccactgtttatcttactgcctcatagtaggcacattgtcgttctcaatataattgcacacagttttattctggatcctcatttgcctttaagaattttctcaatttttctttttatttgatcgcaccactgcaacctccgcctgctgggctcaagcaattctcctgccgcagcctcccgagtagctgggactacaggcgtgtaccaccgcgcctggcttatttttgtatttttagtagagacgggatttcaccatgttggccaggctggtctccaacgcctgaccttgtggtccgccacgccaggccgaagattttcataatttggaagcattgcgtttcgtaattatgctttctcgtatttttgtgatttgggtcatttttatttttatatttttaggattacaggcgtgagccatcgtgcctggccgatttgggggtaattaacaagtccacgtgtttcatttgaatttaggatagctgggcctaattgttgtctttgcttctgcggtaccttccacatagtactaaccgcctattgtaaagtaattagaatagctgaatatgcatgttaccagtctagaaaccgatttttttttaacaccccactgtggacagggtggaaactcgtttgctttcttgtttaagatctgtagtaacatgaatggatgaaattgtttcctattggattctgtaaatttatgcgttacactgattgtccaacgtggatacacccgggaggtcactctccccgggctctgtccaagtggcgtaggggagcatagggctctgccccatgatgtacaagtccctttccacaacgttggaaataaagctgggcctcgtgtctgcgcctgcatattcctacagcttcccagagtcctgtcgacaattactggggagacaaaccatgcaggaaacagccttctagagcactgaatctggattgaagtctttttttttttttttttttttggagatggagtcgctctgttgcccaggctggagtgcagtggcgcactccattgcctctgcctcccgggttcaagtgattatgctaagtgattctcctgccttggcctcctgagtagctgggattacaggcccccgccaccacgccaggctaatttttgtatttttagtaaagacagggtttcaccatgttggtcaggctggtctcaaactcctgaccttgtgatccgccagcctctggcctcccaaaatgttgggattacaggcgtgagccaccacacctggctggattgaagtcttaatacatgtttaagaaaaattggctaaaaagtagccaggcatgatgataggtagctggaggaaggagaatcgctggagcccaggagtgacctatactcaaacctatactccagtgccactgtactccaaccccaggcgatagcatgaggcccctcgttgaaaaagtttagggttttgctgtactaatagattaatatcttgttttgcaggatttgttaaggattccaagtaactcttatttggtgagtaaatctgctaattgttttttgcttatcagctctttgtcaatgatttctgtaatggaaataggattgaagagacttttattctagttggtcaggatttacctctgaggcatttaatcattctcagagcaatagccaaatatcgactttgctgcatttttgtaggcatgttgacataacttcaacatatgctctgttctgtaaaaattgctttttttagtcagctcattaaaagtgcaaagtagtaaaagctgccctagtgaactgtaggaagcctaattggctttatctacatgtgtagcctgagctgagaaagatactagcccttgaaaatactgtgggtgattagcaatattggatttgtcggttactccaattcctcactaatgagcattccaacgtggataccctgggaggtcactctccccaggctctgtccaagtggcataggggagcttagggctctgccccatgatgtacagtccctttccacaacgttgaagatgaagctgggcctcgtgtctgcgcctgcatattcctacagcttcccagagtcctgtggacaatgactggggagacaaaccatgcaggaaacatatctagtatactagattttaagttgaagtaggatcttcaggagtctaatcattatttcttttcttttaggagagaagacgatctgcacttcgcattttggcattgacatttaattttagggtcctttatatagaagggagagtaggtaaactgatttttttttttaacagggagggtttgacaatctttggcagacttggagcaaaagattgaggtgcatttcatgcctccttttgagagtcttgctctgtcgcccaggctgtagtgcagtggcgcaatcttggctgcaacctcagcctcccaagtagctgggattacaaacataagccaccacgcccagccctcatacctcttttaaaagtcgacctgttttgcagaaagtctgctgtttttgtactaaaggctttggaatttggcatttagctaggaatgcacattctttcacctcattcatactttaagaaccacagaagtgactctgcttggccagaaggcacactgtgttggtggttatattaaaagtccttgagtattttgcttttcatgatcttgctcactgcaacttccgcctcccaggttcaggcgattctcctgcctcagcctcccaagtagctgcgactacaggcgtgtagcaccacacctggctaatttttgtatttttagtagagatgaggtttcaccatattggccaggctgttctcaactcctgacctcgtgatccgcccacctcagcctcctaaagtgctgggattacagctgtgagccaccctgcccggccacttttgtatgatttctaatgtatttgtaatttacctaacaaattgcctaatctgctatgttaatgtatttatgaattaaaataaatacgactgcatgtttgtggttcatttttgtggaggtggctgtggtgacatcagccaagaatctgaatggtactgttgaaggaaactagcatgatagcttcagttctaaaggccctgaaacctagtctcaggtgggtcccccttgggttcactttatattggcagtttattgggaaaatggatattaggtcctgaccaataggaccgtaagtctgggttgagtgcaagatgagttagaccgattctttagcttcctgcagtgtagtggaggaaaaatcgatggtagcaacgggaggttgtatccctagctgatgagttgtatgagcctctactacctggcgcacctccgcctgaagattgccagaattgcttgcctcatgacgtgagtcacaatggaaactttgtcaagccccctgcactggctgccaacataaatgttcagtaccctgaaggatgggactgaagggggatcatctagaaggtaaagttacctactggcataggggaggtgggacagccgttaagccatttggaacttgatggagacaggtttgagggaggtgggtgagattggagtttggtggactgtagagcttgcttgccaaggtgttgaggtcagggttggtttgagaatggaagctagttactagctatgattgtgggggaacacagcttgatttttcttacaagctaagaggagtgaggcagtgtttaagagggcatgttaaatgcagccaggcttggtggctcacacccgtaatcccagcacttaggctaaggcaggcggatcacaacatctagagatcctggccaacgcggtgaaaccctgtctgtactaaaaatacaaaataactgggcatggtggtgtgcacctgtgggaggctgaggcagaattgctggaacccgggagatggaggttgtactgagctgagaccttgccactgcgctccagcctggtgacagagttaagtctcaaaaaaaaggcatcttcctaaagcaattgtatttgtgcttacctgtgccaggcactgttctaggtaagcactaagtgggctttaatacagcatattccaatggggaatcccaggaaccaaaagactaattgtccaagtccacaactagaagtggcacctctgcagaaacaagcatcaaattccctgctcaggaagaagccagatgagtcagccccattcgtctgtatgcccagtcccatccgtgtcctgctgtaactacatagatctcacctgagtaaagtgatttttttctgaaccagtggttttagtatgttttcaatccatatactcaggtgggtttgggtaactgcagtgctgggcaggaaatgaatgaatttctattgacttgcaaggtagaggtgaagcaaagctgtcagtaggtgttcaggtcccactctgctaaacttcagcttgcaataccccttttttagactttccaaacaggcacttctggccttgttctttgtgtaggcagacagtattggttgcctatcttaggagtactagactgggtttgaatcctgatcccaccacttgctgttcatgagactttgggtgagttactcagcccctctgcctcaatttcatgttcacaaaataagtgataaactacctcatagagttgtaataaggacaaaggagttggtatttgtgaaaagattcttagggtctctagatggagtgcagcagcatgatcacttattaaataacattcttttgtgacttctcagaaaccaaggatacagtatccaattttttgttttttgtttttttttttttttgagagggagtctcgctctgtcgcccaggctggagtgcagtggcacaatctcagctcactgcaagctcagcctccccagcagctgggactacaggtgcacgccgccacacccggctaatttttttgtatttttagtagagaaggggtttcaccatgttagccaggaaggtctccatctcctgacctcgtgatccgcccacctcggcctcccaaagtgctgggtttacaggcgtcagccaccatgcccagcttttttttttttgagatctaatctcactctgtctccaggagggagtgcaatggagccatcttggcttgctgcaacctccacctcccgggttccagcaattctcccacctcagcctcccaagtagctgggattacaggcgcacgccaccatgcccggctaattttttttgcattttttagtagagacgggtttcaccatgttagccaggctggtctcgaactcctgacctcaagtgatccacctgcctcagcatcccaaagtgttgggattacaggcgtaagccactgcgcctagcctcaagcctgatccttttttttttttttttttttgagatggagtctttgcctcccaggctggagtgcagtggcgtgatctcagctcactgctacctctgcttcctgggttcaagcgattctcctgcctcaacctcccaagtagctgggattacaagcgcctgcaccgcacccggctaatttttgtgttttttttttcagtagagacagggtttcgccatgttggccaggctggtctcaaaactcctgacctcaggtgatccaccacgcccggcagagccttgatctcttaaccactatcctcacctcccctttccctaaggatccacaatggcctcactggctcttgaaggcaggctggcaccttgatcattcttcctggtcattagtattctgatctggttattttccattttatgtccatctaacctacttggaggatcctcaagagactgcatatgtaaactcagtacttattcttgtactgtgcctgccatatagcaagcactggctgatttaatttttctgtgttcttttttattgatttgtttttatctttattattttctttgcttattttggggttagtttgctcatctattcctagtttcttaagctagtagctgagctcattgattggagacctttctttttttctaatgtaggcatttagtgctataaatttcctccagatactgttaacaacacacaaattctggtatgttttgttttcattttaattcatttcaaaatatttttgagttccttttctattctttgatctatgggctacttgaaagtgtattattgttgttgtattagtgttgttcaaatctatccttgctagtttctttttttttggagactgcgtctccaaaggctggagtgcagtggcacaatcttggctcactgcaagctccgcctcctgggttcacaccattctcctgcctcagcgtccccagcagctgggactacaggtgcctgccaccatgccctgctaattttttgtagagatggggtttcaccatggtctcaatctcctgaccttgtgatccacccgcctcggcctcccaaagtgctgggattacaggtgtgagccaccgcgcccagcctcttttttttttttagacaagagtctcactctgttgccaaagccagagtgcagtggcacaatctcagctcactgcaacttctgcctccggagtagctggaattacagtcacgcaccaccacgcccagctaatttttttgtatttttagtagagatggggtttgcgcggctgaagtgcagtgatgcgatctcagctcactgcaacctctgcctcccaggttcaagcaattttcatgcctcagcctctggagcagctggtactacagcatgcaccaccatgcctggctaatttttttgtattttagtagagatggggtttcaccatgttgcccaggctggtctcaaactcctgagctcaggcagtccgcctgccctgacctcccaaagtgctagaattacaggcatgagccaccgtgcctggccttattttaaaattttatttcttgtaggtaacatgttgggtttttcagtatgacagtctatgtcttttaattggagtgtttaggctatttactttttttttttaagacagggtctcactctgtcacccaggccagagttcagtggcaagattatgactcactgcagccttaaactggaactcctgggctcaagccatcctcccagctcggtctcctgagtagtgaagaccacaggcatgtgccactatggctggctaaattttgtattttttgtagagacaaggtctcatgatgttgtcccagctggtcttgacctccagggctcaagcaatcctcccaccttggcctcccaaagtgctaggaatacaggcatgagtcaccatgcccagccatattatacatttttaacttacaatagtccacattcaattgatattaaaccagttcacttgtagtataagaatcttccccagcctggccaatatggtgaaaccccgcctctactaaaaatacaaaaaaaaaaaaattagccaggtgtggtggtgctcgcctgtagtctcagctacttgggaggctgaggcagaagattgcttgaacctggaagcagaggttgcagtgagctgagatcgtgccagcctaggcaacagagcaagactccgtctcaaaaaaaaaaaaggcggggcccggtggctcacgcctgttatcccagcattttgggaggccgaggcgggcggatcacgagatcaggagatcaagaccgtcttggctaacacggtgaaaccccatctctactaaaaatacaaaaaattagccgggcgtggtggcgggtgcctgtagtcccagctactagggaggctgaggcaggagaatggcatgaacccaggaggtggagcttgcagtgagccaagatcgcgccactgcactccagcctgggcgacagagcgagactccgtctcaaaaaaaaaacaaaaaaaaaaccttctggcggcctggtgtggtggctcacacttgtaatcccagcactttgggaggctgagactggcggatcacctgaggtcgggagtacaagaccagcctgaccaacatggagaaaccccgtctctactaaaaatacaaaattagccgggcatggtggcacatgcctataatcccagcaactcgggatgctgaggcaggagaattgcttgaacctgggaggcagaggttgcagtgagccgagatcatgccattgcactccagcctgggcaacaagagcaaaactccatctcaaaaaaaaaaaacaatcttccggctgggcacagtggctcacgcctgtaatccatcccagcactttgggaagccaaggcaggcagatcacgaggtcagagcgagactccgtctcgaaaaaataaataaatatttcttccatttctcactatatagtctttgatattgtcatgtgtcttacttttatatatgttataaaacccacagtacattattacagccagaacctccatatcagccagttgcgatggctcactcctgtaattccaacactttgggatgccaaggcaggctgactgctgaggctcagaagttcaagaccagcctggccaacatagtgaaaccctgtctctaccaaaaatacaaaaattagatgggcaattagctggacgtggtggtgcacgcctgtaatcccagctactcgggaggctgaaacaggagaattgcttgaacccaggaggcagagattgcagtgaactgagatcacgccattacactccagcctaggcaacagagtgagactccgtctcaaaaaaaaaaattagctgggcatggtggtgcacatctgtggtcccagctactcgggaggctgaggcagaggttgcagtgagccgagatcctgccactgcactccagcctggatgacagagtgagactcttgagacaaacaactggggctgggcgcagtagttcacacgtgtaatcccagcactttgggaggccgagatgggtggatcacttgaggtcaagagctcaagaccggcctggccaacatggtgaaaccctgtctctattaaaaatacaaaaatgagccgggcatggtggtgcgtgtctgtaatcccagctactctggagactgaggcaggaaaattgcttgaacccagggggcagaggttgcagtgagccgagattgcaccactgcactccagcctgggcaacagaatgagactccatctcaaaataaaataaaaaatacaaatacaaaactaaaaaaataaaaataaaggccaggtgcagttgctcatgcctgtaatcccagcactttgggaggccaagatgggcaggtcacctgaggtcgggagttccagaccagcctggcaaaaatggtgaaacccggtctctactaaaaatacacaaaatggccaggcgcggtggctcacgcctgtaatcccagcactttggtaggctgaggcgggtggatcacctgacgtttaggagttcaagtccaggctggccaacatggtaaaaccccgtctctactaaaaatacaaaaattagctgggcatggtggcaggcgcctgtaatcccagctactcaggaggctgaagcaggagaattgcttgaacccaggaggaagaggttgcagtgagctgaaatcgtgccattgcactctagcctgggcgggtcaggagttcgagatcagcctggccaacatggagaaaccccatctctactaaaagtacaaaaattaaggctgggcgcggaggctcacgcctgtaagcccagcactttgggaggatgaggtgggtggctcatgagatcaggaattcaagaccagcctggccaagatggtgaaaccctgtctctactaaaaatacaaaaattagctgggtgtggtggcaggcacctgtaatcccagctacctgggaggctgaggcaggagaattgcttgaacctggctgcagtgagccgagatcgcaccactgcactccagcctgggcaacagagtgagaccccatctcaaaaaaaaaaaaaaaaagagttgaggtctccttccaccacttgtgtgaagaccccagaaaacttgctttacctctttaaacttcagttttcttatcttccaactgccatgaggtttttgtgaggaacaaatgagctgacatggatgtttctgtagttaacaaaataaagggtcttacaaaataggcaataataataataatcacttattattattacatgaagctacatgaatgtgtaagatcttggaggaagacagcagagagagagagagagatcagagatcccagggttaaaagttggagaaatttcacagtacatcatccaaaagaggagtccatgatggaggcagaggtaaacttggagaggtaagaaaccctgaagacaggggagtgctttgtggcaggctctgcatataagaattcagcctggccaacatggcgaaacccagtctctactaaaaatacgaaaattagccaggctttgtggcaggcacctgtaatcccagctatttgggaggctgaggcaggagaatcgcttgaacctgggaggcagaggttgcagtgagccgagatctcaccattgcactccagcccgggtgacaagagcaagactcgatctcaaaaaaaaaaaaagttcagttcagttggtaagaactcatcaaaagtgtccatctagactttgggtgccgtagaatgactcagagtctgaatcaacatgaaatcgagaaaacgtcctttgcaagggtttcagggaacacctgaaatcctgaagaactgtttgtatccatcctgaagaatgggtgttaataagagacagccttttcttggtacctgttttccatctctaacccaaccccaactcacacccttctattttatctggtctctctcattcctcttgctcctccccacttggctcccgttttccccaagtccattctctattttgttctataagatctgatcatattaggatgctcttgtagctcataagaagatgactgggtgttcacacgcatatgagatgtgcctccctcaaaccttgttaagacatgggcacatacccatctgatgttaactcacggggaaaaaaatctgatcatgccattcccgtgcccaaattcccatatatccctactgcctcaggatagaggctggaccccttagacacacaagaccctgtatccatgatctgtcactcccacaggcaccctctactcccatctacttggcagtttcccacaacctccctgggttctcgtggttccctgtcattgcaaacgtcgcttctcctaggatgtcctgcccccctagacttaacttggaaagctgttcttaagccccggactgagtcagatgcccctctgggtatccctgtcatagcgttgtgtggttgttgatagtctgatttttcaaccttctccatgccctcttgagggtagggaagatgagtatcttttttctccgtacagaccctaccgcacaagattttcctaaacagaccgaactcaaggagtctttctggttgttagtccacgtgtcccgatttggggtttccaaaatacacgcccactggaaccgggccaggggagccagcctggccaagggctcccccagcccggccaagggctcccccagcccgggagcgcgccacatgcagatcctgggatggccgccaggggccgccgggctctttgttttcctttctcacccgggtcggggccagaggcctgcagagcgcatgctctggggcagttcgcggcccggcggggagcgccggagttccttgtggccgacgtgcaccaaggtaggtctcgcctgggacgcgcggagggtccgggcagagggcggtaagcggagcggccacagccggagcacgggccggtccacgcgggcctaagtcgctgcccgctctcgcccgtgtcgcgcggcgccggccccacgtgaagcccggaggcaggaaggcgcggtgcgggctcgcgattccccggccccgcggggcgctccagcagcggctgggcgctgcctcgctggagctagggccgcgcggcccctccgccgccgcgcctctcacgcccgcaccgcggcgcccgcgcaggcgggagattcaaactgcgcgagcgcggcgggccgggtgcgcgcggccgcccgggcgggggatgggtctctgccgcgaggaggatggttttgtccggcatgcgcttggagaaggcggtttgcagatcggggagggagccctgcccgggagagggtgggtcgtaggagctcgagggtctcccgctgtggacctttgggagccgtgtgtcttgaactccgcagcagctcagtctgtcagcagattatttgctggccatttattgcgtccctctcttgcggggctgggggacagtagtgagaagagcaggcccgtgtcattagcgaactatgcccttgaacccaggcgacggacgctactggcaagtcattcatacgtcacatattgacctaacttcgaccacgtgtgacttgtgtgccctagcagaagttgagtgtgtggggtgttacggggagccctcagggggatcccccaccctgcccaggaggctcagggatggctttccaggtgaagtgactcttgaatggggttttgaaggaacagagtttttcaggcagtctgagggtagtgggattagggtgatacaggcagagggattgcacgtgcaacggcatgaaggtataggtattgtggtcagggataccacaggtcttgaggtgactggaggaggagagtaacaagatgatacagcaggggctgggtcacgaagcgtcttgtgtgcaagactaaggaactctgcggggtggaggaggcagggaagatttcccccaagaagggtatcagagtgaaacctggacagatgaattaggagttcacgaggctcctgtttcaaagacatcccaagagcaggaatcctgttctgttcatcgttacaactttctcatcagatgcccttgggcaacccacccagtcccccagagcattggtttccttatctgtaaagcaatggtagggggcatgtggtgaggatataatttttttttttttgagacggagtttccactcttattacccaggctggagtgcagtggcgcgatctcagctcactgcaacctccacctcctaggttcaagcaattctgcctcagcctgctgagcagctgagactacaggaacacaccaccaggcccagctaatttttgtatttttttttttttagtagagacggggtttcaccatgttggccaggctggtcttgaactcctgacctcaggtgatccacctgcctcagcctcccaaagtgctggaattacaggtgtgagccaccgcacccggccaattttttttttttttctgatacagaatcttggtctatcgcccaggctgtagtatagtgtcgtgctctcagtcgctgcagcctccacctcccgggttcaagcgattctcctgtctcagcctcccgaatagtaatatcctataattttcataaagcagtgaagttgtgtgtcccttcccccaggaaaaatgaacacataggcccaggcacaggttgtatagaacggggatcccaggtgagaaactcctagtgtgaaatataccacctgtgtgcctggcataacagcagctcaccaaatgtatattgttgacacatgagccctctcctcccttccctcctggggaccttacacacagagatttttcagccttagtctggcaggcaagttcttcctcctggtgtgggggacggagggcacagctgcagtggcctgggagggctctgtctccttttacagaaatcgaggctgtggtgaggtcactggaggtcagggcaggagcaccaggctccgggcagactgtctagactggcgtgcctacccactttcttcaataaataaggaaggtgaggtgggggtagggcagctccagctctggtggagcatggtcatgagactgggatttcattccacctctctgtgacctgggtcacctttccctgagcctcatcttccccttagctgtaaaactgggatgagtctgctcacctcaaagggcagctgtgggcattcaggagtgcctgatggtggaagctgactctgtagccgacttatctgtgactgtctcactcttctcccagagactgtatgctccttgaagatggaagctgtgttgtgtggggcggggtggggaagcatgatgccaaaagccaactccttattcccagcccagacactcactgcctggttaagaaaacagccagagaggccgggctcggtggctcacgactgtaaccccagcaatttgggaggccaaggtgggcagatcacctgaggtcaggagttcaagaccagcctggccgacatggtgaaaccccgtctttactaaaaataccaagcagttagccaggcgtggtggcttgcgcctgtagtcccagcactagggaggctgaggcgggagaatcgcttgaacctgggaggcggaggttgcagtgagctgagatcgtgagtctgaactccagcttgggcaacagagtgaggctccatctcaaaaagaagaaaagaaaagcaaataaaggaaaacacacccagagcagtgagagaagtctgtatacaagacccatttgtgcagtagaggctgtgcaggcaggtaccgggaacagggctccaccttttagaaggtggtcctctggccgggagcagtggctcacgcctgtaatcccagcactttgggaggccgaggtgggtggatcatgaggtcaggagatcgagaccatcctggctaacacggtgaaaccccgtctctactaaaaatacaaaaaattagctgggtgtggtggcaggcgcctgtagtcccagctactcgggaggctgaggcaggagaatggcgtgaacctgggaggcggagcttgcagtgagccgatatcgcgccattgcctccagactgggcgacagagcgagactccacctcagaaaaaaaaaaaaaaaaaaaaaagaaggtggccctccatcccctgcccttccctggcgattgccagcccagtgcagggcctcaagtcttccattttggagaggaagcctctgggactcaaagagcactcaggtgccgtctccaccgcagcagggagttgtcgccactgtccttccccacatctgtgggtggatctgtcaccacccaccccaccttccctcaggctctagctgcctcattgtctcctctctggtctcaccatcctctcctcagctggcttctgctctctgcttcttggacttggccaagtgcataggggatactggggaggcctgcccagactgccttagcccctgcctggaccaaggtctgccttcagaatcagtcagataggcctgggttgcttttctaggctgccctttacttgctctgtgaacttaggccgataaagttatctttctgagcctcagttccttaactgtgaaataggagtgacagtgctgccttcttcagcttcctgtgaggaataaaagggttttgcatatggaagatacagtgagttagccggtgcccccaggggctcatattttaggaagttgattggtatggtggacaggcatgtaaattaaagtgattgtgatccaaaagtctgtcccagtttctcagagagaatgactagttcaggatggaggagggatcagaggaggtgactttgagacaccagtagatgttcttccagtgggataagggatgggaaggcgttccaggtaaagagatgcaaatagtatggagaggacagttagcattctggcctggtgggtctggcaaggagattgtgtgggaagagaagggaggatgtgatagataggaaatgaagctaaaggttctgtcagtacccgatgttggagacctctaatacccagctaagaaatgtgggctttatcttccaggaaaaggggaccactaaggagtccaagcaggccagcagcttgcttcaggtttgaggtttggaaagatcatgaatgaggccgggcatggtacctcacgcctataatcccagtactttgggaggtcgaggtgggaggatcacttgagcccgggagtttgagaccagcctgggcaacatagtgagaccttgtctctacaagaaaaaaaaaaattacaaattagccaagcgtggtggtacatgcctgtagtcccagctactctggaggctgaggcaggagggtcgcttgagcctaggaggtggaggttgcagtgagccgtgtacgtgctgctgcactacagcctgggcaacagagtgaaaccctgtctcaaaaaaaaataaatatatatatgtatatatatacacacacacatatttattgatcacgaatgacttggagaatgagaggaggggatgagggtggggaccggaagaccagtgaaaagttgctgtctttcctagggaaaggaggaggagacacagttccaggcaagctgagagactactagggagcatggggaggaaggaggcagaagaaatttcttttttttttttttttttttttgagacggagtcttgctctgtcacccaggctggagtgcagtggcgtgatctcgactcactgcaagctctgcctcccgggttcacgccattttcctgcctcagcctcccgagtagctaggactacaagcgcccgccaccacgcctgtctaattttttgtatttttagtagagacggggtttcaccgtggtctcgatctcctgacctcatgatccgcccgcctcggcctcccaaagtgctgggattacaggcgtgagccaccgcgcccggccagaagaaatttctaataacactcaaggacgccagctctggagtctgactaacttggttcagatcttggccttctcttccaatcttgagtgagatacttcacctttctgagcctcagttttcttctctgtagagtgggatcattgtggccagcttgtagtgaaacgctccagaatattagccaaacacaactaaggagatgttgactgggtttgttccatccatgataacagattttttggttaatgccccatgacaccaacacttcatatagcccttatgtgtctgactccattccgggctgtgctcatggcagcccagccatcagcaccaactgtgctgacataattgtttcctgctttttctcctgacttcttattgtgagtacttttcatgctaatacagtctccctcccaggcacagcagactgctacagattattctgatgaactgatgagatgtttgccttggcatacagctgtctatctaaaacaagggtgcctctttttttggtggagggacagagtttcactcttgttgcccaggctggagtgcaatggtgcaaactcggcttaccacaacctccacttcctgggttcaagcgattctcctgcctcagcctcccgagtagctgggattacagcacgcgtcaccacgcctggctaattttgtatttttagtagagatggggttcctccacgttggtcaggctggtctcgaactcctgacctcaggtgatccacccgccttggcctcccaatctgctgggattacaggcgtgagccaccgtgcccggccacaaagatgcctcttatatcccacatccctaccccatctaactttgcctgcctgacatcctttctgggatggctcccaagcacttcagattgaatgaaaacacctagcaacatggagcttcacgtctcttctctcctgtttgttcaacagtgttctctatctcactacatggaagtctaccatctacctggtcatttaagcccaagcctgggagtctttgtgtttggccaagctcatagggggatcttgggcaggcctgccaagaatcctctggacttttttaggatgaacaaatcaagccaagtgctgtggcacgtgcccatgatcccaggctcttgggaagctgaggtgggaagatcgcttgagtccatgagttcgaggctgcaataagctaattgcaccactgcactccagcctaggtgacagagtgagaccccctctcttaaaaaaataaaataaaaggccaggcatggtggcttacacctataatcccagcactttgggagtccaaggctagagaatcgcttgagcccaggagttcgggaccagcctgggcaacatggcaagacgttgtttctgcaaaatatacaaaaattagccgggcgtggtggtgcacacctgtagtcccagctatccaggatggctcaagcccgggtggttgaggctgcagtgagccatgaccatgccactgcactcaagtctgggcaggaccctgtctcaaaaataaatacaaaggatgaacaaattatgagagtaaaaaagggttagtctcctttatccttgctacacctcctcacccaaagccaagcagtagtgtagcaggataagccgcagacaaaaccccccagacacccagttaaagaaggaagggctttattcagctgggagctttggcaagattcacgtctccaaaaactgagctccccgagtgagcagttcctgtcccttttaagggcttacaactctaagggggtctgcatgaagaggtcgtgattgattgagcaagcaggggatatgtgactgggggctgcatgcactggttatcagaacggaacagaacaggacagggattttcacagtgcttttccatacgatgtctggaatctatagataacataaccggttaggtcaggggtcgatctttaaccagacacaggtcgcggcgccaggctgtctgcctgtggatttcatttctgccttttagtttttacttctttggaggcagaaattgggcataagacaatatgaggggtggtctcctcccttagtagtaaagcactataaatatttgtggatttacaaccatttcattcagtcttgatgacagccctgagaagtagtcattgcatccccttttatagatgaggatacagttcagagaggttaaggcaactggccagccacaagctctggaaggtgaacccagttccctctaatcccaaagaatgtgcactttttagtgtgggacaaggggtctcaaaagacaggtgggaggattctcagccctgggagaataaaagttgggtgaagttcagaactgccacctcatcagtcagaactgggccagtgacaacctgcagaagctcagcctgcaaaggcttatcaggattctagacctttggttactttcccatctttagtatttagttctccttccccaggataatcagcagaaaagtgcctggccttgtgtccatataccatggaggggagagctagagaggcgaggttctcgggaaccactagaaggaaggaatgagggggctgctggttaggcccagagctgagaccgagaagggctcttggagttctccttcccttcgtaacattaggtagaggcttagacaacttgattgtttttcatgaccttaaagactgtggctccggccgggcatggtggctcacagctgttgtaatcccagcactttgggaggctgaggcgggtagatcgcttgagcccaggagttctagaccagcctgggcaacttggcaaaaccctgtctctacaaaatatataaaaattagctggacactgtgatgcgcacttgtagtcccagctattctagaggctgaggtgggaggatcacctgagctcaagaggtcaaacctgcaatgagccgtgattgtgccactgcacttgagcctgggcaacagagagtgagatgctgtctcaaaaaaacaaacaaacaaacaaacaaaaacaagtacttgatgactccattggggtcaattatgaagagacctcttagtgcaagaccaggaccttctaacagcacaccgaagtctcgagaaattcgcttagttaaatctgacaagggtgcgatgtttatgtggcccaaagcaccattctttcttggtgtatttatccaggcaagacggctaaagtgggaatccactgagactgcaacaacttcaaagttcacatcgtgaaattccttagctttgtcactagaagcaacaatttctgtaggacacacaaaggtgaaatccaaaggatagggctgggcgcggtggctcacacctgtaatcccagcactttgggaggctgaggtgggtggatcacctgagttcaggagttcaagaccagcctcaccaacatggtgaaatcccatctctactaaaaatacaaaaattagccaggcgtcgtggcaggcgcctgtaattccaggtactcaggaggctgaggcaggagaattggcttgaacccaggagggggaggttgcagtgagccgagatcgtgccactgcactccagcctgggtgacacagcaagactccgtctcggaaaaaaaaaaaaaaagaaagaaatccaaaggatagaagaaaagcaccaaatatttcccctcaaagtcatcaaggcttaggtctttgaactctccattgaccacggctgtacccttaaaatagggcgcatgctgggtgacatcaggtgcatggtatgaggaactggtaccagaattttgcttgaccggaaccagaccacaatatgtttgtcaaacttgttcttccagaagcagcaggcctgagggctgcagtggcagaaatgcccccaaggaatggcactcacatgccgggcaactgatgctcagagtaaccttcccacagcagccgcgatcttcagtgcatgtgtgtttttgtttttttgagacagtgtctgtctctttcgcccaggctaaagtacagtggcacaatctcagctcaatttagcctcagcctcccaggctcacgccatcctcccacctcagcctcctgagtagccaggacttcaggcgtgcaccaccatgcccggctaatttttgtaattttttggatagaaatggggtttcgccatgttgcccacgctggtcttgaactcctgggctcaagcgatcctcctgcctcgacttcccaaagtgctaggattacaggtgtggtggcaccttgtctctaaaaaaaatcaatcaattaaataagaaaagaaaatagctcttctccccctctgattataacaacacattaccaaagttactggtgcttacatggggttgaatggagttatgatggatatttcatttaatgttgttcttcaatgttttaattttttacaacagacttaaaaattttttaaatacatgtggccaggcacgatggctcacgcctgtaatcccgcactttgggaggccaaggtgggtggatcatctgaggtcaggagttcaagaccagcgggaccaacatggagaaaccccatctctactaaaaatacaaaataagccgggcgtggtggcacatgcctgtaatcctagctactccagaggctgaggcaggagaatcacttgaacctgggaggtagaggttgtggtgagccgagattgcgccatggcactccagcctgggcaataagaacaaaactctgcttcaaaaaaaaaaaaaaaaaaacatgtaatcggctgtacgcagtggctcacgcctgtaatcccaggacttcgggaggctgaggcaggtggattacttgagattaggagtttgggaccagcctggccaacatggtgaaaccccgtctctactaaaaatacaaaatttgggctgggcacagtggctcacgcctataattccagcactttgggaggccaaggcggggtggatcactgagatcaggagttcgagaccagcctggccaaactggtgaaacctcgtctctactaaaaatacaaaaattagctgggtgtggtggtgggtgcctgtaatcccagctactcgagaggctgaggcaggagaatcacttgaacccaggaggcagaggttgcatgagccgagatcgcaccattgcactctagcctgggtgacagaacgagactccatttcaaaaaaacaaaaacaaaacaaaacttagcagggcatggtgatgcacacctgtaatctcagctactcggaaggctgaggcacaagaattgcttcaacccgggaggtggaggttgcagtgagctgagatcatgcctgtgcgctccagcctggcgacagagtgagactccgtctcaaaaaacagaaaaatacatgtaatgctccttgttaaacatcttagataatataggaagataaaacgaaacaagtaatgattatctataataccattttccgaggttaccattgttaatatgggatatattttcttccccacatttttctcacatattttttgtgtatgcattttttttccaaaaaaaaaaaaaatggatgataggctgtttttcttccttttttttttttttttttttggttggggggtggagtttcactactctttctcccaggctggagtgctgagtgcaatggcatgatcttggctcaccgcaacctccacctcctaggttcaagcaattctcctgcctcagcctcccaagtagctgggattacagtcgcacaccaccatgcctggctaatttttgtatttttttttttttttttggtggcgacggggtttcaccatgttggccaggctggtctcgaactcctgacctcaagtgatccacccaccttggcctccgaaagtgccaaagtactgggattacaggcgtgagccaccgcgcccaggctttttttttttttttttttttgagacagtctggctctgttgcccaggctggagtgcagtggctcgatcttggctcaccacaacctccacctcgcgggttcaagcgattctcctgcctcagcctcctgagtagctgggattacaggtgcccatcactgtgcctggctaatttttgtatttttagtagagacggggttttgccatgttggccaggctggtttggaactcctgatctcaggtaatccgcccgccccggcctcccacagtgttgggattacagatgtgagccaccacacctggccgtctgtttttcattctgcttgttttacttggcaatggggaacatctttctattcaatagattgatctctgaaaacatcacttttgatggcttcatactgttctatcatgaatataccacatatttagttcactactattgaacattcgggttctgtttttgttgtttttaaaatgttatgaaggatacagtagagaatatttgtgtaattaatctgtgggtgcatccattattctgttcttgggatacattttgagaagtggaattgttgggcaattcctcttaacgtatttctagagtgtttgataaatattgtctgattggcccaggaaaatgtttgccatttctcatatgtagtatttgactgactttcaggacaggaagatgtcacccaagcgcatagctaaaagaaggtcccccccagcagatgccatccccaaaagcaagaaggtgaagggtaagttggccttggcctctttgtgggtacaggtggccccttgaaaccctaagaacccgggactgggctcctttcttcctgaggcttgaagctgaagggtgtggatgtgcagagaccccacccagctggaaggtttcctgtagctcattgaatcctaccctctgggaatcacaaagtgggcagaaactcctctcaaagcactcaggcagcactggcacaaaaaaaaaaaaaaaaaaactagaccctagggcttcaccccaggcagtgatgcattatggttaggaccactgactttccgacatgggttcaagtccttgctctgccactttctagctgctgggcaagtcacttaatcccgcagtttggattatcaacttcttaaaatggcggcagccagagcagcgtcaccctctctgggctgtgtgaggatgagatgagataatggcctggcagcatttgagggaggtggctgtggtttcctctgtcctgggaccccggagggggacagggaggagagaaaagccagcaccaaactgggaggggaagtgtggacccacgctcagacagtgtctgtcttttgcagacacgagggccgctgcctcccgccgcgttcctggcgcccgctcctgccaaggtgcctgcgggccgagccctcctgaccagaaaacccgaccaggtggctccgcgcccggggcgccctctgtgctgccagcgcgggctcctcagcggtggccacatcctcgggggaggggctgggcgccattggctgcccggggctgcgggttggggggccgcctttggcccacagagagccccgggcgcgcacctcccgcaaatgccgctgtccgctcttcctcccgcccctcctgcctctccactggatggtggagggaagagtccgtttctgcagtggatttgcccgggagctgaacttattcactggcggacggcttgggcatggaggagggcttggatggagactggggattgttctctgacccacgtagtctcccttgctttcggtgcagattctgctattataattagctttctgcggggcaaggtggctcacgcctgtcagaagatcgagaccatcctggctaacacggtgaaaccccgtctctactaaaatacaaaaaattagccttgcgcggtggcgcgcgcctgtagtcccagctactcaggaggctgaggcagaggaatcgcttgaacccgggaggcagaggttgcaattagccaagatccaccactgcactccagactggcgacaaagggagactccgtctcaaaataacaataacaataattagctttcttttctttttctttttttttttttttttgagatcaagtatcactctgtcgcccagactggaggcggcagtggcacgatcttggctcactgccacctccgcctcccaggttcaagtgattctcctgcctcagcctcctgagtagctgagattacaggctactgttggcaaggctggtctcttaactcctgacctcaagtgatccgcccgccttggcctcccacagtgctaggattacaggtgtgagccaccgcacccagcccttcttgccctctccaccaagattcatttcacagtatccagtgtctccttgtttccctttctcccctttcacgtgaataatgtgctcagttcttaatctccacaaaaatcctgtgagagaggtacttttgttgtccccatttcacagatgacaaaacttagaaagttcatactaacagtctgtggcagagcaggggcttctgcacaggtttgtctgatcccagagcctgtgacctctcctcgctgtcgtcatcctctacactcagggtctatcttcttcacccttcagtctcacacaggtcccacagcacagaacccggcttggtgctgacactaggccagggcgacgtgggccagctggggctgggtgagaatgtgatggagaggaagaagccggccctggtatccattccggaggatgttgtgcaggctgaggctgggggcatgcacaccgtgtgtctaagcaaaagtggccaggtaggtgttggggactggcacagggttggacaaggcctggggttgggtggcttggggcagggcttttgaaccacgcatgttcactgtggaaatggagctggctagtcaagtggggagtggcctacatgagaatggactgcgaggccagacgttgcattaatgagggcatcctgggcacaggtctattccttcggctgcaatgatgagggtgccctgggaagggacacatcagtggagggctcggagatggtccctgggaaagtggagctgcaagagaaggtggtacaggtgtcagcaggagacagtcacacagcagccctcaccgatgatggccgtgtcttcctctggggctccttccgggtaaggctgggtctgaaagtctgcatggtccctgaaagacagaattaattggcggggccccaaagataatccacttccatgcccccatggtacttactggtggggagatgaaagcccacaggtagagctgaggcccagacccaggactctagcttcctcatgtgggcctgtccacgccactggctgcttccttgaatccgatgtcatcaagtgtctgtcctgggaagtgagtgggtcaaggatgtccctgggttgaggctgatccaggaggcctgctgtcttcacccatctccctgacttctgtctccccctcaccttgccagcactgcctcttccacacttcccagaggcttggatggggcaaggaggtgtggaggcagggattgtcgcatctcagagtttccaaggtacagaggagtgtagttgaaaaaacagattgtgggtttttgttgttgttgttgttgttgtttttgtattgttttgagatggagtttcactcttgttgcccaggctggagtgcaatagcgcaatcttggctcactgcaacctctgcctcccaagtttaagtgattctcctgcctcagcctcccaagtagctgggattacaggcatgcgccaccacgcctggctaattttgtatttttagtagagacggggtttcccctgttggtcaggctggtctcgaactcccgaccccaggtgatccacccgcctcagcctcccaaagtgctaggattacaggcgtgggccaccacacccggcctgatgggtgtttccttatcacatctattttgaaattttcatggagaatttcaaacacatgaaagtaatcagaattgggctgggcgcggtggctcatgcctgtaatcccagcactttgggatgccaagatgggcagatcacgacgtcaggagatcgagaccatactggctaacatggtgaaaccccgtctctactaaaaatacaaaaaattagccaagcgtggtggcgggtgcctgtagtcccagctactcgggaggctgaggcaggagaatggcttgaacccgggaggcggagcttgcagtgagccaagatcgcgccactgcactccagcctaggggacagagcgagactccatctcaaaaaaaaaaaaagaagtccgggcgcagtagctcatgcttgtaatcccagcactttgggaggccgaagcaggctgatcacctgaggggtcgggagttcgagaccggcctgaccaacatggagaaaccctgtctctattaaaattacaaaattagctggacatggtggtgcatgcctgtaatcccagctactcgggaggctgaggcaggagaattgtttgaacctgggaggcggaggttgcagtgagccgagatcgcgccattgcactccagcctgggcaacaagagcgaaactctgtctcaaaaaaaaaaaaaaaaaaaaaaaaaggaagtaatcagaatatcagaattatatttttttcttttcttttcttttcttttttttttttttttttttttttttttttttttttttttttttttttttgagacagagtcttgctctatcacccaggttggagtgcaatgacacaatctcggctcagtgcaacctctgcctctcgggctcaagcaattctccttcctcagcctcccgagtagctgggattacaggcatgcgccaccacacctggttaatttttgtatttttagtagagacggggtttcaccatgttggccaggctggttgtgaatttctgatctcaggtgatccgcccgtctgggcctcccagagtgctggattgcaggcttgagccgccacgtctggcctcttttcttttttctttgttttgagacggagtctcgctttgtcgcccaggctggagtgcagtggcgcgatctcggctcactgcaagctctgcctccctgattcacgccattctcctgcctctgtctcccgagtagctgggactacaggcgcccgctacaacgcccggctaattttttgtattttttggtagagacggcatttcaccgtgttagccggaatggtctcgatctcctgacctcgtgatcgcccgccttggcctcccaaagtgctgggattacaggcatgagccaccgcgcccggcctcttttcttttttaattagagacgagatcctgctctgtcacccaggccagagtgcaatggcatcgtcttagctcattacagcctcaacttcctgggctcaggtgatttcttccacctcagcctcgcaagtagctggtactagaggcttgtgccaccacgcccagctaatttttgtattttttgtagggacggggtttcaccgtgttgcccaagctggtcctgagctcaagcgatctgcccacctgggcctaccaaagtgctaggattactggcatgaattaccatgcctggcccagaatagtatattgagtgcccatttacttgccacacagtttcaatgattatcagcttgtggccagacttgtttatctctatttgcatccgctctctgactccttgattattttaatgcaagtcgcagaccataaatgatttcattcataagtatttgagtatgtggcctggctcctgcccacttctccatccccatctggtgccactgcccttctggatttcactggcacggggcaggcaggactggctgataagtgccctgtccctcccttctaggacaataacggtgtgattggactgttggagcccatgaagaagagcatggtgcctgtgcaggtgcagctggatgtgcctgtggtaaaggtggcctcaggtgggtctgggggcacttgctcagggcaggagttggaggaccttgttctggggctggcctagccttgggccttacagttgtggcctgcatcccttaccttttcatccttaggaaacgaccacttggtgatgctgacagctgatggtgacctctacaccttgggctgcggggaacagggccagctaggccgtgtgcctgagttatttgccaaccgtggtggccggcaaggcctcggtaagtggccttggtacctccagcagggcaaattggcaggccacccccacagtgaaggccaaaggcaggaaggatttgctgtggtcaggcttgcatcagatgggcttgtggtgttggttaggactttggagacagactgctctggtagttttgccacctactgtctatgggactctgaacatagtttcttcatcactaagtctacctacctgtaaacctacttcattaggttgctgtgaagttaaatgagttaatgagaagaatatcaggcagatggtaagttccacgtaaatgatacccgtaatgactgtgggaatctgagcaaggcacttgtattctcttgatctcagtttccttttctataaaatagggataagagtccctacttagcctctcaagggcttttataatggaggagaattaaactcggggcagagagaagccatgtgtgtctgtctgtcactgaccgtggctttccctttgcctgcagaacgactcctggtccccaagtgtgtgatgctgaaatccaggggaagccggggccacgtgagattccaggatgccttttgtggtgcctatttcacctttgccatctcccatgagggccacgtgtacggcttcggcctctccaactaccatcagcttggtgagccccgagcccagcttcaggcatgacccagtggcctgcgttcctgtcctggctctgccactcattcattgtgcatcctttgcggggtcgtctaacccctccaagccagttttgtcatctgtaaagtgagaatgtccatatcctgatgggaggtggcctcactgtgggaggagattgagaagggcagctctcagaacaccttcacccctgatggctccggcctttcccccaggaactccgggcacagaatcttgcttcataccccagaacctaacatccttcaagaattccaccaagtcctgggtgggcttctctggtggccagcaccatacagtctgcatggattcggaaggtagggcctttacgtccttctctagtttgggggtggagtgttccctggcctaggcctagccagattcctgagaccatggtccttggagcctgggtctgttccatgggttgtaccatacatgggtccatgagagtcactctcatcctcctagagtcctggtgttcttccaagtgtgagttcaatgggggcccatgtagattctcctaggcctcctccaaaactgggaagagacactgcagatctccttctgatcgctctgggagcagggacacactcccatggacaggtggactcacctagcctgccacccattttgcctgtagcacgccctctgctattgctcatctctctccctcctcccataggaaaagcatacagcctgggccgggctgagtatgggcggctgggccttggagagggtgctgaggagaagagcatacccaccctcatctccaggctgcctgctgtctcctcggtggcttgtggggcctctgtggggtatgctgtgaccaaggatggtgagtggggctgcctacactctgtctagttgggacctgggggtcatggttcttacccaattccccaataggctgtgatgtccactctcgggggagccgaggtacagagagcagtgtttgtgatggcactttgttcctgcttctcagaagctctggcattgatgaatatgaaatgagtacacaaattattttagtaaaggtgacttattatgcagaggagagaaatagcaaagagtgagatatcactgaggcctaaggaggcaatgggactggaacccaagtctccagactcctaacccaggctgctctctcccctcagggtgaccccttcatatatcaccttgtatgttcccgctttccagggacttttacttagaatctaaatcaagaaaaaaaaaggcttagtagtcagagttgtagcaactatagcagaggagggtgtgaacaagtgaccaccaaagcctgagtgggtgagggggatagccatggaggtcctgtagaagcctggagctggcagaggtgcttgacctgaggttatctgggaagacttcctcaggaagtggggcttgcactgtaccttgaaggttccattccttgtgaaaagcaaagaatgccattccaggcagaggaacatcagggcagtctcaaaggtggctggtcctgggaacagagggtggggtaggaccttgaatgccacgcctaggagcagcctttggcagtgtgtagggactgtgctctctggtttacagagttcttttttatccatcatctccttgggttctcccaacttccctgaactcccagagtctggtaccttgccaagctgctattggccaaggccacagtccacgcccatgtcccaggtttctcctgctacagaaaggtgggctggggatcctggagacagctgtacccatttctctctcttgcaggtcgtgttttcgcctggggcatgggcaccaactaccagctgggcacagggcaggatgaggacgcctggagccctgtggagatgatgggcaaacagctggagaaccgtgtggtcttatctgtgtccagcgggggccagcatacagtcttattagtcaaggacaaagaacagagctgatgaagcctctgagggcctggcttctgtcctgcacaacctccctcacagaacagggaagcagtgacagctgcagatggcagcgggcctctccccagccctgagcactgtgtcagttcctgccttttctcatcagcagaacagaatccttttcctcttttccttcctcctctttggaattttcctgggacctacagaataaagggggggatggacagggggttttcaaaaggaacatggctcactcagagctatatggttagacgtttctccccttttccctaccttccatggtcctggttggccctggctttgcctactagaaaaccaaaacttcccccctggggttttgtgcccactctctgagaagttggggctccatcaagccccattctagtcatgtgcccctttcctgtccctaacagtccacaggcaaacaaatggtacagtcataagagccatctgtcacggacccacgcccagaggaacgtgcagaaaaaagcagagctacatggctgtgggcaactataagccaaatatttggctcagaacaggtgtccatgggacaaaaaagaacgatcctccacttgaccaagaaaaaagtgattctcccagaagcacaaagcatactcttgcccctcaggtgttgcttgtgtacatcgtacccatccattcggcttcacctgcagccaacggcctggaatcgcaaagagacaccactctgggcagagcagagcagggtatggggtggggagagagggtggagggttttataaacaaacttaacagcaatattgaaaggaggtgggggattgagggagggacagagtgttggagggccagagactagtcctgagatggaaacagcaacttgtacagtggctgagaaaataggatatagttttgatttttttaattgtaaaatattttggagggagaacaaaatcttttaacattttgaataaatttagagttttataaaataggccacttgttttctacacattccctgctttttaagggagcacatattatgtgccaggcactgctgggaaagacagaataaactataaacctggtgttgaggctacaacttaagtgatgtcaagatgtcctgaggtgccaaccagctgtcagtgtgactgtaacaaaggcttcaaatctgtcaagaagtaaggaaaagttttgtttg

SEQ ID NO: 193 - DNA, 33254 bp, Homo sapiens; identical to SEQ ID NO: 192
  source 1..33254: mol_type = genomic DNA

SEQ ID NO: 194 - DNA, 33254 bp, Homo sapiens; identical to SEQ ID NO: 192
  source 1..33254: mol_type = genomic DNA

SEQ ID NO: 195 - DNA, 20964 bp, Homo sapiens
  source 1..20964: mol_type = genomic DNA
tgcagagcgcatgctctggggcagttcgcggcccggcggggagcgccggagttccttgtggccgacgtgcaccaaggtaggtctcgcctgggacgcgcggagggtccgggcagagggcggtaagcggagcggccacagccggagcacgggccggtccacgcgggcctaagtcgctgcccgctctcgcccgtgtcgcgcggcgccggccccacgtgaagcccggaggcaggaaggcgcggtgcgggctcgcgattccccggccccgcggggcgctccagcagcggctgggcgctgcctcgctggagctagggccgcgcggcccctccgccgccgcgcctctcacgcccgcaccgcggcgcccgcgcaggcgggagattcaaactgcgcgagcgcggcgggccgggtgcgcgcggccgcccgggcgggggatgggtctctgccgcgaggaggatggttttgtccggcatgcgcttggagaaggcggtttgcagatcggggagggagccctgcccgggagagggtgggtcgtaggagctcgagggtctcccgctgtggacctttgggagccgtgtgtcttgaactccgcagcagctcagtctgtcagcagattatttgctggccatttattgcgtccctctcttgcggggctgggggacagtagtgagaagagcaggcccgtgtcattagcgaactatgcccttgaacccaggcgacggacgctactggcaagtcattcatacgtcacatattgacctaacttcgaccacgtgtgacttgtgtgccctagcagaagttgagtgtgtggggtgttacggggagccctcagggggatcccccaccctgcccaggaggctcagggatggctttccaggtgaagtgactcttgaatggggttttgaaggaacagagtttttcaggcagtctgagggtagtgggattagggtgatacaggcagagggattgcacgtgcaacggcatgaaggtataggtattgtggtcagggataccacaggtcttgaggtgactggaggaggagagtaacaagatgatacagcaggggctgggtcacgaagcgtcttgtgtgcaagactaaggaactctgcggggtggaggaggcagggaagatttcccccaagaagggtatcagagtgaaacctggacagatgaattaggagttcacgaggctcctgtttcaaagacatcccaagagcaggaatcctgttctgttcatcgttacaactttctcatcagatgcccttgggcaacccacccagtcccccagagcattggtttccttatctgtaaagcaatggtagggggcatgtggtgaggatataatttttttttttttgagacggagtttccactcttattacccaggctggagtgcagtggcgcgatctcagctcactgcaacctccacctcctaggttcaagcaattctgcctcagcctgctgagcagctgagactacaggaacacaccaccaggcccagctaatttttgtatttttttttttttagtagagacggggtttcaccatgttggccaggctggtcttgaactcctgacctcaggtgatccacctgcctcagcctcccaaagtgctggaattacaggtgtgagccaccgcacccggccaattttttttttttttctgatacagaatcttggtctatcgcccaggctgtagtatagtgtcgtgctctcagtcgctgcagcctccacctcccgggttcaagcgattctcctgtctcagcctcccgaatagtaatatcctataattttcataaagcagtgaagttgtgtgtcccttcccccaggaaaaatgaacacataggcccaggcacaggttgtatagaacggggatcccaggtgagaaactcctagtgtgaaatataccacctgtgtgcctggcataacagcagctcaccaaatgtatattgttgacacatgagccctctcctcccttccctcctggggaccttacacacagagatttttcagccttagtctggcaggcaagttcttcctcctggtgtgggggacggagggcacagctgcagtggcctgggagggctctgtctccttttacagaaatcgaggctgtggtgaggtcactggaggtcagggcaggagcaccaggctccgggcagactgtctagactggcgtgcctacccactttcttcaataaataaggaaggtgaggtgggggtagggcagctccagctctggtggagcatggtcatgagactgggatttcattccacctctctgtgacctgggtcacctttccctgagcctcatcttccccttagctgtaaaactgggatgagtctgctcacctcaaagggcagctgtgggcattcaggagtgcctgatggtggaagctgactctgtagccgacttatctgtgactgtctcactcttctcccagagactgtatgctccttgaagatggaagctgtgttgtgtggggcggggtggggaagcatgatgccaaaagccaactccttattcccagcccagacactcactgcctggttaagaaaacagccagagaggccgggctcggtggctcacgactgtaaccccagcaatttgggaggccaaggtgggcagatcacctgaggtcaggagttcaagaccagcctggccgacatggtgaaaccccgtctttactaaaaataccaagcagttagccaggcgtggtggcttgcgcctgtagtcccagcactagggaggctgaggcgggagaatcgcttgaacctgggaggcggaggttgcagtgagctgagatcgtgagtctgaactccagcttgggcaacagagtgaggctccatctcaaaaagaagaaaagaaaagcaaataaaggaaaacacacccagagcagtgagagaagtctgtatacaagacccatttgtgcagtagaggctgtgcaggcaggtaccgggaacagggctccaccttttagaaggtggtcctctggccgggagcagtggctcacgcctgtaatcccagcactttgggaggccgaggtgggtggatcatgaggtcaggagatcgagaccatcctggctaacacggtgaaaccccgtctctactaaaaatacaaaaaattagctgggtgtggtggcaggcgcctgtagtcccagctactcgggaggctgaggcaggagaatggcgtgaacctgggaggcggagcttgcagtgagccgatatcgcgccattgcctccagactgggcgacagagcgagactccacctcagaaaaaaaaaaaaaaaaaaaaaagaaggtggccctccatcccctgcccttccctggcgattgccagcccagtgcagggcctcaagtcttccattttggagaggaagcctctgggactcaaagagcactcaggtgccgtctccaccgcagcagggagttgtcgccactgtccttccccacatctgtgggtggatctgtcaccacccaccccaccttccctcaggctctagctgcctcattgtctcctctctggtctcaccatcctctcctcagctggcttctgctctctgcttcttggacttggccaagtgcataggggatactggggaggcctgcccagactgccttagcccctgcctggaccaaggtctgccttcagaatcagtcagataggcctgggttgcttttctaggctgccctttacttgctctgtgaacttaggccgataaagttatctttctgagcctcagttccttaactgtgaaataggagtgacagtgctgccttcttcagcttcctgtgaggaataaaagggttttgcatatggaagatacagtgagttagccggtgcccccaggggctcatattttaggaagttgattggtatggtggacaggcatgtaaattaaagtgattgtgatccaaaagtctgtcccagtttctcagagagaatgactagttcaggatggaggagggatcagaggaggtgactttgagacaccagtagatgttcttccagtgggataagggatgggaaggcgttccaggtaaagagatgcaaatagtatggagaggacagttagcattctggcctggtgggtctggcaaggagattgtgtgggaagagaagggaggatgtgatagataggaaatgaagctaaaggttctgtcagtacccgatgttggagacctctaatacccagctaagaaatgtgggctttatcttccaggaaaaggggaccactaaggagtccaagcaggccagcagcttgcttcaggtttgaggtttggaaagatcatgaatgaggccgggcatggtacctcacgcctataatcccagtactttgggaggtcgaggtgggaggatcacttgagcccgggagtttgagaccagcctgggcaacatagtgagaccttgtctctacaagaaaaaaaaaaattacaaattagccaagcgtggtggtacatgcctgtagtcccagctactctggaggctgaggcaggagggtcgcttgagcctaggaggtggaggttgcagtgagccgtgtacgtgctgctgcactacagcctgggcaacagagtgaaaccctgtctcaaaaaaaaataaatatatatatgtatatatatacacacacacatatttattgatcacgaatgacttggagaatgagaggaggggatgagggtggggaccggaagaccagtgaaaagttgctgtctttcctagggaaaggaggaggagacacagttccaggcaagctgagagactactagggagcatggggaggaaggaggcagaagaaatttcttttttttttttttttttttttgagacggagtcttgctctgtcacccaggctggagtgcagtggcgtgatctcgactcactgcaagctctgcctcccgggttcacgccattttcctgcctcagcctcccgagtagctaggactacaagcgcccgccaccacgcctgtctaattttttgtatttttagtagagacggggtttcaccgtggtctcgatctcctgacctcatgatccgcccgcctcggcctcccaaagtgctgggattacaggcgtgagccaccgcgcccggccagaagaaatttctaataacactcaaggacgccagctctggagtctgactaacttggttcagatcttggccttctcttccaatcttgagtgagatacttcacctttctgagcctcagttttcttctctgtagagtgggatcattgtggccagcttgtagtgaaacgctccagaatattagccaaacacaactaaggagatgttgactgggtttgttccatccatgataacagattttttggttaatgccccatgacaccaacacttcatatagcccttatgtgtctgactccattccgggctgtgctcatggcagcccagccatcagcaccaactgtgctgacataattgtttcctgctttttctcctgacttcttattgtgagtacttttcatgctaatacagtctccctcccaggcacagcagactgctacagattattctgatgaactgatgagatgtttgccttggcatacagctgtctatctaaaacaagggtgcctctttttttggtggagggacagagtttcactcttgttgcccaggctggagtgcaatggtgcaaactcggcttaccacaacctccacttcctgggttcaagcgattctcctgcctcagcctcccgagtagctgggattacagcacgcgtcaccacgcctggctaattttgtatttttagtagagatggggttcctccacgttggtcaggctggtctcgaactcctgacctcaggtgatccacccgccttggcctcccaatctgctgggattacaggcgtgagccaccgtgcccggccacaaagatgcctcttatatcccacatccctaccccatctaactttgcctgcctgacatcctttctgggatggctcccaagcacttcagattgaatgaaaacacctagcaacatggagcttcacgtctcttctctcctgtttgttcaacagtgttctctatctcactacatggaagtctaccatctacctggtcatttaagcccaagcctgggagtctttgtgtttggccaagctcatagggggatcttgggcaggcctgccaagaatcctctggacttttttaggatgaacaaatcaagccaagtgctgtggcacgtgcccatgatcccaggctcttgggaagctgaggtgggaagatcgcttgagtccatgagttcgaggctgcaataagctaattgcaccactgcactccagcctaggtgacagagtgagaccccctctcttaaaaaaataaaataaaaggccaggcatggtggcttacacctataatcccagcactttgggagtccaaggctagagaatcgcttgagcccaggagttcgggaccagcctgggcaacatggcaagacgttgtttctgcaaaatatacaaaaattagccgggcgtggtggtgcacacctgtagtcccagctatccaggatggctcaagcccgggtggttgaggctgcagtgagccatgaccatgccactgcactcaagtctgggcaggaccctgtctcaaaaataaatacaaaggatgaacaaattatgagagtaaaaaagggttagtctcctttatccttgctacacctcctcacccaaagccaagcagtagtgtagcaggataagccgcagacaaaaccccccagacacccagttaaagaaggaagggctttattcagctgggagctttggcaagattcacgtctccaaaaactgagctccccgagtgagcagttcctgtcccttttaagggcttacaactctaagggggtctgcatgaagaggtcgtgattgattgagcaagcaggggatatgtgactgggggctgcatgcactggttatcagaacggaacagaacaggacagggattttcacagtgcttttccatacgatgtctggaatctatagataacataaccggttaggtcaggggtcgatctttaaccagacacaggtcgcggcgccaggctgtctgcctgtggatttcatttctgccttttagtttttacttctttggaggcagaaattgggcataagacaatatgaggggtggtctcctcccttagtagtaaagcactataaatatttgtggatttacaaccatttcattcagtcttgatgacagccctgagaagtagtcattgcatccccttttatagatgaggatacagttcagagaggttaaggcaactggccagccacaagctctggaaggtgaacccagttccctctaatcccaaagaatgtgcactttttagtgtgggacaaggggtctcaaaagacaggtgggaggattctcagccctgggagaataaaagttgggtgaagttcagaactgccacctcatcagtcagaactgggccagtgacaacctgcagaagctcagcctgcaaaggcttatcaggattctagacctttggttactttcccatctttagtatttagttctccttccccaggataatcagcagaaaagtgcctggccttgtgtccatataccatggaggggagagctagagaggcgaggttctcgggaaccactagaaggaaggaatgagggggctgctggttaggcccagagctgagaccgagaagggctcttggagttctccttcccttcgtaacattaggtagaggcttagacaacttgattgtttttcatgaccttaaagactgtggctccggccgggcatggtggctcacagctgttgtaatcccagcactttgggaggctgaggcgggtagatcgcttgagcccaggagttctagaccagcctgggcaacttggcaaaaccctgtctctacaaaatatataaaaattagctggacactgtgatgcgcacttgtagtcccagctattctagaggctgaggtgggaggatcacctgagctcaagaggtcaaacctgcaatgagccgtgattgtgccactgcacttgagcctgggcaacagagagtgagatgctgtctcaaaaaaacaaacaaacaaacaaacaaaaacaagtacttgatgactccattggggtcaattatgaagagacctcttagtgcaagaccaggaccttctaacagcacaccgaagtctcgagaaattcgcttagttaaatctgacaagggtgcgatgtttatgtggcccaaagcaccattctttcttggtgtatttatccaggcaagacggctaaagtgggaatccactgagactgcaacaacttcaaagttcacatcgtgaaattccttagctttgtcactagaagcaacaatttctgtaggacacacaaaggtgaaatccaaaggatagggctgggcgcggtggctcacacctgtaatcccagcactttgggaggctgaggtgggtggatcacctgagttcaggagttcaagaccagcctcaccaacatggtgaaatcccatctctactaaaaatacaaaaattagccaggcgtcgtggcaggcgcctgtaattccaggtactcaggaggctgaggcaggagaattggcttgaacccaggagggggaggttgcagtgagccgagatcgtgccactgcactccagcctgggtgacacagcaagactccgtctcggaaaaaaaaaaaaaaagaaagaaatccaaaggatagaagaaaagcaccaaatatttcccctcaaagtcatcaaggcttaggtctttgaactctccattgaccacggctgtacccttaaaatagggcgcatgctgggtgacatcaggtgcatggtatgaggaactggtaccagaattttgcttgaccggaaccagaccacaatatgtttgtcaaacttgttcttccagaagcagcaggcctgagggctgcagtggcagaaatgcccccaaggaatggcactcacatgccgggcaactgatgctcagagtaaccttcccacagcagccgcgatcttcagtgcatgtgtgtttttgtttttttgagacagtgtctgtctctttcgcccaggctaaagtacagtggcacaatctcagctcaatttagcctcagcctcccaggctcacgccatcctcccacctcagcctcctgagtagccaggacttcaggcgtgcaccaccatgcccggctaatttttgtaattttttggatagaaatggggtttcgccatgttgcccacgctggtcttgaactcctgggctcaagcgatcctcctgcctcgacttcccaaagtgctaggattacaggtgtggtggcaccttgtctctaaaaaaaatcaatcaattaaataagaaaagaaaatagctcttctccccctctgattataacaacacattaccaaagttactggtgcttacatggggttgaatggagttatgatggatatttcatttaatgttgttcttcaatgttttaattttttacaacagacttaaaaattttttaaatacatgtggccaggcacgatggctcacgcctgtaatcccgcactttgggaggccaaggtgggtggatcatctgaggtcaggagttcaagaccagcgggaccaacatggagaaaccccatctctactaaaaatacaaaataagccgggcgtggtggcacatgcctgtaatcctagctactccagaggctgaggcaggagaatcacttgaacctgggaggtagaggttgtggtgagccgagattgcgccatggcactccagcctgggcaataagaacaaaactctgcttcaaaaaaaaaaaaaaaaaaacatgtaatcggctgtacgcagtggctcacgcctgtaatcccaggacttcgggaggctgaggcaggtggattacttgagattaggagtttgggaccagcctggccaacatggtgaaaccccgtctctactaaaaatacaaaatttgggctgggcacagtggctcacgcctataattccagcactttgggaggccaaggcggggtggatcactgagatcaggagttcgagaccagcctggccaaactggtgaaacctcgtctctactaaaaatacaaaaattagctgggtgtggtggtgggtgcctgtaatcccagctactcgagaggctgaggcaggagaatcacttgaacccaggaggcagaggttgcatgagccgagatcgcaccattgcactctagcctgggtgacagaacgagactccatttcaaaaaaacaaaaacaaaacaaaacttagcagggcatggtgatgcacacctgtaatctcagctactcggaaggctgaggcacaagaattgcttcaacccgggaggtggaggttgcagtgagctgagatcatgcctgtgcgctccagcctggcgacagagtgagactccgtctcaaaaaacagaaaaatacatgtaatgctccttgttaaacatcttagataatataggaagataaaacgaaacaagtaatgattatctataataccattttccgaggttaccattgttaatatgggatatattttcttccccacatttttctcacatattttttgtgtatgcattttttttccaaaaaaaaaaaaaatggatgataggctgtttttcttccttttttttttttttttttttggttggggggtggagtttcactactctttctcccaggctggagtgctgagtgcaatggcatgatcttggctcaccgcaacctccacctcctaggttcaagcaattctcctgcctcagcctcccaagtagctgggattacagtcgcacaccaccatgcctggctaatttttgtatttttttttttttttttggtggcgacggggtttcaccatgttggccaggctggtctcgaactcctgacctcaagtgatccacccaccttggcctccgaaagtgccaaagtactgggattacaggcgtgagccaccgcgcccaggctttttttttttttttttttttgagacagtctggctctgttgcccaggctggagtgcagtggctcgatcttggctcaccacaacctccacctcgcgggttcaagcgattctcctgcctcagcctcctgagtagctgggattacaggtgcccatcactgtgcctggctaatttttgtatttttagtagagacggggttttgccatgttggccaggctggtttggaactcctgatctcaggtaatccgcccgccccggcctcccacagtgttgggattacagatgtgagccaccacacctggccgtctgtttttcattctgcttgttttacttggcaatggggaacatctttctattcaatagattgatctctgaaaacatcacttttgatggcttcatactgttctatcatgaatataccacatatttagttcactactattgaacattcgggttctgtttttgttgtttttaaaatgttatgaaggatacagtagagaatatttgtgtaattaatctgtgggtgcatccattattctgttcttgggatacattttgagaagtggaattgttgggcaattcctcttaacgtatttctagagtgtttgataaatattgtctgattggcccaggaaaatgtttgccatttctcatatgtagtatttgactgactttcaggacaggaagatgtcacccaagcgcatagctaaaagaaggtcccccccagcagatgccatccccaaaagcaagaaggtgaagggtaagttggccttggcctctttgtgggtacaggtggccccttgaaaccctaagaacccgggactgggctcctttcttcctgaggcttgaagctgaagggtgtggatgtgcagagaccccacccagctggaaggtttcctgtagctcattgaatcctaccctctgggaatcacaaagtgggcagaaactcctctcaaagcactcaggcagcactggcacaaaaaaaaaaaaaaaaaaactagaccctagggcttcaccccaggcagtgatgcattatggttaggaccactgactttccgacatgggttcaagtccttgctctgccactttctagctgctgggcaagtcacttaatcccgcagtttggattatcaacttcttaaaatggcggcagccagagcagcgtcaccctctctgggctgtgtgaggatgagatgagataatggcctggcagcatttgagggaggtggctgtggtttcctctgtcctgggaccccggagggggacagggaggagagaaaagccagcaccaaactgggaggggaagtgtggacccacgctcagacagtgtctgtcttttgcagacacgagggccgctgcctcccgccgcgttcctggcgcccgctcctgccaaggtgcctgcgggccgagccctcctgaccagaaaacccgaccaggtggctccgcgcccggggcgccctctgtgctgccagcgcgggctcctcagcggtggccacatcctcgggggaggggctgggcgccattggctgcccggggctgcgggttggggggccgcctttggcccacagagagccccgggcgcgcacctcccgcaaatgccgctgtccgctcttcctcccgcccctcctgcctctccactggatggtggagggaagagtccgtttctgcagtggatttgcccgggagctgaacttattcactggcggacggcttgggcatggaggagggcttggatggagactggggattgttctctgacccacgtagtctcccttgctttcggtgcagattctgctattataattagctttctgcggggcaaggtggctcacgcctgtcagaagatcgagaccatcctggctaacacggtgaaaccccgtctctactaaaatacaaaaaattagccttgcgcggtggcgcgcgcctgtagtcccagctactcaggaggctgaggcagaggaatcgcttgaacccgggaggcagaggttgcaattagccaagatccaccactgcactccagactggcgacaaagggagactccgtctcaaaataacaataacaataattagctttcttttctttttctttttttttttttttttgagatcaagtatcactctgtcgcccagactggaggcggcagtggcacgatcttggctcactgccacctccgcctcccaggttcaagtgattctcctgcctcagcctcctgagtagctgagattacaggctactgttggcaaggctggtctcttaactcctgacctcaagtgatccgcccgccttggcctcccacagtgctaggattacaggtgtgagccaccgcacccagcccttcttgccctctccaccaagattcatttcacagtatccagtgtctccttgtttccctttctcccctttcacgtgaataatgtgctcagttcttaatctccacaaaaatcctgtgagagaggtacttttgttgtccccatttcacagatgacaaaacttagaaagttcatactaacagtctgtggcagagcaggggcttctgcacaggtttgtctgatcccagagcctgtgacctctcctcgctgtcgtcatcctctacactcagggtctatcttcttcacccttcagtctcacacaggtcccacagcacagaacccggcttggtgctgacactaggccagggcgacgtgggccagctggggctgggtgagaatgtgatggagaggaagaagccggccctggtatccattccggaggatgttgtgcaggctgaggctgggggcatgcacaccgtgtgtctaagcaaaagtggccaggtaggtgttggggactggcacagggttggacaaggcctggggttgggtggcttggggcagggcttttgaaccacgcatgttcactgtggaaatggagctggctagtcaagtggggagtggcctacatgagaatggactgcgaggccagacgttgcattaatgagggcatcctgggcacaggtctattccttcggctgcaatgatgagggtgccctgggaagggacacatcagtggagggctcggagatggtccctgggaaagtggagctgcaagagaaggtggtacaggtgtcagcaggagacagtcacacagcagccctcaccgatgatggccgtgtcttcctctggggctccttccgggtaaggctgggtctgaaagtctgcatggtccctgaaagacagaattaattggcggggccccaaagataatccacttccatgcccccatggtacttactggtggggagatgaaagcccacaggtagagctgaggcccagacccaggactctagcttcctcatgtgggcctgtccacgccactggctgcttccttgaatccgatgtcatcaagtgtctgtcctgggaagtgagtgggtcaaggatgtccctgggttgaggctgatccaggaggcctgctgtcttcacccatctccctgacttctgtctccccctcaccttgccagcactgcctcttccacacttcccagaggcttggatggggcaaggaggtgtggaggcagggattgtcgcatctcagagtttccaaggtacagaggagtgtagttgaaaaaacagattgtgggtttttgttgttgttgttgttgttgtttttgtattgttttgagatggagtttcactcttgttgcccaggctggagtgcaatagcgcaatcttggctcactgcaacctctgcctcccaagtttaagtgattctcctgcctcagcctcccaagtagctgggattacaggcatgcgccaccacgcctggctaattttgtatttttagtagagacggggtttcccctgttggtcaggctggtctcgaactcccgaccccaggtgatccacccgcctcagcctcccaaagtgctaggattacaggcgtgggccaccacacccggcctgatgggtgtttccttatcacatctattttgaaattttcatggagaatttcaaacacatgaaagtaatcagaattgggctgggcgcggtggctcatgcctgtaatcccagcactttgggatgccaagatgggcagatcacgacgtcaggagatcgagaccatactggctaacatggtgaaaccccgtctctactaaaaatacaaaaaattagccaagcgtggtggcgggtgcctgtagtcccagctactcgggaggctgaggcaggagaatggcttgaacccgggaggcggagcttgcagtgagccaagatcgcgccactgcactccagcctaggggacagagcgagactccatctcaaaaaaaaaaaaagaagtccgggcgcagtagctcatgcttgtaatcccagcactttgggaggccgaagcaggctgatcacctgaggggtcgggagttcgagaccggcctgaccaacatggagaaaccctgtctctattaaaattacaaaattagctggacatggtggtgcatgcctgtaatcccagctactcgggaggctgaggcaggagaattgtttgaacctgggaggcggaggttgcagtgagccgagatcgcgccattgcactccagcctgggcaacaagagcgaaactctgtctcaaaaaaaaaaaaaaaaaaaaaaaaaggaagtaatcagaatatcagaattatatttttttcttttcttttcttttcttttttttttttttttttttttttttttttttttttttttttttttttttgagacagagtcttgctctatcacccaggttggagtgcaatgacacaatctcggctcagtgcaacctctgcctctcgggctcaagcaattctccttcctcagcctcccgagtagctgggattacaggcatgcgccaccacacctggttaatttttgtatttttagtagagacggggtttcaccatgttggccaggctggttgtgaatttctgatctcaggtgatccgcccgtctgggcctcccagagtgctggattgcaggcttgagccgccacgtctggcctcttttcttttttctttgttttgagacggagtctcgctttgtcgcccaggctggagtgcagtggcgcgatctcggctcactgcaagctctgcctccctgattcacgccattctcctgcctctgtctcccgagtagctgggactacaggcgcccgctacaacgcccggctaattttttgtattttttggtagagacggcatttcaccgtgttagccggaatggtctcgatctcctgacctcgtgatcgcccgccttggcctcccaaagtgctgggattacaggcatgagccaccgcgcccggcctcttttcttttttaattagagacgagatcctgctctgtcacccaggccagagtgcaatggcatcgtcttagctcattacagcctcaacttcctgggctcaggtgatttcttccacctcagcctcgcaagtagctggtactagaggcttgtgccaccacgcccagctaatttttgtattttttgtagggacggggtttcaccgtgttgcccaagctggtcctgagctcaagcgatctgcccacctgggcctaccaaagtgctaggattactggcatgaattaccatgcctggcccagaatagtatattgagtgcccatttacttgccacacagtttcaatgattatcagcttgtggccagacttgtttatctctatttgcatccgctctctgactccttgattattttaatgcaagtcgcagaccataaatgatttcattcataagtatttgagtatgtggcctggctcctgcccacttctccatccccatctggtgccactgcccttctggatttcactggcacggggcaggcaggactggctgataagtgccctgtccctcccttctaggacaataacggtgtgattggactgttggagcccatgaagaagagcatggtgcctgtgcaggtgcagctggatgtgcctgtggtaaaggtggcctcaggtgggtctgggggcacttgctcagggcaggagttggaggaccttgttctggggctggcctagccttgggccttacagttgtggcctgcatcccttaccttttcatccttaggaaacgaccacttggtgatgctgacagctgatggtgacctctacaccttgggctgcggggaacagggccagctaggccgtgtgcctgagttatttgccaaccgtggtggccggcaaggcctcggtaagtggccttggtacctccagcagggcaaattggcaggccacccccacagtgaaggccaaaggcaggaaggatttgctgtggtcaggcttgcatcagatgggcttgtggtgttggttaggactttggagacagactgctctggtagttttgccacctactgtctatgggactctgaacatagtttcttcatcactaagtctacctacctgtaaacctacttcattaggttgctgtgaagttaaatgagttaatgagaagaatatcaggcagatggtaagttccacgtaaatgatacccgtaatgactgtgggaatctgagcaaggcacttgtattctcttgatctcagtttccttttctataaaatagggataagagtccctacttagcctctcaagggcttttataatggaggagaattaaactcggggcagagagaagccatgtgtgtctgtctgtcactgaccgtggctttccctttgcctgcagaacgactcctggtccccaagtgtgtgatgctgaaatccaggggaagccggggccacgtgagattccaggatgccttttgtggtgcctatttcacctttgccatctcccatgagggccacgtgtacggcttcggcctctccaactaccatcagcttggtgagccccgagcccagcttcaggcatgacccagtggcctgcgttcctgtcctggctctgccactcattcattgtgcatcctttgcggggtcgtctaacccctccaagccagttttgtcatctgtaaagtgagaatgtccatatcctgatgggaggtggcctcactgtgggaggagattgagaagggcagctctcagaacaccttcacccctgatggctccggcctttcccccaggaactccgggcacagaatcttgcttcataccccagaacctaacatccttcaagaattccaccaagtcctgggtgggcttctctggtggccagcaccatacagtctgcatggattcggaaggtagggcctttacgtccttctctagtttgggggtggagtgttccctggcctaggcctagccagattcctgagaccatggtccttggagcctgggtctgttccatgggttgtaccatacatgggtccatgagagtcactctcatcctcctagagtcctggtgttcttccaagtgtgagttcaatgggggcccatgtagattctcctaggcctcctccaaaactgggaagagacactgcagatctccttctgatcgctctgggagcagggacacactcccatggacaggtggactcacctagcctgccacccattttgcctgtagcacgccctctgctattgctcatctctctccctcctcccataggaaaagcatacagcctgggccgggctgagtatgggcggctgggccttggagagggtgctgaggagaagagcatacccaccctcatctccaggctgcctgctgtctcctcggtggcttgtggggcctctgtggggtatgctgtgaccaaggatggtgagtggggctgcctacactctgtctagttgggacctgggggtcatggttcttacccaattccccaataggctgtgatgtccactctcgggggagccgaggtacagagagcagtgtttgtgatggcactttgttcctgcttctcagaagctctggcattgatgaatatgaaatgagtacacaaattattttagtaaaggtgacttattatgcagaggagagaaatagcaaagagtgagatatcactgaggcctaaggaggcaatgggactggaacccaagtctccagactcctaacccaggctgctctctcccctcagggtgaccccttcatatatcaccttgtatgttcccgctttccagggacttttacttagaatctaaatcaagaaaaaaaaaggcttagtagtcagagttgtagcaactatagcagaggagggtgtgaacaagtgaccaccaaagcctgagtgggtgagggggatagccatggaggtcctgtagaagcctggagctggcagaggtgcttgacctgaggttatctgggaagacttcctcaggaagtggggcttgcactgtaccttgaaggttccattccttgtgaaaagcaaagaatgccattccaggcagaggaacatcagggcagtctcaaaggtggctggtcctgggaacagagggtggggtaggaccttgaatgccacgcctaggagcagcctttggcagtgtgtagggactgtgctctctggtttacagagttcttttttatccatcatctccttgggttctcccaacttccctgaactcccagagtctggtaccttgccaagctgctattggccaaggccacagtccacgcccatgtcccaggtttctcctgctacagaaaggtgggctggggatcctggagacagctgtacccatttctctctcttgcaggtcgtgttttcgcctggggcatgggcaccaactaccagctgggcacagggcaggatgaggacgcctggagccctgtggagatgatgggcaaacagctggagaaccgtgtggtcttatctgtgtccagcgggggccagcatacagtcttattagtcaaggacaaagaacagagctgatgaagcctctgagggcctggcttctgtcctgcacaacctccctcacagaacagggaagcagtgacagctgcagatggcagcgggcctctccccagccctgagcactgtgtcagttcctgccttttctcatcagcagaacagaatccttttcctcttttccttcctcctctttggaattttcctgggacctacagaataaagggggggatggacagggggttttcaaaaggaacatggctcactcagagctatatggttagacgtttctccccttttccctaccttccatggtcctggttggccctggctttgcctactagaaaaccaaaacttcccccctggggttttgtgcccactctctgagaagttggggctccatcaagccccattctagtcatgtgcccctttcctgtccctaacagtccacaggcaaacaaatggtacagtcataagagccatctgtcacggacccacgcccagaggaacgtgcagaaaaaagcagagctacatggctgtgggcaactataagccaaatatttggctcagaacaggtgtccatgggacaaaaaagaacgatcctccacttgaccaagaaaaaagtgattctcccagaagcacaaagcatactcttgcccctcaggtgttgcttgtgtacatcgtacccatccattcggcttcacctgcagccaacggcctggaatcgcaaagagacaccactctgggcagagcagagcagggtatggggtggggagagagggtggagggttttataaacaaacttaacagcaatattgaaaggaggtgggggattgagggagggacagagtgttggagggccagagactagtcctgagatggaaacagcaacttgtacagtggctgagaaaataggatatagttttgatttttttaattgtaaaatattttggagggagaacaaaatcttttaacattttgaataaatttagagttttataaaataggccacttgttttctacacattccctgctttttaagggagcacatattatgtgccaggcactgctgggaaagacagaataaactataaacctggtgttgaggctacaacttaagtgatgtcaagatgtcctgaggtgccaaccagctgtcagtgtgactgtaacaaaggcttcaaatctgtcaagaagtaaggaaaagttttgtttg

SEQ ID NO: 196 - DNA, 20964 bp, Homo sapiens; identical to SEQ ID NO: 195
  source 1..20964: mol_type = genomic DNA

SEQ ID NO: 197 - DNA, 20964 bp, Homo sapiens; identical to SEQ ID NO: 195
  source 1..20964: mol_type = genomic DNA
